United States Patent 11,001,841 (CCCTC-BINDING FACTOR (CTCF) RNA INTERACTOME) - sequence listing, part 37

SEQ ID NO: 88838 - DNA, 1639 bp, Homo sapiens
ttttgggaaatagctttctgatttggatcatagataaagtgccccaggaaacttaggaaccctttcattttagaacaaaaagactcaatattttttcctggataacaagcataagcaaataccatccttaagcacactaagatgtgtcattaccctagtcctcgggatcagcaggtgtgtgccaatacatttcattttgttaatggcccctagtgtcttcagttgagttgttgtcagtgctagtactgaaagccattgagcctgttccctgtattgttgacagctggaggcacatgatacgaaagcgctgttgtacaaaatagggttctttgaattattagctctgtttggattgtcagctctgtatatacgtaatgtccaattagtggtagtggttattttttaaggatcaaatgtggttttattatttttgaagttttatgacctattcagttctttgtgttcacttctaaaaaatttttgaggccttaactctgacattttctaaatttcttaaatgtattgcatttcatttatgtcctccatctgacatttgaaggtgacatatttccctttttttttttttttttttttttttttttttttttttgagacagtgtctcgctctgtcacccaggctggagtgcagtggcgcgatctcggctcactgtaagcgccgcctcccgggttcacgccgttctcctgcctcagcctctccgagtagctgggactacaggtgcccgccaccacgcctggctaattttttgtatttttagtagagacagggtttcaccgtggtgtcaatctcctgaccttgtgatccgcccgccttggcctcccaaagtgctgggattacaagcgtgagccaccgcgcctgaccttgaaggtgacatattttctagaaaaaaatactgattttttttaaatgaagactgaggggctgtaaagaacagggatttcaggggtcttataaagggatttcaggggtcttatcataaaatggttgaatatacattattttctgttgagacagaacaaatggggtatcagtaagtataattagggaatccctttcccacctgtttgtataatacagtattttatctattaaaggaatttgaaaagaaaggaagagaactatggacttaatggttatatgagtctttaagtgtttattggcctgggatgtgtgtgagagagtgagtgtattgggggataggctttaagtacaagagaggtttatgaaattgttcagattgagtgttatcaaagataagaagacatacaagtgcttgtttttcagattattgacaattattaattagtaaacattaaaagccacaaagaattagatggtattcattttaaaacaatgtaaggctggcataaattttaataaagtatgtacatttaataggtgcatgtaatgcaagtagattataactaattttgtttgggaaatacaaaaagcgagttcagaaactacttttgctttaacatagctattattagtattgtttcttatgcattaatgcatttttataaagtgttaatgtttagagcctaatgctttctgtgtcagtcattcccaatatcatgcagaagaaatcagagttcggtgagaatctgagaatatgtt

SEQ ID NO: 88839 - DNA, 2487 bp, Homo sapiens
tccgtaatttaaaattttatgcaatgtaaagaatttaaaaataatcagttgtcgagcttgatgattcttttagttttttttctctttggtgttgaccccatgtatatctttttttcccccttttggagatagggtctcactctcacctgggctggagtgcagtggcacgatctcgtctcattgcaacctccgcttcctgggctcaagccacctcagtctcatgagtagctgagattacaggtgcacaccaccatgcctggctaatttctaaaattgttttttgtagagacagggtctccctctgttgctcaggctgttcttgaactcctgggctcaagcaggccacccatctcggcctcccaaagtgttgggattacagacatcagacatggtgccctgcttcatcctctttaagtttttatcagttttctggtatgagtatgatactttttcccaatttttaaccaaaacctgaaagttcttctattgccatattggtggccattgccacctcctttatagagtaagtcagtgtgccaacctcattatcagaagttggatttgtgctaggatagaatttgaccacactgaaaatcacaaatgagttctaactactattaaggaaaagaacaggaaaaagtattggcagggtaaaatatatctgaaacagttttttaataataggggcggctattattagattggttggggtgggagaaatgggggtgaagaacaaaaaagctagcaagagaaaaactcagagaattgaagtaggctgctttaaaacgttgcttaactgggaagcttgaagaagaatggaagagtctgccgacaggtcacatacatgctgttgttcattagaacctcattataaattttcatttttaaatagattttacatggatttaggcatactaatcaaatcacatccccttcataagaataacaagttttgccctttgaacaatctgtttatacttaatataaaattggcagctgggatggtgtggtaggtgtgcagcctctgataaatcttataaaatgagtattgtggaatgccataaagttgatttagtaaatgtcttttttagcagtttatagctgaataaagcagattttacctaaaattattttaaagtaagtgaatttaattaaaatgaaaaaagcttgttacactaatactgctacgatgtgtggtgacataaatgctgttggagtgaaggatgttggggtactttagacaacgggctgaagaatacataggtgctgtcatagatatttatctccaggccttcactagcttcaaatggttcaatgttggtgaggattaagattttggggctcatagtcttcaaagcatgctaagtgctcctgtgatgttgaatcacgtgaattaaagcaaacagcattactaaagatgacaaattaatagaagttagcttttcttgggcatgttttttcttaggtagtttccgattttattggaatgattacgataatatccccctaccccccagaaccttatttgaattgcacaaccagagcacggaaaatgaccttcaatggattttgttgacgtcattcagcatactttcattgaataactactcttgaccaaagtgctggttttaggggtaaatacaaagagagatggctcttgctctctcagcctttgaagtattacaggaaagaacttgaacaataattattaagatacataataaagtgctatggtagaggtacgtgccagggattatgggaatagagggagtgggctggttatttagactaatctgactgctgacatgtactgatttaggccttttaaagagtttttcatgaacaaagatgtagaatttatattgttatttgtttaaaacctgtaaggagatttggttagttaaaaaattcccaatatctttgtaatgcagaatgatatggaacctagcaaagctgttccactgaatgcatctaagcaagatggacctatgccaaaaccacacagtgtttcacttaatgataccgaaacaaggaaactaatggaagagtgtaaaagacttcagggagaaatgatgaagctatcagaagaaaatcggcacctgagagtaagttctgttggttgaaaataaattgattgaaatgaaggtataggacatgtgagtgttattaggccattttagcaattagcttttaaatttttgcttggtcagttctttcttctttgccccagtgcctttgctccccaccctactcctcttttaacagtcttcccgtggtttctcattgctgcaagttccttactttagcacacattctaattatttgtgatctggcctgcagtattgccagcttctgctcttgtttctcatgtccttcccattttgtgccctagtcatactgaactgcctaggattgtgttgtcccacatcatagccattagtcacctagggctgttgagcactgaaatgggatttgttcaaattgagc

SEQ ID NO: 88840 - DNA, 1553 bp, Homo sapiens
gtgggatttaaaaaaaggtaaatatagcctatctaacttttgctttttaggaatacatttctcagctccagttttaaaaaatcagtgttattgaggtataatttatatcccatggagacacccactgtgagtgtacaattcattgatacatagaactttgtaaccatcactatagttcagttttagaatgtctatcacccccggaaagtttccttatgtggttagcagttaatccccttttccgtccccagccataggcaaccactaatctactttccgtccctatagatttttagctccagtagtctcgttagtatgcttgtttttaaaaaccttttgtgtgtgtgttttttttctaggatgaaggtttaaggctcagaaaggtagcacattcggataaacctggatcaacctcaactgcatccttcagagataatgtcaccagtcctcttccttcacttcttgttgtaattgcagccattttcattggattctttctagggaaattcatcttgtagagtgaagcatgcagagtgctgtttctttttttttttttctcttgaccagaaaaagatttgtttacctaccatttcattggtagtatggcccacggtgaccatttttttgtgtgtacagcgtcatataggctttgcctttaatgatctcttacggttagaaaacacaataaaaacaaactgttcggctactggacaggttgtatattaccagatcatcactagcagatgtcagttgcacattgagtcctttatgaaattcataaataaagaattgttctttctttgtggttttaataagagttcaagaattgttcagagtcttgtaaatgttattttaataatccctttaaattttatctgttgctgttacctcttgaaatatgatttatttagattgctaatcccactcattcaggaaatgccaagaggtattccttggggaaatggtgcctcttacagtgtaaatttttcctcctttacctttgctaatatcatggcagaatttttcttatcccttgtgaggcagttgttgactgagtttttcatccttacaatcctgtcccatggtatttaacataaaaaaaaataaaactgttaacagattcttgctcgatagcttgtttgtgtctgtcgtgttattagagggaactccactatatatggtcacttgaaattatgatgcaaaggtttctcttgcattgaaaccctcttggatattacagtatttttaattgaaagtcctaattctgttaaggaaaggagttgattaaattttaaggtaccactggtattttgggagattataatcagtttgttttcaagataatagaaaataaggtccatgagaatagaagttatgtgatttcagtgagttgatgtgtacagcatggctgtgctccatctgatttaccccattcttaagttctgagagtatgttctcaaggaagatttaactctctttggttttaaattactttttaaccagcctaataaataagtcttactacttttcataatatttcataatagttaaaa

SEQ ID NO: 88841 - DNA, 1126 bp, Homo sapiens
tcaccatgttggtcaggctgggctcaaactcctgaatccgcctgcctcggcctcccaaagtgctgggattacaggtgtgagctgccgcacccagccaagaaaaataatactcttaaatacttagatgttcacctaaagttgatattatttggtatgggaattacttttgaactgtaatctttcagattacaccactttgaaaacaagttttaacagtagggtaaaaatatagtttttgagggtattcccaacttgtgatcttctaccactttagagacattcaagtaatagttttcttagagctttgcacattcctattcactgagattttaaaaatttcacctttattcgagggaaggatcaatgcttattaccatttggaaaaacgaagatcagaaggtaaatgatctttattttctagctttaaagggaaattaaaccattcatgaataaactttaaaaatgtgaagtgtccttttccttttcacaatacaaaaaaaatttcaacagattgtgtggtttgtgcatttatatcctgttaagcattaatagctaatcactgggacttgaattctgatggcagatagtctcttgcttagtgagatggagttaactattttttagtaggaagtgagaacagctgattttcatgccacgtttcatagccccacttttggtagactaccaccacgcttcttcgcgtaagcagtggcatcttgggaatgaatgcccagccgctcgtgggttggtgcaaagaagtataaacatatatcactaaggaaaaagaaagtttgtcttgcccttctgacacagtgtgtgcacttcaggcaatttttggaaaatataaaaaattccaaattctgcctttcagcagcatcaattgctaggaacatttcattcatttccctgtaatattaatgttctttaagcataatcactaattataagttgtatcctatttttttccagcttaatttctgtggtttattgaaaaccaagtataaatgtgactaaaagcattttgctttgtttttatagttaactttcttaaggttatggacattttataatgtaacatttgattggcctggcctcttgacaattcccttctagttatgcatatcct

SEQ ID NO: 88842 - DNA, 1015 bp, Homo sapiens
aaattgattgtcctttggtttggcatccaagaagccagtagtgatcctagaaagcagtttctcttggcttttgtaatatccttccctttctgattatccttcttgtttatgggtggcgagttttcactttttttttttttttttttttttttttttgcctacttcctctgttgtttcactgaatgattgtattccttagtctttctgttctctctctgcagtctcactaggggatctgatctcatctatgctcttgacatatgcttatgatgcctccatttatgtctctagactcttgtctgtgcgtcagtttcatgaatccctctgctgtcgatactgtgcttcagaggttctaaagctttaatgcacctttgagctcgttaaacctcagaggtgctgtaggcttgggatggggtcaacaatttacgattttagtaagttcccagttagtgctgatggtgctggtccagggaccatgaattgagaacctctaggaggaaaaccacgtacctgtgacagtgggagtgaaagaggtgaggttgtgtttgttaggcctaagtttggatggaggcgggtgacacagagtttgtgcctgatggtttctcctttttttttttttttttaaagacctagaaggtcattacaagcagagatctgacttataaatgtggttggtaactcctgttaactgtgtttttttcattctagcctgaaaactggttttttaaaatggaagccagattatgacagtgccgcttctgaatatggaaaagcaggtatttttgactatagtccagttgctccagtatgtaatcttaaaatagtctgataacttcatttcaccataatacttactcatatgctttctataaggctttaatagttaaaaaacaaacaaaacaactgtgcaagcccttgagtttttttccacttgttattttcagatgtgttgagagctgagtcagagttcctggtacctgctgtctatgacagcagggatggggcggggttggtg

SEQ ID NO: 88843 - DNA, 1049 bp, Homo sapiens
aaactggtgaagtaaggtgctgtcttttgtgactgaagaatctgccggttactggggagtattggggagtgttggtgttagaaagacttcttgattttgagtggaagaaacactgatttgttgccagtagtcaacaattaaaaaagaaaaagttttaaaaatactcgtaagttaccaataattggaaaagttgtaaggaaattgctttagaaaaaagtaatattttatagttttaggatacttcctaagtatttgaagtaagtatgtttataatacttcatataaaatgcagatttcagtaatgattcatttgaggtttttaatgatggaaatagtcaatttttttttctatttcagctgttgcttttaaaaatgccaaacagtttgagcaagcaaaagatgcctgcctgagggaagctgttgcccatgaaaataatagggcgtatctttttcaacttttaaaaagaaattaaacaattagatgattttgacaagctgttttctcttgctgtaaatttactttactacctgtgaagtaaaatgtttttaaattagaaaatgattagaaaaattctgtatttttaaactatgaaggagcgtttataatgaagtttgattataaggtccacactggttcgcagagctacaatacttactttctattgtttgtgattttacttgatgatggttttacttgggatgaagtaaagtaaatctgtagacatgtgctgaagaatgaagaagtagcacaggtattgaaaacacgtgaactactgtatcaatttttttaaatacagttttccttaggtatttgaaataaaaattataagtagtttaaaacagtacattttcttgaggtgtttgcaaacttatcaataaaaaatgtttctcttatttgcaaactgtagtcataataactttgtacttcagtaaaacttcagattattgcgtaatagaaatagtttaaaatctgtgcagtgttttgttagtggttttgggaattatgtagttttaaactatattgacaggtattgaattacttctttttt

SEQ ID NO: 88844 - DNA, 2184 bp, Homo sapiens
gtgctgagacaggcctcaaagtagcagtgcagcgcaaagcttggagagctaagatttcatcactgtcgaagtgttgcactgccctctgaagggcttatgcatggaacaggcccaaagccacatagcaaaggatttgaattaagtgtagaacttccatccaccaaaaacaaggcaccacatgtagtctgaacctaactggggtgattacctgctgaaaacatctgtactctcctgaaaattaagcagaggctgtgcagcatcacattcacagtacaatccagaattactcaacatgcaagaacctggaaatatgaccagttttcaggagaaaagacaactgatggcaacccggcagtgaccagggttgttggcattatcacataaagactgaagcaactataagttgctccatgaggtaaagataaacacaattaaaatgaatagaaaagaggacctgttgttttttataggaaaaattatttttatagaaactataaaaatgaactaattgggaattttaggactggcaaatacattattgaagtaaaataattggataagcttaatctcagagatgacagaaggaagactttgtgaacttaaagatagatcagtaaaagttacctaaacaatagagacaccaaaagatggaaaaatacttcatgaagacctatttttccagtaatttatcagtcatatccttgatcttattactacttttattgttgacttatcaatactatcattgtttctgttatctgaagttttcactcatacatctttttcctagtttctttttaaggattctaagtatcattgtggtgttacgggtcccccccacttcttttttattcacttttcaagattgaatctgtgtagatatttgaaagagatctctttaaaacgtggttgtgatctaaggcttgtgtcaaagtgcggtccccagaccagcagcaggagtgccccctggaatttgttagaaatgggtgaatcccaggcttgcccctagcagccaaattccaggacatgagaattggaaaagtactgttctaggatatttcccctcaggtgtcccgtggaagttactatagcatttataaatctctgtttatacaaacaaagactctgaaagttaaactccaggtgttttcaatactgccaggttattgactttattaaacagatgtaaatttgaccatgatcctctcttttgttttagaaaacaattgctcaagtcttagttcatctacacagaaatgactatgtagctgcagaaagatgtgtccgggagagctataggtaagacgttgtctgggccctcttgacttgcagtggcgacacctctgtgtctacaactaagattgctgctaggacacatgttcctggccatgaaactgtcatttctaaatcttaggagtgctcatctaccatttcatcttttacagtgggtgttttacaccttttttttttttccctttcctgtatttttctctaggggacctccatggaagtgaatgactttagtcattttagtcattttatttgccttctaagaaaaaaagaacaagaaaaagggggaaaaaattatcagatttatgttacagaaatcaaaatgaggaattttctcggtgtttaacatgagcagtcttaatctcaacactgttaacatttgggctggataattctttgtggtcgggcctgtcctgtgcactgtaggctggttagcgggatccccggtctctgccctctagatgccactagcattcccacacttttaagtaccaaaatgtctccagacagtgtcacatgccaggggcagaatcatccctgcctgagatgtgttcttttaaggagaaggtgaagacgtgtgatttgtgcttactgcagcatccctgggttcaatggcagtgaagactgtgctgccctggaacagcttcttgaaggttatgaccagcaagaccaagatcaggtgtcagatgtctgcaactcaccgcttttcaagtacatggacaatgatgtaagtggacccatttgcatagctttcatcttttctcttgaaagaaagaggtttctagtgagattattttttacccatgtacttaagagattttttcctacctctttttttcttctcaagctactactcataaggaaactgaccacttgcattgaatttcaccatag

SEQ ID NO: 88845 - DNA, 1021 bp, Homo sapiens
ctgtttggccttaggcctttagagtatcatcatagtatcagatcaacttaaggccttcagttgtttattataatgatatatgtagataattttttttctaaataacgtcttacataggttttgaaaatatatatatttctaaagttttaattaaaaaaaatttataattgaaacttttactagttgtgtacctgtcccaccatggtcatgaggcatctggggagcagcattgttgggctttgtttttccatctgaatggtagaattggtgttcctgagggtggggagccaggctgtgtctttttagagctgagtaaaacatgttaggattctagttatccagcttttaagaacatgttctgttgttgacagtatgctaagctgggcctgagtttggtggttccaggagggggaatcaagaagaaatcacctgcaacaccacaggccaagcctgatggtgtcactgccacggctgctgatgaagaggaagatgaatactcaggaggactatgctagtattttgcttgctgaaaagaaaagggaaacaaaggtaaaatcctgacatgccatttcaaggacttgggaatagattagggatatccgtacttcattacagtcatgattttggatcctaataaagactagtttttagttaccatcttcccaaatcactcattgtatccattacctgtgaagcatatctttttctttccataagagcttttctaagacaccagcaggaattaacagaaaatgtactgtcatgttttaatacattgattaaaaaatttgcaagccaaattatacataaattatgttctaaacaaaaggggtaataagcataggtattctctcttggacacttgtaagttactgttagtgaattgttttttacgtttcatttaataattgctgctaaaggtgatgtttactgataaatcattttaaaatttttttgttttgaaaagtaaatttatcccccatgatgttagatacatttaaattattaagtcttttcagag

SEQ ID NO: 88846 - DNA, 1095 bp, Homo sapiens
tggccactggctactttgataatctaagaagttatgtctatgttgttggacattagtggtaataaacatttaaatattgatccattttaaaaattgtttaactttttaaattgtggtatatattcatctcttgactagtaggcctactctgggaatctgtcctaagaagtaattcaaaatatgagaacgctctatctaggcactggcttatgagtgcattctctgcattagcagaactagaggcaatttgcggttcagcaaacaggagctggttgaggaaattaaggcagatgtattacatgaatttgattggcaagatactctagagtggtcataataggagaaggagcttctacttttcattttatttacgtgccatgttgtccaaagattttctaagcaacttattttgtaattaaaaaattcattacagagactataaatgacatgacaatttctcaaactaaaacataaattttaaaaaggctattatttttaaaattacaaaaaataagaaatacatcccctaaaacttaaaacaacaattatgttctggtagcagaagggtggctgatgttattctcttgtctatattccacactgttaataatataacataatcctcatcattaaaatttgtcttataaataatttttttttatttaagagagtgaataggaaggagatgcttctttcttctgtaaaattatcacctataatgcacactgtcaaaactaatctggaacaatgagcagttcttcagagagggttgggatgtcctgagcagattgttttgtctctctcatgacagagacgttcccccataggtgataaatttcctttttagtggaaaggaaaaatgacactaaattatctgtttttcctttattgtttaactggaatgattccatagctgtattgatggtagcaactgctgggattggataatgtaactggaaactgcccatacctgtgggtaaggaagccaaattagtgcaatggaacactcaagaccatccattataaaaatattcccttcaaagggagaaaccttttccatactgccagttaaaaggaagagtgactgctttcttt

SEQ ID NO: 88847 - DNA, 1051 bp, Homo sapiens
tgacctctcatcttgggcttcttgatagggaggggaggttgcctggcttacgtgttgagctacgtcttgctgtcataggaagtaacccaggagtgtggaagaccagctggtcatgggagttctggttctgactcatttctcacttttctctcagaggtgacagtgtgttcaagcatgggaaagaggccataaatttgcaacactcatagaatataaacattcccttatgaaccctacagatgacatcagagaaagaatgcctgtgataattaaatgtaagccccttccatgtggcctctatttgtccaccaccaatcatagttctgaatacagcacaccctgcacctgatgcaaaattgtcctatgaacagattgctttttattataaggcagtatcctgcaaacataatatgaagcccaattacagtaaattggcaaatagttaagacatgtttgtgcccccaaaagcttcagaagcatgatgcagagcccaggggactcagtgcaaagtttttccaaggttgaaaaaacaatgtagtgtgaaatctatcagattacaatttgctcacacacaaaataaaatatctatgggtttggcatggaaacatgtttaaagcataagtaagaaaccaataaaaaaaagatggttaaacattggctgtgttttccatatgatgcaaggcagggggtagggtgggaaaaggaattggaagccgaactagcaaaaacttattgtaaaagacagtattataggatgggatgccacaagaaatggagagaaacttgctggaaagataccttaaagatactttaaagacagttctagcctttttcccacagagacgcttgtgtaacatggaggaaattttgctgggtgtggtggctcatgcctgtaaacacagaactttgggaggccgaggcggacagatcacctgcgatcaggagttcgagaccagcctggccaacatgacgaaaccccgtctctactaaaaatacaaaaattagccgggcatggtggcaggcaccagtaatcccagctactcgggaggct

SEQ ID NO: 88848 - DNA, 1119 bp, Homo sapiens
tatgcctgtgtcttaagaagagagaacacacacacacacacacacacaccaccaccaccaccaccaccaccaccaccatgcgatgactgaggcaggaaccggagtaatgcagctgcaagcaaggaccactgtggatgaccggccactacccaaagctggaaggggcagggaacaattctacactaaagccttctcggggagcagggccctgctgacaccttaattgcagacttttagccaccagaacagtgaggcaatacatttctgttttttatttgtttggttattattattattattacttaatagagacagggtctcactgtgttgctcaggctggcctggaacttctgagctcaagctgtcctcccaccttaacctcccaatgcactgggattagaagtcatttctgttgttttaagccactcagtttgtagtacattgttagagcagccgtaagaaactaatacaatgcctaagcacttagatcaagatatgaatctgagctcaaaagaagaggtctccatctgaggattaaaatagtctatcaatgcggagaccctgaggaagaatgttccaggcagagggaagagcatgcctgtttttggcatacgatttcttttatacagaagaaccattctgcagtacaacacccataaactctgagaaaataaatgggtatgaaattttatagcttgatttccatccctggaatgattgaaatagatattacctgcacatattatgttagaaattatattatacatacccagtaaaaaaaaaaaaagcaaaactgcatctcaaaaaaaaaaggcattcatgctttcataaagattgtgtttattgtaatgaaatgttttatggtgcaagtcatttgtggttatttagagtattaaaaaacccatggattttcagaattgtaagggacattagaggttacgtcttgaagaactctcttcttaatgcttaagttttctacattaccattaataagatatcacttaatttctgctaaaacacttccagtaatgtaagaagcagttggacttccagggcaacccatccatttgacaattagacatttttgaccgtagaggtcaaaaacacatctttgtgact

SEQ ID NO: 88849 - DNA, 1029 bp, Homo sapiens
aggcagtccgcttggccccagagccatgagtaaccgtaagacaggtcttttcaatcttgtgggtcaccattttgtcctttcttctttccctcttccctttctccattttttaaaaagttaattttgcctagatttattttctgcatttttgcttgccagtattttgtgcccttaaggggtattggggaaagtcactaatagtctcctcgggcagtcaggagcaggggctttcaggcttgaagaggtgtcacatgctgttggtggcagtggctgccgctgtgctcttgactgtctacacccagcaggtgtcactgggtgggttggcctggaaccactttcagagctgcagaccatgcaggaggaaggcctggagtacctgagcatgcgtgtgtgcaggattgcatgtggatttcacgtcctcaagatgcctgtttttcctctttcctggcaacctggccagccattaactcttacaggtccctttgcacttaggtgcaaaggaatgtcaccctcaaacatcaatgtcatcatcattatattcgcattccctggggtctaatagcatctgcggaatgaaaactgctcttttaagatgcagggacacctgtcaaagccatactcttagttgttgtggagaaaggccctaactcccagtgtggtggctgctgtagtgctctccccagattccccccgtgccctcctccttaggaccaagacttcgattctccctattgcctggagtgttggtgtctgaaagctcatggctgtgtctgttctgggaactgttttctgctaaaaggatctgccttatccaagctttgcctcctctttgttgtggatgtggctctcatttccaagagtggaatttgggggatggggagggaggagaggagtccctgtccccttgccccttgccctgttcttggacaattcccccgggccgtcttgtgggataggcaggagcctttgctgcactgcgcggctccctcgctcctactccattccaaccttgctccccacccccatccc

SEQ ID NO: 88850 - DNA, 1042 bp, Homo sapiens
tggtaggtggctgcagctgccaaaggattcatggaaggcatttaagaaagtaacttgcttttctgtcacactttctcagccttatataagtagatactatttatcaagttcagaaatgaaaaaaggaacagtggaaaggattggaaatttagagcttatttctaaaataaaatatttcatccacacagacgggcatgagcatgttgtctcctgagctgtgggtgctgcagctatgtgtccgtcctgttgctttgtaagtgtgtgtgtttctttacgggtgatgtgtgtttgttcgtagtcagagataagcagatggctttggacttcacctttgaggaaggatggtgttgccactgggcagtttaagagactctcattgacctcatggctctgcccttcactgtatgattgtggagttccttttgtttgtttctcttttctttctgtaaaatggtaaataacatattctattatggttttgtttcgcttttaacactcaagaattacatgcatggttgtgagatagtgtgcacagcacaccttgtataaagcctgacacacagcaggcgctgccttacctttatgaagatgagcagagagcagaatgctcaggcgatgtctcagtcaaaattaacagactaggaggtaagagcatgggccaggagaaggctgatctgaggatgtgggattcacgggaaggcaacttagtgccttcctagagccaaattatgtgagagagagagagtgagagagagagagagagagagagagagagagagtgtgtgtgtgtgtgtgtgtgtgtgtgtgtgtgtgtgtgttagagatttttagttctcaggatttttctcaccagttttactcaatattccaaatctgcagttgcatttttctgattaataggacttaaaaacaatatttagaacaattacatattgttctcactagatcaatactgttaacgtttgcttttgtttttcagcaccatttttgtagtctttatttaatgtgattttatttctaacatgtcattttccttttgggt

SEQ ID NO: 88851 - DNA, 1034 bp, Homo sapiens
tctgctctccaaaacaacatggtgaaaattgagttgtacactttacttttccagaaagcactgggtatatatgatacccaattggtttaagaacctcagatttcaggaggcagctcagttatctccctgtaataacagccaattccacaaaccagttgtttgatatgtggggcttgcaggccccctggtttggggatggaaacaaaaacaccaaattggagttggcctgaaacacagctacccctgaacactcagctgtctctggtcacacgggcttggctttggagactgggttatagcctagagaggacacgagtcaagtccttgatgctacacgatggaaggacataagggcctggtcgtggcaggtccatgggactctaaaaatgaagagcaacatcatggaaaatattgtgacttaagagagcatctaagaggcaaaaaaaagtgatttttttcccaaagcaatgtagacgaggtgttacttaggaaggtgttaaattgaagtaacacttggcccatttgaaaaatcacaggaataccaatacaaaatgggaagggactgaagaatttgcttcctgatgaggcaacattaactttggaattaggtacatctggctgcactaatagtggttttccaactcactggcagtgtttatcaaaatgcagattcctaggttcttgcccagatctagtgaatcatgatctcttgaggaggttcccaggtatcctaatctttagtgagctctccaggtgattttaaaacacagctaaagcttttaagagcttacgatgtgccaggcactgtttcgactgcttgctatgcatgatctcacttagaatgtaaaatgatggtacgagctcagtattatcatctgtgtttcatagccaaggaagccaaggcttagagtagccattggacttgcctgcagtcacacagtggatgatggagcagggatgtaaacacatgcagcatgtctttagagtccacactcctaagcaccatggtgcctgctcagctttttatgctcttt

SEQ ID NO: 88852 - DNA, 1001 bp, Homo sapiens
ctttctaattcctgatttactgaagacagcctttctgtcttgaaggaattactctgtggcatttcccagtcttagcaagtggttctggggggccctgatgaaagcactgtgttctggcgaactgagaaccaactgtggacccttgctttgtttgagggccaggggtggccaggagggtttctctgcagagtccacacctcacccatatgcacacactgggaggaaatatttttcaaccattggtttaaccattgaatagttagctttgtagtacttactcctctgagattttacgcagatgatctcacttaatccacacacatgcacgcccccgtgtagtagccaccatggcggtcccctgacggggtagatacgtggcccgtgtcacacagcatgtgcagcagggctgggacttggcgccagggcctacactctgagccacaatgtctaagccctacctcacccaaaaagattcctctaagtctgtgtcagattagaaatgaagaggggacaaagagaagtaccacggacagcaagaaaagaggaagatgcacatcagaactcataaagcaagtccctcaagaggcattctgtgtgggggcaaattcccaggggttcccggtgtctacaacacaaatacagtgactgacgcaagatcctatgtcctcaaggagagagaggaggtgaaattccagtgttttcatttcgtaagaaggcagagatgtatggaatgcttcaggaagatttccattcaagagtttatgtgggaaaaaagttttattgctgaaagaatgatgtccctaagtatccagacatttctgatttggatggctaggctcgccagaatgtcattaactgggatgtttgctcacctagcgtttaactgtcatagttcaagcctagagaaaaggtgtctccggatgggagtgatttataattcgcccctccattgtcatccatggttgcccaactgatagctaaaaaatcaacagcatccgcct

SEQ ID NO: 88853 - DNA, 1038 bp, Homo sapiens
gcccctggcgtcttacgtcccacaggccccaccccggcgccttccgtcccgcaggctccgcctttggcgctgggctctgacgtcaccacctgcgccgctcacagtagaaacaggaagtgggaccaaaacaaaggagcggcggccgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatgcccttctacctttgggtttacagccccctccacataaattaagaaattcagtatttctgcactcttagctggattctaaagttctgtatagctcgtaatgatgg

SEQ ID NO: 88854 - DNA, 1133 bp, Homo sapiens
tgtcataatgtttgaggctgtatttgtaagtcttgcaagtgtgagaaagagccgtatcttttgactttatacttcagattaaggttttgtaatgtttcttcttcaaaaggcaagtgaagctgtcatcctcattctcctaggccagacacaaacattgacacgtcaaggttttttttttttttttttttggcctgagtctcactttgatgtccaggctggagtgcgatggcacgacctcggctcactgcaatctccacctcccaggttcaagagattctcctgcctcagcctctcgagtagctgagattacaggtgcccgccaccacgcctggctaatttttgtatttttggtagagacagggtttcgccatgttagccaggatggtcttgatctcctggcctcgtgatccgcctgcctcggcctcccaaagtgctgggattacaggcgtgagccaccgcgcctggccacattttgtttttctcttactgtttgcttacttgtatgacgtagcctgtgtccaaagttttgactaagggaatgatggacctgttcccacttggggaacttgaagaagtgtttcattagcagactaatgaggaaacatattgtctagagagagagaaaaaaatccctggttccctgaaaagattagattgcaatttgtacccctgaattgagttcaggtttttacagctcagagaagtaacagcaggtggttgcaacagcttgtgatgttggtacattgtcgatagaatgtggatgattaacgtgtataacttacaattttttaaatcagggagtattttataaagtgccaacctgataaaatatcctaaattctacagctaccattcattccttttttcagagtaagcagcaggtaatgttgacattaagctcttcagcacaatacaaacacatttcatgtacaggtatagatagccatggtgaaggcacaaagatctacaaggatttttctttagtagttatacaaaagaatattacattttgtggtctgtacagtgtaataaaccagcaatagggacaacaacaaagagaatctaagaaagaagactatgcctaagtatagggaaagtttagagaatcatttttagacaggacacattttgca

SEQ ID NO: 88855 - DNA, 1054 bp, Homo sapiens
tacaccctcaacaaatatctgtggaatgaatgaattgtatgtgcccttgggaaacatctaacttgaaatgtacatttaatggccaattattgtctttgggaacgaaaaaccaagatcatttagactttaatagctaacatttatatagtgctctagtgcttataatgtgccatctgtttcaagtactttacttccatatattaacacattaatctttaccatggtcctgttgttttacctacggtaccaatgtggaatctgaggccctgggcagctgagtaacttgccccaggcttcatagtaagtagtggaactaaaatttgagctttgctatcctggggccaggtagagcccttaactaataatgctagtctgaaactcaagtgttgaaagttattttgtgttcatgatgactctaggagtttctaaaatggcttgtcctgaaaaatgtttcttctcacaattgaatataggatgaacacatacaaagtagaacgctttgagaaagtgttcagctctgaaagactgttttcttggaaaggcattaagtgagtattatttgtaaattcttccaagacctttagtccttggaaacttcattttttaaaggtgcctgccatactgggatctatcatctacctgcgttctgtttagcctggtttatgatctttaaacagcagtgccttaggctgtccttgctggtgctcaccatgggagccgatagatgggaaacctcaaaccaccctggttttccttgacaaccccataatgaatcggtcagtttatgactctgcccagccactgtgggaatgatagtctttctgtctgcactgtctctgggtagcacaaatttcatcagcccactttgtaaaagagtctttatttgatcaaaatatactaatttcacgttacaaagactgttctcgtagttatggtgtcataactactatgggatttggtggcaagtgtgtcacagttcctctgtagctctgtgccacccatctccattggcctgggcttttagaccagagcatcctgacccttagcctgacca

SEQ ID NO: 88856 - DNA, 1019 bp, Homo sapiens
atgcttcctgcctgccgggcagtgctgagggaatggcctgaaggtctgctgctgggacaaacagaagccacacgaggtcatcggaacctgtgtaaagagggacagattgtcttctaatgcaatcgggggctgactggagaaaacatatcctttagccagatgacctggttcggggtgtaaaggtcgtgagtggtgatccttttggagttctccttagtgaagagcatgttggcaaagtcgcagggcccccagatgctcacccttcactagcacccagcattctaccactctgttgttcgctgctctcagctgcccctgagatggagtctgtgttctagatgcggaaaggtgagggagccgaaggagagaccttccaagagataaaggtgcactgtcctttctctcttagactggttccgctcaaggtggccctggagaaactgcttccatttcccctctgccccagttctggcaggcttccctgtcccaggctcccaattccctcacctgccccctccatgcttctgtgccactcttccttccgtgaccgtggggatcatccctgccctcctagttccagccacccacactgtgacgggagcctcctccctggctgttgggcttttggggagggagtgaccacagccccaccccaagtacagatgacagtattcactgatgtggatggttgtcatcttttgtgtgatgtgtgaacagaagtattgtagacagctctgcctttcaaatccccccgcggagctgaaccagcttctgttgggccagaaacttagacaatttagggggccctctttaagaaaatacaaactttgccagatgtggtggctgaagcctgtaatcccagcactttgggaggctgaggcttgtggatcacctgaggtcgggaatttgagaccaatatagtgaaaccccatctctactaaaaatacaaaaactgtggccgggcgcggtggctcacgcctgtaatcccagcactttgggaggccgaggtgggcagatca

SEQ ID NO: 88857 - DNA, 1002 bp, Homo sapiens
aggaacaggtttggagctgagagtcgagtgttctcttctgtgcaggttaagctcgaattgccagtagatttcttattttatttttttgagacagggtatcgctttgtttccctggctggagtgcagtggtgcaatcacagcttctacctcctgggctcaagtgattctcccacctcagcctcctgagtagctgggactacaggcatgtgtcaccatgcctggataatatgtattttttaattttttgtacagacggggtttcactaagtggagatgttggatttgcacccaagctgacggcagagatgcagtgtggaagtcatattcctggagatggtatttagggccatgtcccggacaggaggagagcaggcttggccactgatgggctttgccgtcggatgagctcaggtcaggctcccattttcctccttgggagcctcacaaatgccagtttgtggaggtcatttctgaagtggttcatttctccagaaaaggcttccctgctcttcctgcctgggctgagcgcacctgtcgctggaggaagaggaggcaggagggggagaggaggcggtggtgatggcctccagctcctgcctcgcctggtccacacctgcagtgtttgcttagctctgcagggtggggtcagcctacgtgagaaattcgaaaactcaacaacatttcaaacatcagcagagacagaattcctgtgagacagcagctggcaggcacagagtagcagctgtccctttggtggggtgggggtcggtacatggtctccaagggtccgaggcccactgctcctgaccctatctgagaggtccctatcatttcctacccattttgctaacaaaagctgtctcagaagaagggggagggcagaaggcactgcccttgcctctgggcagcctcatcccagcccttggcactccagggtgccagtgaggtcccacctgtgcccccttaaggagaggctggtagatggctcatccccacggggag

SEQ ID NO: 88858 - DNA, 1056 bp, Homo sapiens
tctctaagactgagggaaaatagccgtggtaaaggggttcagcgggaccttacctggcaaccccatgtgctccctcgccctgtggacgtgatcctggctaaagggcagggctgtttgagtctcgcttactgattttagaaatacagcacttttcctcactttttctcttagcataggacaattcgtgaattaaacttttcttaacctagtattttagcatcctatttgcaacgtgtacattgtatgtacggtaggttcttattttttgtaacaatacaaaaattagctgaaaaagtcattagattttctcagatacatgttctcacaactgatactggtgaggttctgtgtgtaaataagtttgtggaccaagaccttttcatacaatacctcatgtgattcctaaaacaacccaatgtgttagatacactgttattacagaagaggaaatgaaggccatgagaacccatatagaatttgaatttagagctgtctgattctggagtgtactttatccctctctactcccactgatgttatgaaactgctgaaaacaagaattacatcctggaagggaatttttcatacccatcttcatgaagagctacaggacaaggcttctgactttttttaggttagcttagtgtcattgtctgttggtgactgaaggaagctagctggcgcagcccccatgtgtgcaaggcccccgagtacacctgatagagccctatctggtgtatatgggtgcatgtcgctggcatcagcaccctgccggggtgagggtagttcctggagctactgggatgaaatgcagagctcccaacctggaggagtgcatggcccagtggaggagacagggcagtgaccaagtacagtggactgtgcagtagctgacccaggaagaggggcctcagccagggcagtgggcggacggccacacgggcgacctcctggagcagctgtgctggagtagatggaggctgagagcacagacaggcagaaggtggccagggatgtcattgcaggcacaagggatcgtgtccaaagacatggagg

SEQ ID NO: 88859 - DNA, 1022 bp, Homo sapiens
tgtcttggaagcagttagtgaaactgtgggaagtagtttttaaacaaccaacccacccagagtgtaggaaggtccttctgagcctgcggggagccgcacagcacacaggctcccgagagctgccgctcttgttccagagagtaaacctttctattttcctttgcagattcccgactgtggcggttagcattggatttgctgttcgacaagaggtgcgggtgtggcccaggtccccagggcccctccctgggctccctctggccatccttcctttctggcttcagcctctgtgcgcctggtttgctgtttgccctgtgccttaatcatgactggcaaatccaagcctgtgggtttcaaatccgagaaaataaacaagtccagactggctttggggtgtgcggggtggggctccgtggctggcccttgtcccccgtggagggctggcctcgtgtcaaccgtggtctatttgtgacactgctgtggaagcggaagtcttaagtgaacggtccaagtgcatctccagctgacccctagagcgtgtgatctcacaaactaaaaggagcacttagttttggagagcatcctcaatcccaatattctaataattctttcttatcttcctctggttattagcatgagaacatagctctttcatggttcccatagaccttctgaactacacagtgttgtgcgacctgcatggaaggcgtggggctgaggtttaaagcttattaaataattcaagcagcagcactgagaagagccttaatttctttctaattgaaacagttttatttaaatagggccgagggctgcatgtttctcaaaagcagccctgcttcagagcagcatttgtgcagcttcaccttagtctcagcacagactccctggcaggggagctgagagaagtacttaagttgaagtatttaaagttaagtactaaagtatctcaaagtacttaagctgaagataagtaagaattgtaatactgtaatttgtctaaggatgcaatgattgacgtc

SEQ ID NO: 88860 - DNA, 1059 bp, Homo sapiens
tcctccccatgggagtgggggacattcctctgcactctgggagctcttcacaggcctcaggaaccagccgaattctaggactgacctggtcatgaggattcctttaaagccagggtaccggaaggggaaggatgatgaaatgctgccagacacctgcaggctctgaaaaagcgttgactgaatgacgcctccaaccgccagaaataaaccctttctctgtagcttggggtgtccactctagggtgtttgtgctcaccccagggccagccaaggctttcctaaggcatttggccagggtgtttttttaattttccagagaggtgaacacttggctaacttgctaagcaagcatgctggcccttgttaaccctgagtggtgaaaagtcggtagaggaaagatcacagaggcacgcggccgtgggctgccgtccttttccacgctgacctcttccttttgctgcttcatcctgggaggctgtggtctgatgctttgttccctgatgtggggcagtcgggccactgttcagcgcactgcctgctcacggatcagtccccagtctgcggcggtgcctcttcctcgctggggctgtccttgggcttctgagattccgctggctttacagatgcattctccattcttcacacatcagcaattttgaggatttcttgtggggtttggttagagtcacaagtaacattctttttttcagcaacaaaaggggcctttctaaaaaattaagctttttcaataacttctggttactaatacttgattatgatgttaatttttaaagttttgtttgtctgaatatattttaaaattgtacttatttagcaaaagcaagcttgcttttatgtccaggtctcattttaaatgcaggcactgctttttctcagttccttttggaaaggtaatttctgtcacagtgtaatgtgttatcctaacgcctagcgcagccttcatctttgaataacaatgttttttcccacatcaaacgagtgaaccatctttgttttctgtcctgcctctgccgcccacagcttgaattcggagtgatt

SEQ ID NO: 88861 - DNA, 1971 bp, Homo sapiens
ccaaacattgagtgttcccagtttggagtcattttgcttttctttttggttgaatgatggtgatttttttttttttttttttttttaaagaaacagggacttgctctgtcctccaggctggaatgtggtggcgcaatcatggctgacagcagccttgaacccctgggctcaaccaatcctcccacctcagcctcctgagtagctgcaactacaggcctgtgccaccatgcccagctacttttaattttttttttttttgcagagatggagtctcaccatcttgcccaggctggtctggaactcatggcctcaggtgatccttgttccctagcctcccaaagtgctggcattacaggcacgatccactgtgcccggtccatccttagttttcaacatagatatcaaaaaagcattcagcatgaaccagtcgaaagatgatccttactctgagaaagaaaggctcacgttggaagcctgtactccttagttagaaccaagacttgatttttctggtgacaggaaattctttttattgcagatctctcaaaggccttggttctgacagaaattggccccaaacgtgaccctgcgaccctgaagctgttcctgagtaacatggagcggctgctgcatgccaaggcgcatgggtaggaggttcagttcggggaacaccctgcagcccgaggaggaagaacggaacacggacttgctaaaactcccctgggatttgaggaggaagcctgacgtggaaagagtgggaggggcacatgaacatcagactcagggaagccctgtgaggggcccgcctgcagtagatactcctatagccaggcctctggagatgcgtgggcacctgtgttgcttctgatcagaatccatggaactgacctcatgctgctcaaccagcgaatggtgcaaatacttacagtccttcccgagggggcctggcgtcagacaggtttatcaaagcccagtgaatcctctttgtctcttgccttcccagtagggctgtgctgtgagccctagccatgtgagaccactgacacttaatgtcacgttcagtagaggaggattcaattctctggttgctgcatctcaggtgctcagtagctaggtcagctgggagctgtcatggcacaaggcatttgcgtctggcggaggcctgttggttggtggctccaggccctatattcagcctccagagctttggcagaagtgctgtgcttcatttttcactagggaaaatgcccagccggggtacctggctgaagtcggcttgcacaccacagaaaaggctccactcccgcctgcatctgtcctcccttccctctccccagggtccgagtgattggaagctccacattggcactctgccacctggcctcaggggccgcggatgcctattaccagtttggcctgcactgctgggatctggcggctgccacagtcatcatcagagaagcaggcggcatcgtgatagacacttcgggtgagctctcctgtccctgaaatgcagcggcagaaactagactgagagacactgtgggtggggcacttcctgaagtccccaccaactgaatttcccaccttccccagagtttctgtttttttttttttttttttttttttgagacggggtcttggtgtcacacaggatggagtgcagtggtacaatctcggctcactgcaaccatcctactcacgggttcaagcaattctcctgcctcagcctcctgagtagctgtgattacaggtgcgtgctaccatgcctggctaattttttgtatttttattagagacggggtttcatggtgtcagccaggatgctcttgatctcctgacctcgtgatccgcctgcctcggtctcccaaagtgctggaattacaggcatgagccactatgcccgaccccattccacattttttcttttttttttgacacggagtttcactcgtcacccaggctggagtg

SEQ ID NO: 88862 - DNA, 1036 bp, Homo sapiens
caggcaggaggatggctggaacccaggaggtcgaggctgcagtgagccattattgttccactgcactccagcctgggtgacagagcgagaccctgtctcaacaaacaaaacaaacaaaaaaacaaaaagaaagaactgctcccctccccaacctcaggaaaggccctcccagcccttgggtcaggacagcaggaggccctgagggagcttgagctgactcctgcttctgcttctgcttctgctctgtccggagtctcaggctgcctttagcaagtattccgcatgagcgtcatccctgcggcttcaggagaagcagagtgaaccttggagaaaagagaggcacccaaggtggggacctgcgggcttgcctcattcatccctggacaagcctcccagaaacgaaatgggctgctcacctctgtgatcctcagagttagcaaaactgcttgctatgtcatttagacctcttacaaaatgatattcatctatcactggtgatgacattcattctgaattccactcataggcttcaggatacttgccctcatttttttttcccttcatttcaacagttttcactgagtgtcttgtggacatgagtcatcaaatgttttgctgcctttatgatccaatcccaaataaaaagtaaaacatttgtcctagtgcatcactgtcaccactcagaccaggagtcaggacgcggattgatgttcaggtagctgtgtggccttgagagggccatgtcagctctcttttggtgccaggtgaagtctgtactgggggtctggctgcctccctcacagggttgggagcatgtcccaggacgacacctaggagagtaccatgaaaccagagaatgacggaggcagtctcagtcagcgttgagatttattttgccaagattgaggatgtgcctgggaaaaggacacaagccactgtaggatctgtggtctgcacttttttccaaaaaggattttgggcgcttcagtatttaaagaggaaagaaaacaaaagagggtatggtctcatccttgat

SEQ ID NO: 88863 - DNA, 1029 bp, Homo sapiens
accacaggcatgtgcctccacatccagctaatttttatatttttctttttttttcagaaaattattttaatagttacaaaacttttttttttttaacagaatcggtataaaatagcagttgatttctccataattatcagaatttatacttgaggtcttggctaagtggggctgaaatcaacaaaaggtcttggactgttggctgagaaatcatcctaggaagcccgcctgttgatatctgtcatgcttagctctcatgagatgcgccagtcctaaaaaaaaaaaaaaaaaaaaaaaaaaaaagaatctctctttattcattctttggaggcttgaaatgaattcagcagcattcattaaacaccttccagctcctgtcatttaccacttcttcaacattcagttctgactgcatccatttcaactttgtctgctcttttctaagttgctttaataacgttaaatcgtccaaattcttttctctctcttctcagaggttttttactactgctgaagtctgggctatacaatttttttggactctgtctctactggcatgagctgccatcaaagactcataaagttgtttacaggtttggctggcatcaattttccctgcaaaggaagctgttggaaccacagtgtttaattcatgtactattctgtcatcgataggcctcatcaccttgagtaattcctggaactcggtgaattcctcacagttcacaccgccactgggtgctgccatattggacctgatttttatatttttcatacagatggggttttgccatgttgaccaggctggtctcaaactcctggcctcaagtgatctgcctgcgtcagcctcccaaagtgctgggattacaggcatgagccactgtgcccggtcatattaatgtttgtaaatggaaaatgtgtgcattgctcaggaaaaagtaagctaccaccacttatctgttcgagatgcctgatggtgtgctgaatttgattacgaaaattaacataattagaataagatgaagtttc

SEQ ID NO: 88864 - DNA, 1053 bp, Homo sapiens
gcagccggcccgcagttgccgctgtcgtccgcagagccagttcctagcgcagagccgcgcccgccatgagggagatcgtgcacatccaggcgggccagtgcgggaaccagatcggcaccaaggtgggcctggcgcggtgcagggcctctccgcgggtcggctgctggcgggccccgggtctcccggcgcgacccccgccggggcgcgcacccgctgtgcgcccctgggtcctcggagcccggtgcggacccgcgagggccgcagggagggagcgcccggggcgtggccggccggggaccttctactcttcgctccccacccccatcccaactgggagcggctgccggcggctcaggcgcgcctggaattcggccgccggggcgcctggggtgggcgcgggtggcggcgtcccgggctctgggttctgagcgtctgtccccccgccttgccctgcccaagttttgggaagtgatcagcgatgagcacggcatcgacccggccggaggctacgtgggagactcggcgctgcagctggagagaatcaacgtctactacaatgagtcatcgtgtgagtagcaaggccgccgcgccctgcccggccgggacccgcgtggacgctccggcgccgcctcttagcgcggcgagtttgcttcgggaaaagttctctcggggtgtagcaggatgcccggccactcccttcgctcctccggggcgggaaatccgccgtcagtttattcaaacagctcgattcagcctatcctgagggtctgagcgcttgaacgggaccacccgttagcgttgtgaaatcaacgtagcggttcctgcccagccttctctgtctagccgggcgcggtggctcaagcctctaatcccagcgctttgggaggccgagactggaggatcatttggggccaggagttcaggaccagcctgggcagcataggagaccaccccccgcccccctcccgccccgatctctacaacaattttaaaattagccgggcttggtggcccacccctgtagtaccagttaactgagggcttgagctcagg

SEQ ID NO: 88865 - DNA, 1007 bp, Homo sapiens
agcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcatctctctagccatgtgcataaatgacgtaagttactttgtatggttacaatggctacttgggtcactggtctctccctggggtgaactcctccccacttcagttcacgaaaacaacagaggaaagggctcttctttaaatggaggctttaaggggggcagccaaaactgttgctagctggaaggcaatgcagtacagacaaaagcccctcctccatccgcagccaccttttagactcccacaggatcttgcattttcccaagtcaggtcctgggctagggttccccaaccttgtaggggaacaaacagccccaaaaggcctccggacaaagccaggggtgctgggtgggagctggggtgccaacagccagccctgcatggaagggatgggcccttttctgctgtgacccatcacacctgatggcttctaccaccggccacacctttggagtttccaaagataa

SEQ ID NO: 88866 - DNA, 1061 bp, Homo sapiens
gatgaggacacctcacttccagaaggccttaaggactggaacaaggagcgggaaaaggagaaagaggagcccccgggtgagaaagttgccaactagaggcccagagggaggccatctcagtctgtccactgtggtttcagctggtgcattatttcagctgtggctttcagaagaatgggaatgctgcgctgattttagccagccactggcccagctgaaatgatggggaaaggagtccttagtcctttcagcctcagaggtcacagtgggtggcaggtgactttccggaggccttgagggaaatgcacactgtcccatagcctcattgggctcccagacgtgctggaaaggttgagcccagagtggccgaggctggaccctgtggcaccaagtggggtcggctgaccgtgtggcagggatcgttgcactggactcttggcgtgtgggaagggatgctttctctttgtcgcccactcttcattcctgtttctcctcagttcccctgtgcagatgggctgtgaaattaaattggagtcttgataagaacattttaatttgacttaatattttaaagattgaatccagatcacttgttgctgtcttaatggaatggttttctacaggagctgtaacatacttaaaaatatgaatgtattatgtaaatatggcttctttacataaaaaataaaatgtcaacactgtacttttctgaacacacatagggtccctatttatgctctggatatttttagaaaacataatggcaagaaattaaattttcttgctttttagaggagaatccttcaaaatctcagcctcgctggttctcattagctcccacaggaggttggaaccttctagagttatgtgtcctgtaaagatgcactgagctctggatataaagtacatgggtcctgaggggttagtcatggcctgaatctgtgataaccaccccagtgcaggtcctcaagaggccagtcatggccagatgttggccacaccttctgggtatagaagttaacgtataactgtagcgggcctggcaggctgacctgagccgt

SEQ ID NO: 88867 - DNA, 1001 bp, Homo sapiens
caggtgatagaactaagttatttaaatgagcatttttagatgctgtcttagtttgctattatgtgagctatattgtctattaaggtaaatagttgcctgtaattatctattgactactaatactttcatcttagttcagagggccagaattataccaggcttacattaaacgctagaatagcttagggttatcatgagtcaaaacagaattatatttacacaaaacctttattcattgtactgctgatttaaaaattaactatggatttggctgtccatattgtgtgactgatcagtttgggcgtatttcggtgggtaagctgttctgtgttcattttttaggtgctgatgttgctaatgtctgtaatgaagctgcgttgattgctgcaaggcatctgtcagattccataaatcagaaacactttgaacaggcaattgaacgagtgattggtggtaaggaaactgaacataactcaagtggaaaggctgataaaatgaatttgaggccagggatttctctgtttgggcaagaactagaagcaaagaaagtgtatccactcagccctggggcccaccacatttgtgctctcttggtgtcatggcccctcccatgcctctcctccctctcctccttcttcctgccaccgtcccctgccacctgccctctgcatggaggtccatggtgctgggtgagtttgagatggcagctcacgaatgctttgcttgcacaggcagccagcagcgaggtgtctacccatgaactataccaatcaagtttgttaaaaagctcacaaccttcctgtttacaaaagtttcatcacatgagttagaggtgctctgtgctagatacaggtgatgggtgtaaaatatctgtaacagccgggtgcggtggctcacgcctgtaatcccagcactttgggaggccgaggcaggcagatcacaaggtcaggagtttgagaccagcctggctaacatagtgaaaccccatctctactaaaaat

SEQ ID NO: 88868 - DNA, 1083 bp, Homo sapiens
tgacctttggtaggattttagcataaagaacccctttgtatcaaagagtgccattcccatctttgaactatcatttatgtttacatttcacagttttccaggatttttaggtgattcttctctcatcagaacttcttctttgggggttgtctttaataagaccatgttagtaaccccacttaaagtctgggcagatgctccatttatttcgaagagttggttgccatggagcttatttgggaattctgttgcctttgaagaacacttgcaagttaccctcctttgtattaagtgcagaaggtataccttggtgtagctatatatatttatattgatatcttgcaccacatgtgaaagctggaggtgagcagccagtcctaacccgtgttgcgctgtgtgtccccagctcttttctgctgagcatgctgcctacggtgctcatcatcgccttcttgctctacaccatcagaagagggcctgctggcattggccggacaggccgagggatgggcggactcttcagtgtcggagaaaccactgccaaggtcttaaaggatgaaattgatgtgaagttcaaagatgtggctggctgtgaggaggccaagctagagatcatggaatttgtgaatttcttgaaaaacccaaagcagtatcaagacctaggagcaaaaatcccaaaggtaaaatgaaatttaagattaactttttgaaatgtttcttgatctctgaagttataattctgtgaagtttgattacttattatagatagctgtttttctgtccttcctctttctcagcttactaggctagcctctgcccaactcgaggatcgttttgggtcagttctgtgtgcatgtgtcttgtatagtgtatgtattcctgaaaatatctgtgtcacctcctcttggaagattttcttgattcgtcttccttttccctccaatctgatttagatgccctatctctcagcaactgtaggcccgctgtagctcactgacaatgtcacactctgctgtcacccagtgtcccttcgagggatgtatgtggacaggacacctgtgctggcgctgaggttcacggcac

SEQ ID NO: 88869 - DNA, 1104 bp, Homo sapiens
tacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactgtattattttggtatgcttacaaatgactaaccaatcaaattgtcattaatgtttggaaaatctgttaatgcacatgcacaataatttcctgaaagccataggacatgtctgtagtcagcaccacgatagcacc

SEQ ID NO: 88870 - DNA, 1028 bp, Homo sapiens
ttagccaggcctggtagcaggtgcctgtagtcccagctactcaggaggctgaggcaggagaatggcgtgaacccaggaggcggagcttgcagtgagccaagatcatgccattgcactccagcctaggcgaaacagtgagactccatctcataaaaaaaaaaaaaaaatgtatctgagaaacagaggagggtttttcagaaccttctgcagattccttccatgatgaggagacacttaagagctgtggccttttattaccttttaaaatagaattataattaaatacagagctacattatcagcatcacagagccagctgttataaacaggatttctgaattgtcttcctcctcttgtctgttcagcttcccctatatatagatgtaaagcatattcaaacatggatattaggaaatttgctgttggcaatgttttttttcctcttaaatttgtattttttagctctgcttttgttgccgaaccaggaggttttccttcttcacttggtcttatacctgtcagttctgtaagaggtaaggtattttgtaattgatgaaaagataaatttaacagtcgtaagagaaataccaattatcttccttatttcaccatctttctaaacaggaataaaattagaaatgactcactctgttacgttaccttgtgctatccttgtaggttaggaatattgatttcttaagagagtgagccaaatatttatttgatattgaacctagaaaatgtttctctgtatgttacttcttttacataactaagatcattctaataatatgtcatgtttgaacagaaaaaaaataagatgtgattatcatgtgatccctggatagacaaataagaaaattccaaacacatgtaagttgatccttttataggagacagtgtaagagttaagttctgtagattatctttttggcaattcagtgtgtcaatttgttacattctaatagaagaagggagagttatgcagtttattgtggaaacttacaactgtactgccataggcttct

SEQ ID NO: 88871 - DNA, 1046 bp, Homo sapiens
taattctgtcatctctgaaagtagttcctgttgaaagagaaaactgtgatcgttaattttttaaatgcgtattttaggcattttagagcaaatgatataatctttctgagtaaactcatccccctgtcctcttatactaataagcttctcatgttaaaaattcaaatgcaggatttttcccaaagcatttttaagcaaatgtaatcttccttaagttagcttgaacagagatggttttgcattgatttttagtaagaagcagtagttcttcagactacttttttaagtaaaatgctaatgtttgacaagtttgcaacctagattgatttttgtttttctctgattgaaagacagaactgattgttaaaactccataaactgactgcattcatagtcatgtgctttctcactggcgtgttggattcctgagtgcctgtgagcgatgctgttgtgtgtgtgtgggagtgaattataatgtgtttgtgctgagaacattcagtttcagtgtcactgcaccacaatggccccttgcagcctggcagggtccgaatgcacaagactgttctgtctttctctgagatccaccaatcaagtgcggggccggatggggagcggatgggtgtgaggctcttattcaatgagatcagttacatcaacatcttccgcagctgcttgtagggaaaccattaacacaagacagccaacataaatatttattatgaaatcttttacatttctctagtctttccattgctgactatacatttagcatttgttgaaagtaacaacaaatctagagaactgtggggcagcctggagagactgccttttggatataaatgctccagtagtttcatgttccagttccactcgtaccattaggatttgtaaaggtgtgctgatgtaactgatcactaaataatgcttgtcagtaaaaattactaaccatcttcttttggctattctgggtaccacaaatgagttttaaaaacagggccaggccaggcatggtggctcacgcctgtaatcccagcactttgggaggc

SEQ ID NO: 88872 - DNA, 1043 bp, Homo sapiens
gccttggaggattccaggctatggtaccaaaaagcaggccatcagagtcagtactgacaaagactcatggatcagctgtggcatgacaccatggtgccacttgccgaatccatctgagccttagtttatttattcaccaatagagatcaaaatcagtatgaataattgctaacatttattgttcactgcctgtactaggcacagaattttatatgcaattattaacctgtttaatgctcacaacaagcccacgtctgttagtatcctcattttacagatgaaaggagattagatagcagtagagacccaaaccatcccccacaccacactatagactgcttcattgtctgtcatttgttgtattgccttctcatccaaatttgagctcttaataatataaatcagactcatcagaggaaatgtatcccagactttttgtgttcacattaaatatgtttatatgaatatagattattagccatttttattttcaaaccaaaactttttcagatcttacagccatgtgtctggtaaggctttgtgtgtgtcctctcttcatccatacatcactggatccttagaggctgtgaagtaaactagcttctctcagccccagtttcttcatctggaaaataaacaagttgtgagtcagttatctgtaggattccttttaagtctaaattctaatctacaagtatgaatatgtaattattcattttaaagtttcctttaattgaatttgacagttaatatccaaccagaagaagttttctatacataggcaaggtgttactgaatcaagcctctgtgtttttgtatgaaatgctctgttacctggtatgcttccaacacagataacctttcttggctcaagaaaaggtaagcttttgcttttttaccagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaa

SEQ ID NO: 88873 - DNA, 1042 bp, Homo sapiens
gatgggcaccatcttctagaaccatgagtgtggtgtgatggttcttccaaaattgcttaggagaaaacagatttactgtagtcttgtatcttttttacatatattgttttcaaacaagcagaatgttttattttactgaccacggcttagcagaagcctttcaattttcttttttaacatgtttgaacaagcagatgaatgaaatgtatttcacagaaaccacaaaacccacgtcaggtgtaaaagtgtttttgttttttttacctgacaagtcaaaactgtaagacatgctaagtggccgcattgctgaaaaaaagaaaacaaacaataaaaagaaaataattcagctgttaggaatatacagagaggacaaaaaagggaacggattaatgaagacccttagtggctacatgtcagactctaaggcaggcagaagctagtgaatgaaaatctgaaatacattaaaaccatgcaagagtcttagtttcagttatatcactaagacttcaaatggaggaacaataaaaggaaaaagtaactttttagaaaacaagtaaaaaatgaaagcatgataaaaatacaaacattttaaagaatcacagaataagatgtttgacttaaatatagatttttaaaaaagccatgttttaaaacatgattttagggaacatacaacatctttaaaatttcagagtaaatttatccttcaataatttatgtcaggatgaaaatttggctctcagaataaaggtgaaacagttcataaaaaattctcagttcagctagttcagcagcatcaccattatgtgttaataaactatctattgtaggccatataacctagtagttgaaggacaggacagattgcctgagtttgaacctcagctctgccactaactgggagtgtgaccccaggcaagttacttaacctctctgtgctttagttacttcatctgtaaaatgggaataatcctatcttatggaattgttataaagattaaataacttcatgtaaaaaaggtgcttagaatagtgcttgaca

SEQ ID NO: 88874 - DNA, 1033 bp, Homo sapiens
accaacttggtgaaaccccatctctactaaaaatacaaaaattagccaggcatgttggcacacgcctgtaatcccagctactcgggaggctgaggcacgagaatcgcttgaacccgggaggcagaggttgcagtgagctgagattgcaccactgcactccagcctgggcaacagagtgagacccctcctgtaagcaataaaatacaatttgagaatgtataaccaaatcactctgatatccagtaatctccctattgctttaggaaccttaatatttaatgacttgaaagtaatcttttatcaagcagtgttccagtcaatgaaatgtaatttataatactgtactgtatgactagacttcagtaaaaattacttaattactgaagtctttagccatttttcttactttcaaggtctcagccagaaaactgaaaccaactccaccacggccacggagcctccatgaaagaatattagaagaaattaaagcagaaagaaagctgcggcctgtatcaccagaggagattagacgtagcagattaggtgagtccactgcttcctgtactcagtctagagtcatcccctgggaaaaggatctttatacacccagccccatgaaagtaaagagttctcattccttgttcatttctctgtatctcactcacttgttctccctctcactctctcgtatacataccccctctcactctctcatatacataccccctcacacttacttgaaatttatagggtgggaaatccttccgcctatctaatactgaactatatgagaacatcgtgccgtaattgaaagagctctgccagtctctaggctgaggttttaggaaagtctctttacctctctgagcatcattttcttcattggcagaagggggataaaagttcctcttaacctacattatgagttttatgtaagaattaaataggattatggtaaaaaaatactttataaattgtattgcatatacaaagataacgtattatattttaaaaatatagatgatagatgtac

SEQ ID NO: 88875 - DNA, 1964 bp, Homo sapiens
tgatataggacccaagaagataaattcaagaaaaaggaaagactagctctttagaggatctcttgaaagtaaaaagattaaattatgtataacgtcctaaaatgagcagtatggttaagaagtatttctgtgatgacaggaggatagattgcttagaatcaagagagtttatgattcttgtttggtggcttatttaacattttattttctccagtgtttatgcagttgtagtaataataagactttgttgtttgggaaagtttattaggtacaagttgatgaagttttaactttcacacgcttaattaaggggttaaagacacgcaggctctttgtatactcataagtatacctgactagcaattagagcacattttggtatacagggtctttagaaggtagtaactgatgcagtttaggttatagtctagatcttcacatggttaaaaagcatttgcttttctggcatgccacaaagaattattaatagcagtagttttagagattagaatcatgtgtggtctcacagtctttcaggacttaaatacccgtctgacaacaatcatttattttaacttttggtttcaaaatttttgatgtacctttagtttagatgtataaagaatcgtttaaaaattatggccatatgttgatttaaaataatcttaaggttggtagaaggttttcctgaaaggaacaatgaatgcctgtgtgcatactaataaagggatcccttgagaatggtttcttggtatagggaacattcaggctttgtttgggttttgaaaagaggatacgatcagtcaagcttctcagcaaggttcatgctaatttggaggggaagatcgtcttggcataaaatcctatttgattttaaagagagaatatttgtggaaaaggttgaaatagtgaaaaaatatgttttttttgtttttgtttttttgagatggagtctcgctctgttgctcaggctggaggcagtggcgtgatctcggctcactgcagcctccgcttcctgggttcaagcgattctcctgcctcagcctcctgagtagctgggactacaggcgcccgccaccatgctcggctaatttttgtatttttagtagacacgggtttcaccatgttgtccagaatggtctacatctcctgaccttgtgatccacccacctcagcctcccaaagtgctgggattacaggcgtgagccaccgcacccagcaaaaaaatgtttaaaaacattttttttggtctgctctttctgtatttcttgtgttcccatcctgatcattaaaggaaaggaatatatgaagtatatgtgtaggtttccagagtaggtagtgggggtgaatggtagaattagagattggtgaaatgccttatcagttacagtaatagataaaaattgttctctttgaataataagttcaaatatgtcaggttaattcaatctaacaaatatgctttgagttcctactatgtacaagtagtgttctagttttacatgggtgatgtaagggcaaatagttctagtcattaaagaagagaaaataaaacagaaacacagtggtgaatttaccatgaatctaatgcagcttaaacttcaagtcccttcatttacacaggccccttctaagtgagtgggaggagccttaacagtaagtttagatgttcatttgcaaaattaagattttagctgtaattggataagattgctatcactttttttttttttttttttgagacagggtctcgctttgtcacccaggctgtagtgcagtggtttgatcggctcactgcagctttgacctcccagattcaagcaatcctcccacctcagcctcccgagtagctgggactacaggcatgtgtcaccatgcctgggtaattttttttttttttttttcctgagatggagtcttgctctgtcaccaggctggagtgcagcggcgtgatcttggcttac

SEQ ID NO: 88876 - DNA, 1052 bp, Homo sapiens
gtctttgatagcagagacagaatttgaaaaaattattttatttatttatttttgagatggagtctcagtctgtcgcccaggctgtagtgcagtggcacattcttggctcactgcaacctctgcctcctggattcaagcgattctcctgcctcagcctcccaagtagctgggattacagacgcccgccaccacacgcggctaatttttgtaatttttagtagaggcggggtttcactatgttggccaagctggtcttgaactcctgacctcaggtgatccacctgtctcggcctcccaaagtgctgggattacaggcatgagccaccacgcctagcctgaaaaaattattttaaatactgatttacttgcaaataaggaattaaagtgtatggtcacttcttaattgaataattttttttttcttaaatagatctcctttctgtgaagaaataatctgttgccgtggagaccaagtgcgactggcagttcgtgtccgagtatttacttaccctgaatctgcatgtgctgtttggatcatgtttgcttgtaaatatcgctcggtattatagggccaatatttatataagatttatacctgtgtttaattggaattttacacattgtacattacttagctatttagaggtttgttattttaaaatcacaatctggcttgaatggcatacttcaattttgtatatacttgactggtaatgtttaaaaaaaatcatgcattcctttaaaaattaaggctgaaaaacttgtataaatctccctggaatttagtataaattaagtgtatattctattttaataaatgctactttgtttacagttatcagtagtttaaatattaatataaaatgcattcagttttctttacacaaacaggtaatcaaagagatgtttgtctaagggtttgagccctagacaaatcagtatgatcattacttttcacaggttaatggaattattttatacagattaggagaaattaacctcatgacagatttatttattgcattggtgaaaataaatgttaatgaattacc

SEQ ID NO: 88877 - DNA, 1051 bp, Homo sapiens
aggctgaggcgggggaatcacttgagctggggacatcaaggctgcagtgagctgaggacgtcaaggcagcattgagctgagatcatgccactgcactccagcctgggtgtcagaactagaccctatctcaaaagagaggaaaaaaaaaagaaatttcttcattcggacactcaactcaaatagttatttttgctttcgcgtgtagtcttcctacacttaaatacgaaattgtaaccatagtgtttaatatcttggtaatttttttcacagaacacagtatcagatattttcttttctttttttctttttttttttagagacagagtctcactctgttgtccaggctggagtgcagtggcacgatctcagctcactgcaatctctgcctcccaggttcaagcgattctcctgcctcagcctcctgagtagctgggattacaggcacacaccaccatacccagctaatattttctatttttttataggtctttataactttttaaaattgaaagtaatataaccaaagaaaatctggaaaaagagtggaaaattatatataacctccccagtaataaccattgttggcattttgttgttgttcttgccagtcatttttcttatgtatgtattttcttgaaattatcacatatagatactatcagtcattggttgagtgttttccatttatttgcatttcttgctgtatgacttgtttgcttgtttgttcatgtacttcagctattaatctattaaaatattccaggctgggcacaggagctcatgcctgtaatcccaacactttgggaggctgaggcaggaggatcacttgagcccaggagttcaagagcagcctgggtaacacagtaagacccctgtttatacaaaaaaaattttaaaattagctaggtgtcatggtgcacacctttagtcccagctacttgggaggctgagatggggaaatcacttaagcccaggaggtcaaggctgctatgaatcatgtcaccagcctgggtgacagaggaagaccctgtctcaaaaaaaaaaaaaaaaa

SEQ ID NO: 88878 - DNA, 1023 bp, Homo sapiens
ttggggattaatattgacatacttgaaggctttttattgtagtagcatatactttagttaagtacttttaaagaacagacttatcttatgaatcagaaagcactgatatgctgtaagttactggataactcatcacaatttgccagtcttctgaaaagttagtgatagaaataggactgtacttgtatttccagttttttgcatgctttctgagacattagcaaattgttctctttggttttatataagcttattatttactgtttaataaaagtattcttttatgttggcctaactgaatatgtagtgtggtataatttcgtttggattatattgctaggtgatggaactagaatggctgattcaacaacaatgttatcaataagtgatccaattcatatggtgctaatcaaaacagacatatttggtgagacgactttagtagcatcatattttctggaatggcgatcggttttgggctcagaaaatggagtgaccagtctgactgtggaacttatgggtgtaggtatggtgattaatatatcattgttaacctttttatagccacagttcatttgtaaatatattttatatctttaaaatgcttttataatccaagagggaaacctgtaaaatagaatttcgttagagttacaattggacctcagcatcctaatcttgagaaatgtcttgaagaataatatcagtatagcacttcatggtcaatctgaccttgtcttaggagaaatgtttttttctggaaaatgaatacaggaattttgagggttttaatttcaagttcatttgattaaatataaggctataaagaaaattaatattcttgacacacatacaaacttatgtgtgtccagtcatcacaccctggaatacatcccctttggtaccagtgattcttgcaaaatacagagtagatgttctcccaaccttttacagtgtgggtgagtgagactcggaagaggaaataatttgctcagtgttagtatcaactagtccttgagggca

SEQ ID NO: 88879 - DNA, 1809 bp, Homo sapiens
gcaagagtctggggcgatagaacgagcggtcttggcgttttaggacggccgtgagaatgaagcgcttagcgagcgacttctggaagtcggatcgagtgtaagttgtatttggaggtttatattctgctgtaagatatcaggttttttttctttcttgagacggagtctctctgttgcccaggctggagtgcagtggcacgatctcggctcactgcaacctccgcctcccaggtttaagcgattctccgcctcagcctcccgagtagctgggattacaggcgcgcgccaccacgctcggctaatttttgtatttttagtagagacggtttcaccatgttggtgtggctggtcccgaactcctgacttcgtgatccggccgcctcggcctcctaaagtgctgggattacaggcgtgagcctccgcgcccggcagatatcagggtttctttaccgctgaaacatgtgggtatcagcgaagttgaaccaggagcttcaatcagcaattctcaaataagtcatggaagagaagttactaaagggtttgtaatgacggaatttgttaatatttcggagctccagaagaacctccagtttctgcagcgctcgctcgactgagtgcaagatgctgaagtgataaaagcgaccatttatggtgcccttgtgtgccaggctttgtgctgtctagtatctttaatcctcacaacactatcgtgagagggcactacactaggtttttccattcttatcggtgacgaaacagatttataaagggtaaataagttggcttgaggttacacatctactaagttgaaagctggtaagattcccttatcattaggcagatcaaagtatgaaagtaataagatcatactttgatctgcctactcccagtccgtgttcttctgattatactatactccctctcagaagattccttttggttgagtgttgtttgtggagaaatggtaacaaaggtgccagataaccagtggagactatttctagaatttgtactcaaaagattcattctttaaaagcttacctttgttcccattcaattgtggtaacaattgtgcatttactgttagctggagaaccttaaaacttcagaagcagtatttgactgctttgtgatgttataaattgtaatatgagttttctacatagatggatgtccatggtagaataagagaaatccttgctgagactatacgggaagaattggcacctgatcaacagcatttatcaacagaagatttgatcaaagcccttagacgtcgaggaatcattgacgatgtgatgaaagaacttaattttgttactgtgagtaatcttttagggaaataaatgagagtatatatgtatatactaatgcgtaacactacttataaggttccgatgtggggcctttcgttttagtaaaaccacttcaaggtcattctgtttactagtgtccttgtttcaagtataggctagctctgcccttgaatatactgaatagttttgtgtatcaatgaaatttgtgttagatatcttattcctgtctctacagtgacagaattttctcttattttctaggtctgtaaatttgaatatacatactttagtccaattagttcaccataacaaagttctttttcattatgatctgtaacttttttagattaagcgtatttttaaaataagcactcttttgggattatattctctatgattaacaaattacaaatttctttaagaaaataattgactgcataagagtcctcaaatcttttaatacaaataggtcaataatgggatgatagtctct

SEQ ID NO: 88880 - DNA, 1013 bp, Homo sapiens
tgaaaatcaatatctagctatgatgttatgatgctttcagtactaatataactattgtattctgtctaaactttttgaagtgctgtgggccaggcgtgttggctcacgcctgtaatcccagcactttgggaggctgaggcgggtggatcacctgaggtcggtggatcacctgaggtcaggagtttgagaccagcctggccaacatggtgaaactccgtctctactaaaaatacaaaaattagctgggtgtggtggtgcgcgcctataatctcagctactcaggaggctgaggcaggagaattgcttcaagccaggaggcagaggctgcagtgagccaagatcacgccactgtactccagcctgggagacagaggcagactctgtttcaaaaaataaaataaagtgctgctaattttggtgacttactgaacatatcttttataatttcagccagcagtatctgttggaaatgttggccagcttgcaatggatctgattatttctacactgaatatgtctaagattggttacttctataccgattgtcttgtgccaatggttggaaacaatccatatgcgaccacagaaggaaattcaacagaacttagcataaatgctgaaggtatgtaagactttaccttgtatttttccactacaaagtagagttgttttaaattagaaatagactttattgataattgttttgtagcaaatgtttacttagtgccaactttgtgtagagttcacaacccaatcacattgtcctattcttttatgtcctggttttagttgttgttagcctcttgtaaatggcaagtcttacgaaggttgagaataagatcatacttgtatcttttttttttttattatttttgagacggagtctcgctctcttgcccaggctggagtgcagtgacgcgatctccgctcactgcaagctccgcctcccgggttcacgccattctcctacctcagcctcccgagtagctgggactacaggtgcctgccaccgc

SEQ ID NO: 88881 - DNA, 1038 bp, Homo sapiens
gttaaagtcaaaagaaaaataattttttatattttcttacagttaacttttcagaaatgaatctgttccatagaataaagcccactggcttattttaaggtacttctaaaaggtcttattttaaccagatgtcatatatgttccgtattttaattattgaaaacatttaaatgcaaaaggtattataattcaatttttgtttatcataataatttcaacttgtataacttcactgtcatatgatttcattttcttcttgtttttatagtgtattcattgccttcaagaaagctggtggctctacagttaagatccatttttattaaggttagtatgttgtagtttgcctttttgtttattaaagtgtaatgagaaaataagtaacattagggattaagattcaaaaattactactgtttttaccatatgtacagttaagatctgattctacagagaaataatcttacaatatttcagatgtgttactgtcttttcatgattatatagaaaggaagcagggcttttatcttgagtgttaacatattttcagttcgggtagcattggtgaaaaaatgtaagcatattaatattagaggtttattccatttgtattacctttcagctggtggcatctacatataaactatgtatatatcaaattatgtatatgtcataaaatattctgaatccgacttctttcctcctccactgctgtcattgagtgcaaaccagtgtcatcttcatgcccctgactaacttgctgatctgcctcccacaaacagcagcactgatgatcctctaaacgtacaccacatcactactctctttgaaaccctccagtggcttctcctctcactcaaaattgtgatccaggaaaaggggctcgcttcctgatgcactgtgacaccaggtttttgagacaagaaaggctttatattgcaaattgactcccaaggagacaggagtcgacctcaaatctgcctccctgtgctgacttcaaggcagtgtttttattagaaaaggttcagagggtggatt

SEQ ID NO: 88882 - DNA, 1014 bp, Homo sapiens
cttgcctgtcccagagcctgcctctcttaactgctgcactagactaccttcttattttaaaagttagcctgcatttctcttacctgcattttaaattttattgagtagttattttatgagcagtctttgaaaaattttcataaagcgggctccccctgaaattttataacccacattccagatttaccagctgtgaatgtcttgccacacctacttgatctctcgctatgcgcgtacacagtttccttcttcgaaacaatccagaagtaggctagcaatggtcacccctacatacttccgcacacatctttcaagaacaggacaccattaccacacccaagaaaaccagcatttaatgaatttattcaggagtatcatccaacatactcaaatttccacagctgttccgaaagtatccttcaattctggatccattgatggttcacaggttgtatttggctgttacatctttttagttgttatccttcagagtaaaactggcctgcccctctttctttctttacaatattgactcctttgaggaaccggggctggatgtggagcattctccattcatctgattgtttccatgtgaccagattcgggtcacaaatttctggcaagaacccttcacagatgaccatgtattggttattaggtaacaatagattactcaagtagagaactgggaaattgtcctttgtccatcacaatagattttttttgaaatctagattcctcatgattcattgatttcttttctttttcttttttcttttttttttttttttgagaaagtttcactcggttcccccggctggagtgcaatggcacaatctcggttcactgcagccttcacctcctgggttcaagtgattctcctgtctcagcctcctgagtagctgggattataggtgcctgccaccatgccccgctgatttttttatttttagtagagatggggttttaccatgttggccaggctggtcttgaactcttgacctcaggtgatcc

SEQ ID NO: 88883 - DNA, 2002 bp, Homo sapiens
aaccactcagcgttttcggaagaagtaggaacttttatttcctttaatgattccattctcttccacagtttccctcactgctttagatagtaactaggtgttattttctttcagtctctgctgtggtgcttctgaaaattactgtcttctgaagtaggtttggggagtaggtcagaacataccttatctgctgtagccaaggacagaaaggctggtttttcatgcagccatggggtgaggcatgattgtgcgtgttccccagtgggtgttacaggggcctgctctcacaagtagaaaactctgtgtggggcgaagggagatgataagtgatcttatggtgtggcgtcttttcctttcctaaaccaggtaggttatcgtagctgtaaaaacagacacactagagtcagctcttgtaccctatgaaagaatactgattcttatttttatttcttgtagctgttctaaagaaatccaaatggcagttctgctgaaatttgtttcagaaggggacaacatcccagatgcattaggtcttgttgagtatcttaatgagtggcttcagatactcaaaccacttgtaagttctattatagcttaagcctcttctttgtctggttgtattcattaactcgcactttatatactacctaagtagaccaagtaagtgaacgtttgtattaaatatagacatatctttacataaaatttagtttaagctgaacttttgaaaattagaggacagttaaccaacctattatttacagttttttcattaaagctgactttccaaaaaggaaaatccttagttcttcattgtacttactattcatgttagattaattatgccagacatagtcttgcaataataaacaagccttctgtggaattcaggaatttttttagggaagtaaaaagtattgctatgtgagcaatactgtagctattgaatatgtattacagttgatatttttctctattatgaaatgagagcattacacccagggaagtgagttagcctttaggcataacagaacactgagcataaggctgctttctaagatgggtaactagctttttaattcatgcttttgccaagaacaaattgatacaaatcacataatgctgattttttttttaatccctattctttttgaatgtgattttccctaataaacttcatctacagcctttctggcatatctttataatttggaacttaaagaaatttatcttcagttgacatgaagacaaagaaactttatttttccttaacaataaaacctggctataaaagtgccaaccaaaaggaacacaaaaggagagttttataattcactttaaaaggagatttgatggtaaagtttaaagattaaaatattttgttcttcaattacagagcgatgaccccacagtatctgcctcacggtggaaaataccaagttcttggagattactctttggcagtggtcttccccctgcacttttctgatctaatttctgttttataccttatacccaaaacacttactaccaacacagctgttaaacattctatacaaaaaaattgtatgatctggtattaggaaattactttcacagtaaatatcaaagaaaaaagattaagggtctctttgccatgcttttcatcatatgcaccaaatgtaaattttgtacaataaaattttatttcctaagtaattttgtcttaaatgtattttttttaatttcagactctctattagcttcctagtttgtctctaataaatcaccacaaacttagtgacttaaaacacaccagtttaattttttcattaactaattaattaattttcattctgtattttaagtaaaatgagacgaggtcttgccatgttgcccaggctggtctcaaactcctgggctcaggcaatcctcctgccatgtcctcccaaagtgctgagattacaggcattacaccactatgcccagccacaaatttgcttttaaattctgacttctgagt

SEQ ID NO: 88884 - DNA, 1738 bp, Homo sapiens
tgccctgtctttaaagggagtagcctaattctcagcatttgggagtttttgactaaatgtgtggatatgatttgtatttcctatttcttaatatatatgtgaagatacaatactgacaagtacttagatttggaggttttgcggtactgaggggagttgggggaagaatggaaataccattgacctcctaaaaagttgttacttgcaaagtttgggaggtgacatcaaaaactcaactgcccttacaatagtcattccatccatctgttgcttatttgaattctcatttatttttactttatggcattaaaatacaataaatctgtcaattatgtattttatattagtagtagcttaagattgggtcacttcatttcggtagatataattgttagtattatccttcaggacaaaaagcatctgctaacaacctgtggtttaaaaatataggccaactttatgttcaaacattatgttgataatatttttagcagtattacacagtggaggtccaaattggattagacttttgcattgaattccaaagtattggtaagtctagcacatagtataaagtcttgctaaattcttgtgggtacattatttttaaaacctgtctgtctgtcggtatcacacagaggtcacttcttgagtaaaataagatgaccttaagaattcacataattcttgaagaagaatataagtcacgatgcttccacatgaggccgcgtcacaccaccatcgtttggaaatccagcaccccagccgttttaccctaagataacagtgcagcacttagtgtggttgaatgtgtcatgtgggaatgatttttggtcaccttttcagttcattgttagtccttttatgtttgtgtgcatctatgttcgtctgtgtgtttggtaaatatgaattgaatagatgacttcttattttatgttttaggccaagattgacagacacctaatattcatgacttgagaatattctgcagctataaattttgaaccattgatgtgcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggggagattactttgtattgtactgccattcctactgtatttttatactttttggcagcattaaatatttttgttaaatagtcttttgttggtttgtgtgcattatcttaggacagctctgcttcaaataatgaatattttcctgtgagtttataatttctgtaacaagcaattgacatactgccgaggcgggtggatcacttgagatgaggagttcgagaccagcctggccaacatggtgaaactccatctctactaaaaatacaaaaaaattagccaggcctggtagtaggcacctgtaatcccagctacttgggaggctgaggcaggagaatcacttgaacccgggaggcagaggttgcagtgagccaaaatcgcaccactacattccagcctgggcaatgagtgaaaactccgtctcaaaaaaaaaggtttttatagttgcccttcaatagtctttctatccttaatagtacaggttaggtgaaagcaataatagaagagttatgata

SEQ ID NO: 88885 - DNA, 1052 bp, Homo sapiens
atgacatttccagttgaaactaggcttgctttcggtacacaggtgaagacttgaggaagccagtgccagagaggacgtgcctcacccctcagctggctgaatgcgcttcattggcttacgctttgctttctgtatgctttctgtccttctgggtggtgtcgcatatatttttaaaaccacattcagtgtgatgaacacttgttggtacacttctaaggttagtcatctttccttctctgagcagatccttgagaagggcattgacagtggatgctttaaatagtgttcagtttttaccagtaataatattttttggtggatgtcatgaaaacacatgacatcgtgttgtgcccatgataaaaagtcctgactttttattgaatgaggtgtgctggtcaaagagacagacgtggctgccttctctggtaacagccagaggaaaaagttagcaattctagatgggttctacagctttaaaaaacttgttgtatccttaggtcctcataatattaaatattttctaattttaacagattttaagagtcagatatatactttgacttgaatgatgtagtgttgcttaaggaagaaaaaattataaaaaaaatgtttcttttattttcaggagtttttaattcatatctagttcatttccactcatatctatttctgctaatagattgacagcaacctttggtttaatgctgtgttctctagctacaccaacaagttatatattcctttccaatattaaccaagtatttattttatgttagcctatgactgagttttatctatgcttgcacatatatagaatgtaaaaatataattctccatgtttaatgtatccatataaaaatgaaaatacccattttctgcattcttaaagggttaagaaaagtaacatgtaataagcacatggaggactttagaccatttcttgtgttagaggagactttatacatttgtgaggttttctgtcttttggtccttttatgttcttagtccatttcattattgttttaatatttctaccaaggaatgaccaagaa

SEQ ID NO: 88886 - DNA, 1340 bp, Homo sapiens
gtacatctctgaatcattaaagaatattgaggcttttcttggccgggcgccgtggctcacacctgtaatctcaggactttgggaggccaaggcgggtgaattgcttgaggtcaggagttcaagaccagcctggccaacatggcaaaaccctgtctctactaaaaatacaaaaaattagctgggcatagtggtgcacgcctgcagtctcagttacttgggaggctgaggcacgagaatcacttgagcgtgggaggcagaggttgcagtgaaccaagattgtaccactgcactccaggctgggtgacagagcaagacgctgtctcaaaagaatattgaggcttttcccctcattattccagtgttcaaatagggtgaaaactatgtggatggttttatttgcgcctaggtcctctgtgttagagtactcaagtcctgctctgtgtgcacttcctttcacttgtttttatttcctcatagtgctctacggaaacgtattcgagaggacagaaaggccaccacagctcagaaggtgcagcagatgaaacagaggctaaatgagaatgaacgaaaaagaaaaaggtggttatattggcaacctattctcactaagatggggtttatgtcagtcattttggttggcgcttttgttggctggacactgttttttcagcaaaatgccctataaacaattaattttgcccagcaagcttctgcactagtaactgacagtgctacattaatcataggggtttgtctgcagcaaacgcctcatatcccaaaaacggtgcagtagaatagacatcaaccagataagtgatatttacagtcacaagcccaacatctcaggactcttgactgcaggttcctctgaaccccaaactgtaaatggctgtctaaaataaagacattcatgtttgttaaaaactggtaaattttgcaactgtattcatacatgtcaaacacagtatttcacctgaccaacattgagatatcctttatcacaggatttgtttttggaggctatctggattttaacctgcacttgatataagcaataaatattgtggttttatctacgttattggaaagaaaatgacatttaaataatgtgtgtaatgtataatgtactattgacatgggcatcaacacttttattcttaagcatttcagggtaaatatattttataagtatctatttaatcttttgtagttaactgtactttttaagagctcaatttgaaaaatctgttactaaaaaaataaattgtatgtcgattgaattgtactggatacattttccatttttctaaagagaagtttgatatgagcagttagaagtt

SEQ ID NO: 88887 - DNA, 1045 bp, Homo sapiens
tgtatatccagacatcgtgtctgtagtgcagacatgaaggaggcggaaggggaatgagcagaaaggttgactcctgccatgacttttaaaaaaaaaaatagtccttatactagccagaactggttataaatccttcctttaaccaatgactggccagaaggaatgagattactatgattggtttggaatcagttgtgaatcagctaaagaatcaaagtcctccaactacttgaggggttgagatgtggggagggatgagtaggctgggatagttgttgtgtacataacagttatagctggagggttaaattatcgttgttctttcagaggagaaaatgcatagcaaaaatcttagcaatgatcttgcattgattctgtttcctgggttccaataacaagacttgtctcattttttgcctttcttgcagatggaaaaaggagatgatattaacataaaacaagtgttactgaacatgagaaaataccgaatgggtcttattcagaccccagatcaactgagattctcatacatggctataatagaaggagcaaaatgtataaagggagattctagtatacaggtaaacttcatacaggttttaaatcatatctatttgttaaatacacatagcatcaaataactgcactccacttgagcccttgtctttgtttcaaagagtgtatttgaatttttgtggtaaatccagctggctgtcttaaaattgtaaaattttagctagcttcctcatatatactcagcctcaggttaaatcctgtgtgttacttaaaagcccttgtagaaacaagatttcattaaagaaactgaatttttcattttgggggtggttaatcttttaattattaaagtaactggaaacttgagatacttttgccttcattaaacactgatacttggtttatgtgatatttgactttataacaacaagcaacttgaatatttatggcagatataatgaaattccagcaaaatgttatattcttctggttggtggctttattctcattaagctatttttactgcata

SEQ ID NO: 88888 - DNA, 1480 bp, Homo sapiens
tcactaaagagtataaattataaagtcacagtttctcataaagaggctttgatagtttcacttcctgaaatgtgtatattcacaatcttttgcaatagttattttaaggtgatgtgttttatttttttctctactgcctcttcgaaatcaaaaagttatatatactttttattttatattaatctttttcaatttttgtttttataattttaatgtattttaaatttattttaaagttttatttctcctttttgctttaatatttcttcctttttaaattgtttttcatttttcctttgtatgtgtttttcttaaaagaacagaagaattaaaataatatctagtgatgtaggtatttcagttttgtttttaatcagccttgagaagaaaatacaggctcaaataacatttgtagtcagttctaaatagctatagagttttcccaaggattacctttcttttttagtattatctgataacaaaataaaaaaaaattttcctgagaaaattcaccgttcctttgcttttgttgactctgtatattaatgttaaacaggaagcgaggccactgccaggggctgagccctgcagacccagtgccctgcaggtagtgccctcctccctactgcctcccaggactggatctgggcttttctggtgtgtggttactgtgcttatagagcattgaggtaacacctcgtgcatattttacagatagaaggaaaatagcagtgaattttagttcagagtcctgagggtgaggtatcaaatactctggctgaaggtctttctctaggtttacttcctgcatagctgggcaagggtgtggggtggtgccatgtggggtaaccagattcccagcaccctgtgaggtggaccttcccgggttttatggattcctaccgcatgttagctaaatggctgttttcagttgtgcaatagatatgagtagcctttggttagtgttctttctgtgattacaacatgaggaaatacattcctttggtgtgatattttagtggaactttaattttaaaatcatgtagttttctaaaaccaggctttctttttttggtatgttgtctaggagatatgtggtctttattttaattaagttgctgacctttttactattttacataatataacagttaaagggtgattaaactgttttttaaaaaagtgatttttaaaaaaaagtgcttgttgacatcatctttctgagaacactagtatatgtgatttactataacaagatcttagtttttcctgttggcaaatgacatgtaatatttacagaggtcttgggttcagtccagcagaaacatctcagataaattgatgtgtgaaactaaagccattttacattttctttcatatggagataatataaacagttttttcatttaaaagtaaggagagactggctatttagtatggatttctttgagagggacaacttgtaatagtatgcattctc

SEQ ID NO: 88889 - DNA, 1020 bp, Homo sapiens
acacctgagtggagagcaacgtgaaaaggtgatgtcagcaagaatttaggatgtatggaaaggatggtaaaggcaccaactggatggatcagggagacatggaatgcagaatgcaggaaataggtaatctcttaaattgcacaaatctaggtttcatttttgtgctctagtgtgttacacttgtgatgacttgacttccctgagtgacagtgcgatgggtgtgatccatattcatatgcacttcatagggctgtgaggactgagagaggtgacccagtgacgagtgtcacacaaacctgacatgtcgtaggcaccaaatggttctagacagtggttctggttggttttgtggtcaattggaaacctttcatcaagtagaattttctttgcagagcaaacaattgaaatgttaatattctatgtgtactaaagtttgtattctccattaatatgggggagtatatggtgacctggtgtttagtgccagctttgtttttggttcattgctcgatttatgagagagaatgcataatatttgttgttcgactattttacttgcaggattgaagagagttgacaaatctagaaaatgctttgagttcttggacatcactgtttgaaaacgtactgattacccttagttgagaatgggaaaatctaaaggggaaaagtcactggttcacgctgtactattagaattggtcatcttcttgcctgacttgtaagttaaggatgcttgatctttgctgtgatttaacctgttcaggatgaattgtaaccagttacaatgaatacaaattctcctttctgtttgacctggaaaactttccaaaaggagatgtctttacaataatgatatatttggtgaaagctgtgggttgtttttttttttttaaagcttatgatgacagtattgaaagaggaaactaatctgtattgtcagcacagccacagctagcactagtcatttcttgagaggtggagctgtttctcagaaaacatgctgtttgagggtaggag

SEQ ID NO: 88890 - DNA, 1054 bp, Homo sapiens
tttagattttttgtagagatggggtttcgtcatgttgcccaggctggtctcaaactcctggactcatgtagtccacctgcctcgacctcctgatgtgttgggattacaggtgtgaggcaccgtgctcagcctccgtaatgtatttcaaatctgttttcttctctgttcacattggcttggttcaggccctactacgcttttcctcgtcattacagtagcctccaaacccatctccttgtttcccttctgttcccacttcagtccattttcatggtatctggagtaatctttgtataatgcaagtgtgttttccactctcctctctaatagtgctgcacaatttttatgaaaaagttaaacttctttagcattatcatactgggctttttggagattgacccctttacacacctctctaaatcttttctacccattttcctagaaattattcatttcagtaaaactgaatcacttggagttcttctagcgtgactggtttttaatacctcagtggcttcaaatatgtcattccctttttgaaatattcttcccctcctctctctgacccatctcaatcaaagttctccttctgcaaataccagctcaacaacctctttcccgtgagtggtattctcatccagtggaggtggtggttctcgttcactaagtccagaggggctcaggaatgtgtattttttaaaagctgggatggtgttgctgtaccttttccaactgatagtcattatgtaatttaaaaatgtgtttctggctgggtgctgtggctcatgcttataatcccaacactttggaaagctgaggtaggaggattgcttaaggccaggagtttgagaccagcctgggcaacatctctacacagaacttttttttaattagctgggacgtggtgatgcatgcctgtagtcccagctatttgggaggctggggcaggaggatcacttgagaccactaattcaaagctgcagtgagttgcaatggcaccagtgcactccagcttgggtgacagagcaagactgtctctaaaaaattttttaaa

SEQ ID NO: 88891 - DNA, 1127 bp, Homo sapiens
ctctccccggatcgtgcggggcctgagcctctccgccggcgcaggctctgctcgcgccagctcgctcccgcagccatgcccaccaccatcgagcgggagttcgaagagttggatactcagcgtcgctggcagccgctgtacttggtgagtcgcggacccacgcggcagtcgccgacctcctccgagacccggactcgtgccctgtccgcagggtccctcccgcctcccccgcctctcgcctctagcctctcgctcggggcggaagtggcggcgcggtccgcgtcaggggcgcgcctgcgctgaccgctctcttgctccttttggtttaaaaaaaaaaaaaaaaaaagcatacttgagctgagcagctcatggttagcgcaagcgcagttagttctggagggcggtgccacagcggcttcttggggagcgcgtggatgcgccaccagcgttgcgcggcccgggtctgggggtccttgggaaagccgtgggggcgctcgggcgcgcgcccccgggccgcagcttcgccgtagctcccacgccgctgtgcttggttcttgctcgcggacagctctttctctggccgggtgttttgtggccgggtgggcagctggcgtccccgggagcggtgagggcgggggcgggcgagccgggccgcggcgtccgggtccagctggcgcccgcgcaggacctgtgggagcaggccgctctgggcgccgggccggccgccgcagccctctgcgaggcgaagctcgctctcctggcggagccgcggtggttgggggtggctcgtggcctctggcgagggcagcgctctcgggaccctccgtcttcattttcccccgtggcccagcagcgcccagcgtgggttcggcccccatagaaccttcccggaacgaaagaggctttgcttgtgttcgtccagtgatagcgtgtcattctctttatagttttccttactgaggtatactttccctacagtgaaacgcagctttcatgtgtgctcccagacgggtgtcacaaatgaatcccctcttgcaagccccctcaaatcaaaatagcctttccttgccctgagaaagtgccctcatcccctccccgggggcacggtgttccgatgcctatcgccc

SEQ ID NO: 88892 - DNA, 1053 bp, Homo sapiens
cccttggtgcttggcccagtgcttgacacattcaaggttctcaatgtaaattttttgagacggagtcttgctttgtctcccaggctggagtgcagtggcgtgatgtcagctcactgcgacctccgcctctggggttcaaacgattgtcttgcctcagcctccctagtagctgggactataggcatgcggcaccatgcctggctaatttttgtatttttagtagagacggggtttcaccacgttgtctaggctggtctcgaactcctgacctcaggtgatccgtttgccttggcctcccaaagtgctgggattacaggcatgagccatcgcacccagcctctcaataaatacttaattgaatgaatgaatgtttacttgctgattgtgttcttttgttaactatatgttcaccgctttccttgtacactgattcagtcttatagtttttgtatcaatttgtaggaatttttgtataaaatatctgccttttattttcttataggtctgggataaaagtgaaagtggtgattggcattgtactgctagctggaaggttagtatttatttttacatttattaaaaatacagaaatatttactgtttattttatagttatctatgaattgttttgagaaaataacatttatacagtagttcttttcctgggaagacattttactgtttttcgctattaaagtaacaactgtgtttctcagaatttgagagtaagaaaatctgtaattctgtagcattctaacataattatcttagtaattcagaatattccttttgcctttacatattttaattgttgtgatgtttcatacatagttttctcttaaaaaaaaaaaacaaaacctttactcaagtagaaattttcttttttttttttttttgagacggagagtcttgctctcttgcccaggtgggagtgcagtggcgtgatcttggctcactgcaacctccgcctgttgggttcaagtgattcttctgcctcagcctcccaagtagctgggactgtaggcgtgcaccacgatgcccggctaatttttg

SEQ ID NO: 88893 - DNA, 1150 bp, Homo sapiens
tttactctgctcccagccgctggtaaccactaatctactttctgtctgtatggattttggagcaaataaatctaatgttatttattttattaggtgggtattttctgtagaaagaatttgcaagtaaaatggtggacttacagaatctttgtttcaaaggttggttacgctaaactctgaagcaactctccaactatcagcactggaagtagtcaagtttatctggctagatttttcttttattagtaaaatgtcagaagaactggacttcagaagcattacaatcctaaatatagaatgtcttctaaaggttaaaacattctggaatttaactttttatttacatgttatgttgatcagttttcttctctcatagaagtaaaactatattctgtttcctgatgtaaaaccagtgtttatgaaatatgaataagtatttaggaaaaaagaagccctgggataatgagtatctgttcttttcttttttttttttgattccccagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggtgagacatttattagtattctggggaccgggaagacatgagcagccaaggagcattcatccgaaggctacctcagataattggtaaaatatcaccactcccctctagttttaccagttctaaagttctttcttccatgtttttttcttccttttttatttcattttaacttgggtctgaagcaatacttaggagcatcactgcattgtttataacttttatgatgaatccagaatatttgcattgtatttgattttacctattagtatattttatgatagtaatatatgattttaaagtattctggctcactgcagtctcaaactcctggccccacctcagcctcctgagttgctgagattataggcatgagccactgtgcctaactctaaaattcttttttttttttaactttaaactcttaagggttaataaaattcttttttttttttttagacggagtctcactgtgtcacccaggctggagtgcagtggcacaa

SEQ ID NO: 88894 - DNA, 1180 bp, Homo sapiens
cggtgtcttgccatgtagcccaggctggtcttgaactcctgagctcaagcagtctgcctgcctcggcttcccaaagttttgggattacaggtgtaagccatcacgcccaactcatttacagttaaagggtctaatgcttgcagcatgctttgtgtgacaaaacttcttgtctgaaaattctaacattttcttttttttttgtgatcagtttgcttaagagagattacttatataacaaaggtaggcttttggaggtagacttttttttcattaaagggagtaattaattatagctcactaatttgttagtgattcccagctatatatgtggtattttgccatgtacttgtaggaacttgtggcccagagatgtatccaagcttatatacctagtgaatgatagaggagtttctgtgtgattccagagtctgtgtgtcttttccactctaccatgctttctttttgtatataatttaaattgttattattttttttttaggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaaggtaagtttacatattaaacctctgataacatcctagtaaaataaactagtaacttttaagctaacaatttgataatttattctctcaaaggtgcttcttctcaagatatatagagtatatgttctccatttttcacccaggcatgtcatttgtccctgttttcactcaacagaggaagccggcattgtaaatattttcatgtgaaccttttggatgttttctatgcatatgcaaataactatttaatgttgtcataaacacatatatgcaaacacgcccagatattcactagcacaagtagacacagaacaccagatattgaaacccatacatttgattgattgattgattggttgattgagacagagtattgctcatttgcccaggctggagtgcagtggcaccatcttggctcacagtagcctccacctcctgagttcaagcaattctcctgcctcagcctcccaag

SEQ ID NO: 88895 - DNA, 1089 bp, Homo sapiens
tcatagctcactgcagcctccaactcctgggcgcaagtgatcctcctgcctcagctcctgagtagctgagacaaacggcacatgccaccacaccaggctaattaaacaaattttttttttgtagagatagagtcttattatgtggcccaggttcttcttgaactcctggcctcaaatgatcctctctcctgagtctctcaaaatgctgggattacaggcatgagccaccctgccgcagtgtttcttctttttgtcaaagcacttaagatctttttgtcatgaagttagtcacagtagggttactttttgtttcatagttaatgaccaaaaatttcaggaggaaaaattactaagacctcttaagtatcttttaaaaatatgttgaatgcttgaaagcttttttcaggcaaagagctcctttctatctgagccataagaatatgctaaaaacagttcataaggatggaatcttcagttcccatgtgtgacattctcaggtgcatacttgcagtgtggccatgtcagctatgtggcagagacctagattcactagtagtgtgacaggctaactgtaagctggttgtctgcttgcctccagtgtgttcattctgtgaatgaaatgtgtatttcttttgttatctaaaatgttctttctccccgtttctagctctcgtgctcattcccccatgatcgccgtaggaagtgatgacagtagccccaacgcaatggccaaggttcagatttttgaatataatgaaaacaccaggtcagtcctgctttggttttaataattgttcagaattgcatttaattttttaaaatgttatttctttattcatttacagaattatgtgtcattcatcatatgtttgctgatttactataatataccaagttctgtgctaggctgtgatagcacaggcatgagtgataaagaggagaaagtagaccagcctggccaatatggtgaaaccccgtctctactaaaagtacaaaaaattagctgggtgtggtggcaggtgcctgtaatcccagctactcgggaggctgaggcaggagaatcgcttgaacccaggaggcggaggttgc

SEQ ID NO: 88896 - DNA, 3678 bp, Homo sapiens
ctgcaatctcggcactttggggggccaaggcaggcagctgggaggtggaggttgtagcgagccgagatcacgccactgcactccagcctgggcaccattgagcactgagtgaatgcaactccgtctgccatcccggcacctcgggaggccgaggctggcggatcactcgcggttaggagctggagaccagcccggccaacacctacagttacttttaaattaatgtcatttttgaagaatggattatttaatgaacattttatatataaatatatgtctttttggaaaggggaattgagtcaagagcagatttatattctcttaactgtgctttatttaggctgaaactaacaattctccaaatataactgataatctataaatatttaatgacaagtggcagtctatttagggaaaactaaattagtattgagacagtcttgtgaataacatatttaactttaattttgaattgtgaatttcagttcttttctttccattctttcattctttcctacttgctgccctgcccatttttttttttttttttttttttttttgaggcaaggtctcactccgttgcccaggctggagggcagtggcttgatcttggctcactgcaacctccacctcccaggttcaagcaattctcatgcctcagcctcctgagtagctgggactacaggcgcccgccaccatgcctggctaattttttattttgtatttttagtagggatggggtttcgccatgttggccaggctggtcttgaactcctggcctcaagtgatctgtccaccttggcctcccaaagtgctgcgattacaggtgtgagcaactgcacctggccttgccctgcctttttaaattaattattgtcatctattttattcttctgccttgtgtgggagaataaaatcatcctgttttgttgtttctttcttccatgaaacagtcactgagtatcatttatgtgctgggatcactccaggtcttggcgagttaaatgaaaatgacattggcccagctcaagggccaaggtgtggggtttgggcagatgtgcacattattataaagtgatgtggtggcgagaccacttgtattaatttagaattttacgtgtgtatatatatatgtgtgtgtatatatatatgttttaaaactttgtttggaatgcctcagaaaatgttttttattaacaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaaggtaagagttcagtgaaggggtaattgttggtttatatttctgctctgcaatttttacttaaaatgtaaactctgaaatattttttgaaaatggtcttttacagttacttttaatgtcatattaatttatgttattttgaacatcagtttacctagttcatagaagttaatgactgaattgttttttaagttatgtggaacagagcagttttcaaaactaaagtaattacaacagaatatgcaatatctccaataaaaagataccagttgtcatatatgtaccttacatgactgctctacaaactcaggctaggactgtagtggctccttttttatcaaataaattgctttagacaatccatccttaataggagaaaatccagtatcttccctgcttcttctctgcagctcccataagttaagagccttgggggccctgattgtaagtttcttctaagtgccaggctgagtgagaaggtctggtcagttgacactgactgtggtctctgtagcttggttctgcacttctccttggatgattatccattaggcagagatgtctgtgatttgtgcaccaccatagaatggtgtcccatacttagcattcagaattatagctatctttgtttatttgccatttagcagttattgtttcccaaagtgcagtttgggtaagcttgagggcctcccatgttcaattttgggctttggtaaaaccagcccagaccttcctttcctcagtgtaatttgattttaggggctttgctgtccttttctgcctttaggctttattcaggaccaccttgccatgctccccagcagggtgcctaacttgattttcttgggctcattgtcttcagagaccaatttttcattcaaactaataaggccattttggataagccactgaagctccaaaggttttgttacctacatccatttcagaagacatgataggtacccttataacttatacttgcataattaagaagacaacttcattaccttacatacatatgtaagtgaaattcattataatgaagactttaatattataatgaagattttaatattaacttcataatgtggtagctcagagaattgtctttgctagtatctgtaagatgggtggtgaaagctttatatttttaaaattagtgatactttgaaaacttctaaaaagttgttaaaactgagataatatgtctttcatttaaaaagtgtctttaatgtttatcctgaaagaaatgtagctcatagcctctgtctcgtttctttaattgtagtttaaggacatgggtacagatttgtgcccttaggcattggtattaatcatgttaatgtatttgattattttcctttcagctaattatatggacaattggaagtgtactggtattttgaaaggtaatgggagcccagtcaatgggagttctcagcagggaacctcaaatccttccctaggttcaactattccaagtcttcagaattcattaaatggatcttctgctggcaggtaggctgcttcatgggaaaactggaaatcatctttgttttaaatcattctggtagccatacttaaggtggattatttcatggattataagatggagtggaaatgttcacatgtgcttgtattagcatttaagaattcattttgttagctatgtatttggcttacttggtcataatatttgcaggtaggttatgaagtcattacattatattctgaagctttagtggtctattggtagaaatgtttacaggtttaagattcaactttgcttccgcaacagtgagaggaaggttatctggtttaatggtgagagttttagtccaaatgaacattagtgttttttagtgcttgtagtgtggtctttgcattaggtcaaactgaaattttaaataaaatacatttcttaaggctttctagaagagggtacattaagttatttggcttttgtgtttaaaactttaatagaaataagaggaaataataaaacacgagattgatttttagaatatttagcatatgttacattcttgtatatcataataaggaatatttgatgtcatctagagtctgtttccatgttcaaattttaaatatgtgaatttgtaagataaaattattttaatatgcctttgtgaataatttggaatagaattcaggaaacgtcaaaacacagcctaatgaattgtcctgtggttatatcctcttgttatcctatataaaagaagaaaattgtatttaaaatttcaactatttttatattgttatgttttcataaagaagttctgcttttgattttgaggtttta

SEQ ID NO: 88897 - DNA, 1100 bp, Homo sapiens
ctcctattaaggatggattgtctaaagcaatttatttgataaaaaaggagccactacagtcctagcctgagtttgtagagcagtcatgtaaggtacatatatgacaactggtatctttttattggagatattgcatattctgttgtaattactttagttttgaaaactgctctgttccacataacttaaaaaacaattcagtcattaacttctatgaactaggtaaactgatgttcaaaataacataaattaatatgacattaaaagtaactgtaaaagaccattttcaaaaaatatttcagagtttacattttaagtaaaaattgcagagcagaaatataaaccaacaattaccccttcactgaactcttacctttccacaatcttacacacccatcatctcctgaagatgctagcaccgttcctgttatattccaactcactcgccagacctgagaattatgattatcgaactgagccactatatggatttcaaactttgttggcccaccagaggaagtcagttctttcctgttaataaaaaacattttctgaggcattccaaacaaagttttaaaacatatatatatacacacacatatatatatacacacgtaaaattctaaattaatacaagtggtctcgccaccacatcactttataataatgtgcacatctgcccaaaccccacaccttggcccttgagctgggccaatgtcattttcatttaactcgccaagacctggagtgatcccagcacataaatgatactcagtgactgtttcatggaagaaagaaacaacaaaacaggatgattttattctcccacacaaggcagaagaataaaatagatgacaataattaatttaaaaaggcagggcaaggccaggtgcagttgctcacacctgtaatcgcagcactttgggaggccaaggtggacagatcacttgaggccaggagttcaagaccagcctggccaacatggcgaaaccccatccctactaaaaatacaaaataaaaaattagccaggcatggtggcgggcgcctgtagtcccagctactcaggaggctgaggcatgagaattgcttgaacctggga

SEQ ID NO: 88898 - DNA, 2825 bp, Homo sapiens
gtactgcatattttcttttgtaaatagcttctattttttgatctgtattcttattgtgccaataaccatctgtgttagatctgtgatgcattttcccttttccatttgtattatgtcctttaacagaaagcacagctgagtacaagctaactggagtaactttgctgttttgctgcttgttgcatgcacacaggaatggaaagcgagctccttttccccttccccagcgccgtttgacctctcccaagatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggaggggaataccactttagttcatttggaaaatatagacatatttcttttgctttcttaaaacagcttaaaatgatgaacttttataattttaatttgaagattgaataaatattttttataaagattgttttgagtgctgatttgtttactttttgtagatttgctttatccatgatattcagtacaactctgtcatttctttgtaatatttaaaaaatattagtaaaggagtgaattaataaagtagtaatagtaaaatgaaaggaacttgactgtacagtttgtagccaggttaagcatttggtattgtttcatttacaatttgggactaagatggaaacactttttttataagtttttaattcatagtcactaaagagataaatgtttcttatatacatttgtgtatttttatggtgttatttattccatggcttagcttccttcaaatcaaaatttggacacacactattaagagaagccattaaaattttactaaaattgtgcatgtaaattaattgtcagcattccatgtctcaagattttcttaatttagttcgctgtttaaattaattcatgtcctgtaaagttctgaccttgataacaaagctataaatatttaagtttgctaatatgcgtaagtattatcggtaagttacaagatggaagaagaataacagtagggcacagtcattctgtgaatccttttacttatcaaaatttggtagctattctaaggcttttgcagaaaaataagtgttcaatgtttgtagttcttcaaaagcatgttgcagtagccagccatactatgtgtattcccagtatcatgtacgcactaaaaaaaatgtgtgcttgctgctgctgtgagtgaaccattgcttaagataaaaaacttaactagatctgtaaatgtacagaatagcatcagatgtttctgagagattagaaaatgttttgaatttataaaattaatgtttttctttgtaacatttatatatattttttaacattttaagtttaacagattgtattcctttcaagtttctatacttgcttaagcaatcttgatttgagtaagggtcttgatttgtgctattatgttctgttagttttggcatgaatatactaaagcttttttttttttttctagcatgtgttttctcctctttggttctctttgtatttactacttttctctttttcttgtgttttttttttcctgtttttgttttgtttggtgttttgttcctgtcttcattgtttcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagcaaaacctaatgtggactttttggtcttttttttttttttttttttttaaaggaaattgcctttcactacttggaattactgtttaaagcttttgtaattattatccaagtaggttatgtaataaaatatatttaaaaatatacgaatctcttgccttataaaaacagaatgtattttatttaagataattgccaaggcttactcttctttcactatctcacaaaaaacccaaacaaaaattaggagatgtgagcaaatattacatttatttaaaaggtagaaagtcagtatgtagactactaacatttagaatggacagatgttgactttcagtctaattagtcaacattagaatattttctagaatattttaaaatgagaatgtacttgattataattgtggtaaaatga

SEQ ID NO: 88899 - DNA, 1783 bp, Homo sapiens
agctgattgaaggtgaaacctgacgcctttcagcgcctaccaacaggaaaggtctgcatctgcccacggaaggacgaaacctatcgggggggatttgttggcgggggatacttctttgcgcatagagtgactggcggtgccctggagacccaaactgaataaagtaagcattattttcaaattcgccaagaccttgaaggcggcgccaacgggagccgtcccccgggtcccacgcagcgcagagctccatttcctcctccggactcgcagggcgcgcggcttcctcgcttcaaatccaggaacgcgctgtccccaccaatcaccgggcttcttcccgccccatgtcttcccgctgtccaatcaaaagccagctcagtctcctccccttgcctggtgccgcgaacagacgtaaaccagaggcgggcgcggtacggccgttccgggctccagccggtgcgggggccacgcgcacgcgcacttgcagtgccctgggacacctcttcagtccgtggactttcccgctgcacactgccctccgaagtcggggacgcgggctcggtgaggggggacgctggtgcctcggcctgcgcctaggcgggaggcagacgcatgcacctttggcctacgtttcggctgccggaccgacgggacagtgacggttgggccgggtgggggcgcaggctgtggggcggcctcagggcgcgagcaaggggactgccgcgcttcccgcgcctctgcgcctggcgcagcctctgagctgagctccgcctggttgggattaattgcacgcctctgtgtcatcgggctttggccgggcgtgatgagacagactgttaggggatcacgtccttctttcctcccctcttgtctggggacttccacctcttgagggacaggccctctccgtgctaccctctggagtttcttgcagtgtgcttgtgaagtgaccggtgatgtttcctttatgtgccctgtgatgggcggttctgttcctcctttttgtttaaaattctgacccaggaagtaaccttgttaacttaacttaatgcccttgtcttccgtttactcacttgatttggtttctgctaggttgcgttcatttattcctaatagtttacctacattccttgcctatgatttcattatcaacagaacgtgaaatgagacgaatgttaatacactctacttttactttgctgttactttcagagtttgtttagtaaaacatgaggacctcttcaagtcagtcgtttggagaacagctgtttatatgaccatatttccatttgctcttactattttgaggtcattcgactggcgtttttactgctccaaaatcaactttttctccaaatttcagttttctaggcaaaaacggcaagccttgaacaataatataccaaatgcctacctagttttaaagtatatcttaaagtgccaagagtaaatgatgagttttggggaagtttgactcggctttgggttccacggcgtgtgcttttaaatgtgtttaattgtatacatagacctacgattaatgactatagtcagtaatcttttatgtacctaggaatgtaattagtgagtccagatgtgaaatttgaggtcactactttaaggaaatagcaagagaaattgcaaatatagccactcagttcaaataggatagaagaaaaatattgtcttcacttgagatgatggaggaggggtgggtaatgcaataatgtgagaaattaaaggaaatttcctttaggaatgtgttatgtccatgaatggtttacaa

SEQ ID NO: 88900 - DNA, 1025 bp, Homo sapiens
ctgaggtaacttggctcttgtcattctagtaactttcagctcctgaagtcaagtttctctttcttagaaactcaaccaggctgggcgtggtggctcatgcctgtaatcccagcactttgggaggccaaggcgggcagatcacctgagttcaggagttcgagaccagcctggccaacatggcaaaaccctgtttactaaaaatacaaacattagccaggcgtgatggcgcacgcctctaatcccagctactcgggaggctgagacaggagaatcgcttgaacccggaaggcagagattgcagtgacctgagattgggccactgcactccagcctggacgacagagggagactctgtctcaagaaaaacccccaaaactcaaccagcttttattttctttacttttaaaatttctgttttattaccagattgatgtttggttaaatacaccttgttttgtatcttcaactggattgtgtatagtttacacatccattacatgtagggtcttgcataatatataaagtttgcctatgcttaaactggccactttcttgtcttttctcaacctaaacatttagtgaggagcaccatcttgacctttgggctgaaggggttgtattaacactctcagctcttttagctttaagatttttgtgactgtattgttgaatacagataaactccctattgccaagccacaggtttccgtgctttgcacagaggatgatggtttgaaatacaggggccctatttgtttttaccccggtggttggttttactgtcacgcagccctatgtcatgatgacatttaaatatgtgtaatttaattcttaacaattaaaacaaattttttttgtataggtatcctgatatccaggcatcttacttagtagaagggagattttcagttccatccgggtcatctcccggaagccagagtgatgctgaaccaagagagaggttacagcttagcttccaggatgatgagtaagttcataccttcatttgcttgtactgtgttaaa

SEQ ID NO: 88901 - DNA, 2166 bp, Homo sapiens
gtatagtctttccacctatgcctttcctttcctgtactcaatgaaattttcctgtacctacccatgagtgcacctttggcttaagctagtgactttttatgtactacagccccagtaaagagatggagaaactgggaagtaaattgtagttagggttggagagttgcctcaggcatgaaaggttgggatttgagaaatatggaaggacttttaaaaaaaaatccatcctggccaaatttgagtctggctctaggtatcagtttgtcatgtaatgaatttgttgcatttagaggctttttcctgaagttccgttcccacccctctctttctgtggtgagctgctctagacccaagagcttttggagtagggtgggaggaacattgcctgtaagaaaaatactttcatccacacagaaaacagcagaggtagaaagaaagataaggacaagaactaggactagggataaaagtaaaaacgattgaaacctttattaattcagagatttggctattttggcaaatatgccaatatcctttaagtctgcagattttagaaagctgaattatgtagattggtagtttcaaggatacttattttggaagtaaaaaaaccactttttgctgcttgaaagagtagcagtatgacgttctttgattttggtagactgtatcactggacccaaaatgttggttcagtccccagaatacagtgcagtgttagcagttgtagttttctggctagactcaaatgtttctttttattgcttccattttttctttttaagaggtaaaatacataactgattaataaatattttgtagatttacccaaggtaactaacattttatcattcttctgtttcctaataaaaaagttctatctctaggaaaaagagctatgtggaaagtcaacgtttgtcaaatgctctcagcaaacagtcagctttacaaatggagacagcaggaccagaagaggagccagccggagctacagaatccttgcagggccaagatctcttcaacagggcttcaccactggaacaagcacaaggtactgaactatttgaaattatttcttaatgcatatgttttaatttcctttttcatttccttatctttggattttttttttttttttttgaggcagggtcgcactcctgtcgcccaggctggagtgcagtggcgtgatcacagctcactgcagcctcaacttcctgggctgctcaacctatcttcccatctcagcctccttagtagctgggtctacaggcacacaccaccatgctaggctaactttttgtgtttttaatagagacagggtttcgccatgttgcccaggctgggctcgaacgcctggactcaaatgatctgctgtgccttggcctgccagaatgctgggattatgggcctaagccactgtgcctggcctttttgtttttttttttttttttgcttaattttgagatgggttctagctgtgttgcccaggctggtcatgaactcctgggctcaagcaattcaccctcctcagcttctcgagtagctgggactggatgcatgcatcgtcactcctggcttcgatgtattcatcttgtactatcataccatgaactgaaaatgctttggtttgcattgtacctattaatatcatatttacagtacttttataggaaaggtctcctcttaaccttgttgactcatttaagctgaaattctctttgctttggaaaccatgctgtcggatggccacagcatactttatattcaagacaagcctatttttagtgcatcttccacttttctcccactaattaatttatattcttatcgagagtcaattttgtttctaagcctattttttttataaaactgatgaattataagttctaaaagaaattactgtttctaagaaaactaggttgaatgcattggaaatactcaaggataagtcatttgataaattgccctcgggccaggcatggtggcttacgcctgtaatctcaacactttgggaggctgaggtgggcagatcacctgaggtcagaagttcaagactagcctggccaacatggcgaaaccctgtctctcctaaaaatacaaaaattagccagacatcatggtggctacctgtaatcccagctacccgggaggctgaggcaggagaat

SEQ ID NO: 88902 - DNA, 1044 bp, Homo sapiens
taagccttcgtctcaaaaagaaaaattgctctcaaattagatgtggagaagaaactacaaaaatatggggggtcaggcactgtggcttatgcctgtaattcctgctgaggtgggtgaatggcttgagcccaggagttcaatatcagcctgggcaacaaggtgaaactctgtctgtacaaaaaatacaaaaattagcagggtatagtgctgtgcgcctttagtcccagctacttgggaggctgaggtgggattgcttaagcccaggcggtcaaggtgatcatgccattgcactccagcctgggagacagacccagaccctatctcaaaaataaataaataaataaaaatatagggaaagttgtttaaaaaaatcataggcttctgctgtctgattcctcttaagtactccacattcactttcttttatcaaagaaatcaaagctggaaattgaaaagtacattctatgcacttatatagtgtggtattctgtaactccaaactagttcagtactcaaaaggacttgcctgattatatgttgtaagattgatgaatgagtacacattatatgttagaaaaattttaagggaggtttgtatttctcttgatgaaaaatgttatatatatgaaagaaaagagtggtattatcactcaaataagcaataaaagaaaaaaatagatgaattggatttcagaattaaaaacttttatgcttcaaaagacactatcaagaaaggaaaaagacggggccgggcacggtggctcacaccggtaatctcagcactttgggtggccaaggcgggcggatcacctgagtctgggagttcaagaccagcctgaccaacatggagaaaccccgtctctactaaaaatacaaaattagccgggcatggtggcacatgcctttaatcccagctacgtgggaggctgaggcaggagaatcgcttgaacctggtaggtggaggttgcggtgagccgagatcgcgccattgcactccagcctgggtaataagagcgaaactccatctcaaaaagaaaaaaaaaa

SEQ ID NO: 88903 - DNA, 1705 bp, Homo sapiens
ataatataagggaccttaaaactggaaagcaacaaaagtatagaaacatgagatgcttgattaaaaagaggaagaaatgagaataggggaaaataaacgtgttagaaaacagactgaagggagctgctactgcgtgtaggtctcatctcatctgtggagctatgccactttatcagaatggagacattttccagggaccaagcatggcagagtacacagtgttctcagtagccaacatgaccaaaaagacagggatgttttacatattgtgctttcccatacagattttttcccaatttttatattatgaaaactttcaaagctcagagcttatattgcacagctgttaacatttgccatattttaagtgatcatctattttaaataacagtagattatagtagtccttgatgcccctggtgcttagatatttgtgagaatagctcagcactgtcctctctaaatgtaaaattggattaagattccatgtttctgtcttaaaaatcagtgcgcattttccaatataattcctatgctggtgttatttacatatatatgtaatatatatgaaatataatcacacttagagggaaatgttacattttcattctgggccttgagtatcattaaatggctgcgtgccctttagggttacatgttccctggttgaggagcagagaaattgatttttccaatgtaatggtgcaaacagttccttagatacaggctgcctggtctagctttgctgttatcttcactttctcgtaagccttgtgttgctcaagttcagttatgtatttgtgtacttactatattacgagcctctctgagcatgtgcacagtttgagggaagccttaagttttaaggatgttctattgggcaggtcaggtgagggaggtggcgtgggggaaagggaagttattaatacatgtacaattgctagccctttattgcctaagctgtgatttacagatactgaacacagtggaggttgagaacatatttggtcctttttgtagccttgtactatgctcttcagagccctgaatgtgcttctcttacttgccattttgtttcttatagattgttgtgcttgatgctggaaaacattttgaagacaagactctaaagagtgacctaagccacactagcttattagaaaatgagaaacttatcttaccgacaagcttggaagattcttctggtactgcagagtaacctgtgtttccctggtcttcaccttgccactccactttattcttctttgttgcagtagttatgatgccaactttttgggttttttgtccttaccttttcttcctacctgccagcactcaaatggccacttctattaagtgatggaattgaagaatttatttctatatatctatcctgatatgattatactcatcctcagtttaacatagttagggtacaaagtagtcacctggaggtgcccttcagtatatagcattgtgtttagaaattaggggaaccatgaaattttttttttttttttgagatggaatctcgctttgtcacctgggctggagtgcagtggtgtgatctcggctcaccacaacctccacctcctgggttcaagtgattcacctgcctcaacctcctgagtagctgggattacaggtgcccaccaccatgtctggctaatttttggatttttagtagagacagggtttcaccatg

SEQ ID NO: 88904 - DNA, 2863 bp, Homo sapiens
gaagaccatgactgactgaggggtcatgttttattttgtgcttgctgagctgggtgttacagtgttgaaaactcctacagtggcctttctccttccctccctcctccctccttcctccctttctttcttttacttctcctgtgataggctcatctatacttttttgaaagaggtaaccatttgccacaccattttctggaaagtctgctttcttctcattgatttgtgatgccacatttattgtatcctgacttttgataacatgccagggtctgtttctgtcctgtcttctcaaagaggttaaatatttatcttgtattaaaatgttcataatggtttataattgactgaagttacaatagttttctcatgtcaaacaaaaaagacaccaaaatcttagtccattgactcatttatgtcttatcggcctttttaattacaaattattgcttagtcactactttaaagcatgtcctgttttttctcgattttatcaatagatgatgatattgatgatgaaatgttttatgatgatcatttggaggcttattttgaacaactggcaattccaggaatgatatatgaagacctagaaggaccagaacctccagaaaaaggttttaagttacctacaaatggtcttagacaggtgtgttccagtctttatgatttttcagaaatttgacattagaaaattactattggtctccttggatgttcacatgaaatgtaagcctttggactttggacttttctttggactctgtgtttccgaggtatgaattgataagaaatgcctaccctttcttccttcttggtacctttccctcacctacagaaaattaaaggagtaacacaatggacatctacaccctcttcctccagttaaccaattgctaaagtttgccacctttgcattttctttctctctccataaatactttcttctctgaatcatttgaaagtaagtcacagagagtatgacatttcactcgaatacttcagcatttatcttttgtagataaggacattttcctgcataaccacaattctgttacctaactttgatataataatttaaattactgtacagtccatgttcacatttacccaataatccccagaatatcctttattcttactattttttatctacaatttaatcaaagattaaccttgcctttggttgtcctgtctctttattctcttttaatttggagtagttctttcatgacgtgatctattttgcaaaatctaggccctttgttttgtagagtgaactgtaatctagtcaggagggaaaaataaccataatctgttttctctcctgactagattagattaaacgttttggcaagaatacagattaaacagtttctcatgaatggattcatagtaaaccaagcagtgttgtgtacttctcattgccctacaccgggagacgtttatctctcccacaattggtgatactgtttttgataattttggctaaggtgatgtcagctggatgtctccttgtgaaggtagcttttccccttcgttattaataagtcatctgtgggatgagatatcagccctttgatcatcttattccccggcaactcttcactagctggtttcagtgtccttgctgactcttggaaatattgattactctcgtggtgacaatggcgatttttctaattccttctacacttattttctggcatccttcagtaaagccacattttctccctcaaaatatttcattttaatttaaaagattaatacagctaagatattctttcaacaggcaaatgaaaacggtagcttaaactgcaagtttcaatcagaaaataacagctctctgatttccctcgactcacactcttctgaaacaactcacaaagagtctgaggaaagccaagttatttgtctacctgggactagtaagtatagaaatatgattcttttgttcttaagttctagttttgactttactttttttaaaaaaaaaatatttctctggtatgatttagcatatattaactcttctagtccctcaggtctttagacagtctaaaacttttcaaaagagcttttaataatagctgagtaaattagtgttactagaaataccgtagtatatatttcttggattgaatattacaaataattgtattctatccagacattgataattaaatatgaattctttgggtatggtagcagtttatcatgtttattattgcctcttactgttgcttattttctctctacgaaaatggctaaatttgtcataggagtgctaagtattagggttacataaaataatttgactggcaagaatcagttattatgttagattactcagatttgatgtggctcctttaacatttttctttattttttcaggtaattctataggtactggagatagtagaaggtacacagatggtatgttaccattttcctctggtacttggggaactgagaaagaaatagaaaatttgaagggtattgttccagatcttaacagtgtaagttatgcatttttcttagatttcctataaaaaaaggaataaggggtcttttgtgtttatatgatatcagtttttttcaaagaaacagtaactgttgacttctgaaaaatacagaaaaagtactcactactgataatttttcgatatgtttataagtatcatacaattatatacattttcttgcatttaaatatttattgacttgcatttagattagtcatttggaaagttctttagcccagtgtccagtcattacatgaaaaagcaaacggatcttttaccttgctcaaacatgtttgtttttcattgtttcagttttttctgtttgttaatagtacccc

SEQ ID NO: 88905 - DNA, 1037 bp, Homo sapiens
catttgtagtataaactgccttactcctattaaaagatattaatatctagggctgtttatccatattaattttatgaggctagtcacactaataggcttaccatgtttgtggagacttttattggtaatgataaaagttgggctgacaacatttctatcatcctgtaatgtaatgcacacacagagctcacttttggtatgtaaatctcttgatgtgtttcctatgaccacatcacaaagtctggttttggtaagttgcttatcattggttcatatattcacatatagtctagaatacagcgaatactgtgtgttctcttctttcatataataaacattttatatcaactatataatttttcccataaattttaaaataagttataaaaaacaagacttactgttgctctgttaaaaaatctgattttttgttttaaaggaatgtgcaagtaaagatgttctggtgaagaccctcagggctattgatgtgaaacttaactctgataattttcatgatgcaaatgccaatagaggtggttttgatctgactgaccctgtaaaacagggggcagagtgtcctcaccaaaataagacagttttgcacatggatggatgtttagacactgagactcctacggtgtccattcaagaaaatgtggatgtagcctctttgaagcccattagtgacagtggaattaatttcactgatgccatttggtcaccaacttgtgaaaggcgaacatgtgaatgtcacgagtccatcgaaaagaataaagacagtaagtggactttttaaaaaatagagtgaaagaaatagatgttcatacattttgaataggacatattttcatgtgaaatgtgccagtctttcctgttgaaatattttagtgttttatagtttaaacaaaattttaaatctacttgtacagggaggattgctcagaaatggtatcttttctcacagatctagtgaaaatgtacctttctagctaactcttagcattctttctttattcctcattctccattatagactt

SEQ ID NO: 88906 - DNA, 1985 bp, Homo sapiens
ctgatgctcattcctaggttctgtgctgtaggttaagaatgtgttttttcttaggctgggcattttggcttatgcctgtaatcctagccgtttgggaagccaaggtgagtgaattgcttgagcccaggagtttgagaccaggatgggcaacatggcaaaaccccatctctagcaaaaaatacaaaaattagctgagggtggtggcacacgcttgtaggcccagcttttggggaagctgaggcaggagaatcgcttgagcccaggaggtagaggttgcagtgagccaagattgtaccactgcaccccagcctgtgcaacagagccagaccttgtctcaaaaaaaaaaaaagtgttttgtttgttttttttaataagaaatggtcacttaacaaggtaaagaactagcactgttctgacaggtaggaagcctcagtgggctttggtgctctgcttttcctgaacagaaatatcctgtgtctgcttttcttttgtcttaggttgtgaatgtgggacacagtctagggtcgcaaaggagcagtgtggatctgattggtccctcatggacacatgatagtggggagcctccgtcatgtttgggccatgagtggactgttccctctggctcaccattcacttttctcctttctgctccaaccctgcagtgccaggcagaggcctagagtgctacagccaggcagtctagcatctggctggcatacatttcaccaacacatttaaagttcttggcgattctgatgcctcaagcagggtcttgggcctcctagtttgccacaaatccaccactcccagttgtgtttctggccctggccctctttgcccatttgccccatccctctgaggcattttagtgatggcctttggcctgaggttgagtgtgcttaggctggcgttcctttcccagggagggctgaggtgctcggcagcagccttgagggcagacattaggggactcccagtctttgtccggaccggggtttcctgggatggggggcaagcggtcctggggcacgcttgtagccatcttcatgacaagcttatagagggcttatcagtctgatgactcctgatgaaattccaccagcattcatggatgagtgcctcaatgcaagagtgccaaactctccaaagcaaacattaattttagagagaaaaagctttcattgtaaagcccctgagtaaattggggtacgttagtgacaaaataactacagcaaggtgttctttagcaaaagtttgacaaccacagacttaagcatttaatacagatgcatgagtcatgagtgcaagcttttacatacttgttacaactttatttccttagtatttcattttcctaacttgtatctgtgtgctagtgtttgtttaggcattagtgtaatgtatttatataaacattcttttttaagctgaagcatttgatttgattgcacaagatgaagaagaatttaataaagagcatcaatttatacaggtttgtaattatttgttttatccaaaatttaaaatttttcctgtattagtgtaagtgtaggcacagtgttcatttctttctgaatatatggttagtatagaattatttcatatttttcttatggctagacaacttctgctttttccctcatactctaaataaaatactctaaattattaattgaagatcattgacatactgaaatatatctttaattcacttagaattgctttaatggcattaatggatatttccatagtttatttttattttttgagacaggacttgctgtgtcacccaggctggagtgcagtggtgatcatagttcactgcagcctcaagcttttgggctcaagtgatcctcctgtctcagcctcctgtgtagctgggattgcaggcatgtgctaccatgcctagctatttttttattttttgtagtgatggaggcttgttacgttgcctagacttgtctggaactcctgggttcaagcaa

SEQ ID NO: 88907 - DNA, 1098 bp, Homo sapiens
aagcaatagatgaagataacattcttcttattatttttcagatggggtctcgccatgttgctcaggctggtcttgaactcctgggctcacatgagtctcccatcttggcctcccaggtagctgggattacaggaaagcgctgtcatgagcaactcatgatcgtgtgtattataactcaagtgttcaaaaatactcattttccttttctggacttcattagctgtggtagctgatgatgcttcagtttgtccaattttttttttgtctagtttttcaaaattactttttaaattttcttggtaagacttttttagtttttgtatattagaacaacagaaaagtgacttgctgggggaaagaaacgaaacaataactttctccctaggaagaaaacatagatgctcataatacttcggttgcactgggcgatacgtcctggggagctacaattaattacagtctgttgaggaaatcacgtagcacatcagatttggataaagatgatgccagttatttacgtctgtctttaggagagttctttgctcaaagatctgaagctcttggttgccttggtggtggtaacaatgtgaaaagagtaagtatggaatctgttggaagtgctcacagtcaccagattttagattttgagtattatgatggcacagtgactttaaaatggagatagaataggatgggacagaagagtggtaaaaaacttaggtttcatcatcagtcagacctttactgcagttctagctctgtcttttagctaattctgggacattgagcaatttaactcctctgtgcctgaatttcccgtttcttaacagcacagttttatagggctttgtaagatttaaatgtgacggttcatgtaaagcatttagcactaaaccaacatgtaataagtatttaatagttgttcattgctgttgttattgttggttggtgtgaagaattctaaaattgctttttaaaaactattgtctaaagagatgttttgaaatatagaagtgttttgatttaattaaatgtaatgcatgtacaattaaaaagacaagttattcagatagtgataagtcctgtaaagcatgagtg

SEQ ID NO: 88908 - DNA, 1157 bp, Homo sapiens
tgctcgaacccaggaggtggagagttgcagtgagccgagatcacgccactgcactccagcctgggcaacagagcgagactccatctcaaaaaaaaaaaaaaaagtgatttttttcttgtgagaagaaataagacttttccctccattagtgacctggcccttgtctgtgtgcaggcctggaggtaggaaccagggtggcatattggaggaatggaaagcaggcaggcagagctgctctgaggagcagggtaggcaggtatgaagggagaatggcagatgattccaggggccaaatcatgagggctcctggtaggaggggggttttatctcagatgaactgggaggaagtgcttagaggcacagggcaactttgttgtggtgccagcccatctccaggtgcagcagcctgccgccatatgtcaggtgcccaggtagtgaaagtcagcaaaagacagaagagggaaagaagcaggcaaacacttaggaaatgggagagatgtgatgaaggctggggacaaggatgacctagtagaagcagagaaaagggcaagaattcaagatttattctatagagtcaaagaatttgttgataaattccacagagggtattagggttattggagggattgtttagcaaaactggatttcattaagagtatgattttgaaataacagatgtagtgttagaagtcacagctgattcatagaagttgaagagtaactgaattccttattaatggaattatagtaaggaaagataaggtgggcaaagcactggatcatgaaaaaaatggatctattatttggaatttttgttgtggtataagtgatgacgttttatttgcattcaagttactgaatcaagggaagaaattaagatattaatcacaattaataaattaatcacttgggaaagtgaagaccaataaaaaattgagtgtatttaatgagttcacattttagttctgtcatgtgactgctgtataagaaagacaagtggaaactgcctaccctttagcaagctccttgaatgcagaccttccagaaactttcatgcaaattggtaggagcgtccctaatcttaatacacatttttcaaggatgtgtttattctataaaataaagtacctttatattgtaatttccaggaagcagga

SEQ ID NO: 88909 - DNA, 1069 bp, Homo sapiens
agataaggtttccccatgttggccaggctggtctcaaactcctgacctcaagtgatccgcccacctcagactcccaaagtgctgggatcacaggcatgagccaccgcacccgaccaagaagtactcagttttaaattcaacttattgtatgtttgtgaaatgtttcaagctgaaaaatattgaatgagtttatgtgtgtatttgcaagggaaagattaaaatccacaatcctccttcaaagtttggactctgcagcattgagccaaattaactatgttgttgttctctgtccaagtgactatacgtttaaaccattatagtgaaggcaactgacatttggggtacaaagacatcttccttggtaaattagtcattttgcctggtccttattccacagactgtgtttgtcaaatagtgtatacttataagttgaatattatatatttcctgcaggagatttaaatgaacagtcccaggcacagctaagtgaaggatcaattacacttcaggttgaagcagtagagagtacttcacaagtggatgaaaatgatgtgacgttaacggctgataaaggcaaaacagaggtagcttcagcctttcgtaaggaaatctaagattatcttgttgtagttcttatctaggatcaagacgagatcacctgtgaaaaatttatgccgtttaacatcttttctttcctggcttcagatttcttgcaagtgtcctttaaatttttctttttaagtttttgtggcgatataatatacacacagatgagtttataaaacagatttgtagtcaatgaatgaattatcacaagtcatacacttgtgtatacctcagatcaagaaagagaacattgccaacagctcagaaacaagtttttttgccgcctccagttacctgacctttaaccctgtattaattttatctgattctaaacttcacttaaaagaaaccatgtggcatgtattccttttctttggcttttttcacctcaccttacatttgttagatgagtataatataaacttatttttattactgtatggtattctgttatatgaatatt

SEQ ID NO: 88910 - DNA, 1055 bp, Homo sapiens
aaaaaataatgctgaagtttctgaggtctgtggtaagaatgatcttttttatgtgtaattacaaagaaggacagagaaattcatgctttgcactccaaacttcaaacgttccagccacagtgagtgataagtgcttagttaagatggaaaaggcactacatttgtgggtggggaagataggaacagaaacatgctctgatttatggcagtcggatttggtactatctgaggtttcaggtatccacttggaggttttgaaacgcatctcccaatgataatgggggactaatgaatgttcatgaaactggggtaaatttatctgatgtttaattttctcacttctaggacactttcttcatgagcaacaaaccccaaagatacaaagacaagctaccagatagtggtgattctatgcttaggatcagcaccattgcttcagccattgcagaggcatcagttaatactgatccttcccaacttgctgcaatgatcaaggcactttcaaataaaaccagagacaagacttttcaggaagatgagaaacaaaaggactattctcatgtgcgtcatttcttacctaatgatttagaaaaaagtaatggatccaatgcacttgatatggagaaataccttaaaaaaacagaagttagtagatatgaaagtgcattggaaaacttttcaagggctagtatgtctgatacttgggatttatctttgcccaaagaacaaactactcaagacattcatccggtggacttaagtgctactagtgtaagtgtgagggcaccagaagaaaacacagcagctattgtttatgttgaaaatggagagagtgagaatcaagagtcatttagaaccataaactcctcaaattcagttacaaatagagagaataacagtgcagtagttgatgtgaagacatgttccattgacaacaaattacaagatgttggtaacgatgaaaaagctacctcaatttccactccatctgatagttattcatcagtgaggaaccccagaataacatccctttgtctgttaaaagactgtgaaga

SEQ ID NO: 88911 - DNA, 1091 bp, Homo sapiens
tcagagtgatatcaccagcgagttgagtaccacaattattcaaggcagtccagccgcattggaggaacgggctatggaaaaattgagagaaaaagttccatttcagaatagaggaaaaggaacattatcatctattatccagaataactctgatacaagaaaagcaactgaaactacttctctgagtagcaagcctgaatatgtaaaacctgactttagatggagtaaagatccttcctccaaaagtggaaatctgttggaaaccagtgaggtaggttggacatcaaaccctgaggaattggacccgatcaggctggctctcctgggcaagtcaggtctgagctgtcaggtggggtcagccacatcacaccctgtgtcctgccaggagcctatagatgaagatcaaagaataagtcctaaagataagtcaactgctggccgtgagttcagtggccaggtttctcatcagaccacctctgaaaaccagtgtactcctattcccagcagcacagttcacagctctgtggctgacatgcagaacatgcctgctgctgtgcacgcactcttgacacaaccctctctcagcgctgctccttttgctcagcggtatttgggaacactcccttcaactggaagcaccaccttgcctcagtgccatgctggcaatgccacagtctgtggcttctcaggaggccttccctatccagctgttgcaggagagcctgtgcagaactctgtggctgtgggaatttgtctaggatcaaatatcggctctggatggatgggtacctcttccctctgtaacccatattctaataccttaaatcagaacctgctaagcacaacaaaaccttttcctgtgccgtctgttggtacaaactgtggaattgaaccatgggattcaggagtgacatcaggattgggtaagatgctttttctctattattattacttgctattattttctcaaatgacaccacaaagctagtttgtttcaaggagttactggttagcattaattccttgtaagttttgtgcttcttcctaaactgagaacaccgtgtatttctgtgcaagcgtccctaaagttg

SEQ ID NO: 88912 - DNA, 1741 bp, Homo sapiens
ccctttgttacggactctgttatctacatttaaagtgaatttacttcaaagtttatttcatgtttctagttcttgggttactaacgcttctactagttacttttgctgagtcttcctgattttcttctagtggcttctgattttttgatatttaaaaatttttaatgtgagctcacattcattgaggctgctttttgctttaggaatccaatgatgtgtcctagtctttggaagcgtcccttgagagtacttttgcagaaatgtttgaggtgttaaaagcctttgtgatttttttcagcttggggctcccatgtcccatgtggcctaggcgtaggctttcatgttcttgcaaataatcttctatgccacccctctctggacaggttccttgttgactccatagacatgtggacagttttttcagttcattcctttgagtttctgggctttatatgcagatttcaaattccattcgagcctcaccctgctcacaacaagcttgaagtcacatcttctgttctctggaacatattaaagctctaccaccttgagcgcaagtctggaacccagacctttctgggccaccatggaaatcagctcctacttactggtctgcctttgatctctacttattttgtgtttggctagagcaaaacaaaatgtgagcacgtctgtgtgtgtgtgtgtgtgtgtgtgtgtgtgtgtgtgcctgtataatacagtctgtcttctgtatctgtggattctgcattcttgtgttttactaaccttggatcagaaatattcagaataataaaaggggtagttgcatctgtattgaacatgtacagacatttttttcttgtcattattctctaacaataaagtataatggctatttacatagcatttacattatattaggtacattatgttaggtgtttgaagtatacaggaggatgtgcctaggctatatgcaaatactatgacatttcctatcggggacatccacgagttttgatatccggtgggggttcctgtactgtcaaacatttccacatgtgggtgtgtgaggggtctgagtttggttggtttcccgcatttagggaagtgagtctgtcatgatcataggcacttgttttaaacttttgatatgtctgttttgataccattttaacatttgcagattaaatctgaaaatgccaagatattcatgatctttttaaaaggaattgagaagttgttattctaataatagaacccattgaaaaggggtctataattttataaaattatcagttcatcttaagatacagtcttttcaaagtaacagcagctgaattctgtagtatatttgggtacatagactacctcaaaagaagaatttaacatttatttttgtagaaaataagcaattgttaaatagcctgggaaaatgtaggtaagttttacttactgctgactcataatttgtggctagaaatggcagtgatatgaacatacatgttgtgctattaatatattgcttttcataaatcattccctttttttgataattaggtagaaacagaaaagaaagacgttcttgattttggtgacttgacttatggaggctggaaagccctcccactaaaattgataaaccgaacgcatgccactgtgccaattagactgattattaatgctgtaagtatgaacatacagtaagaaaccatttacagaatgcactgatcttatgaaagtacatttttttaaggatttt

SEQ ID NO: 88913 - DNA, 1651 bp, Homo sapiens
ctcttttctttcattaagatagtaatattaataccagtttacattaagacaaatttttcttttaattttataggatccagaatttctgatgatttgggttcttttccatagtccaaagaaacagatcagctcttcaggtatcatgtttacactgtgtgggaattgctttaatctgtagctagataaactacaaatttgagatgtatttcctttgtcaataaatgtcagtacttcgaaatctgtcaactattttatgtttttttgaaattgaggcagatggcatgctgttttgggtcaatcctgtgtaagtgtgggtaactcctgcagatagcactgaaaaccttttagaatattttctgttaattgatcttatcacatttaccagttggatgttttctttcttttatcacctttctcttcactcatttctattcttttaactctttaaaaaatctgcttgcctaaattttcttattgcccctaagggcactgtgtgggactgctgatggcatttagaattaaataactctctggtctccaagctaaaagaatgaacttttttttagatattctggactcagcagaagaattctcggcaaaagttgatatcgaagttgacagcccaaaccctacgcccgttcttagaagtgtgagtctccgagcaagagcaggaatagctaggatccatgctcccagggacttgcaggtagcctcagtcctcctttctgccgttactgctttcattcatgctgatttcactttgtgacagttcgttgaaatgtctgtcttgccccatcctccagacgatgcatttcttggccaaagtggcttcctcaagaaagcagcacttacctttgaaaaatgctgggaacattgaagtttatttggatatcaaggtatgcacttccatgagagtgccataagatagtctttcctcagactgtgagagctccttgctttctgcaggctgttgtgctcttcctggcccaacagagtgccctgaacctcagatgaaagaatcgctgagagtttttaaaaactgggtgttatatagcataaaatatatgctgtggtgctttttaagtttaaagttcagtgtcttgaatatgagaaccaagttcttagattagttcctgaaaaacatgcatgtcaccctttggttagagttggtgaagaatgatccgcacacgttgacatcatttctgagacctgagggtgaatgagagggggttagtgatccaaaattgtgggtgaggtggaagataaggtttgttgtagaagagaaagaaatatcctttccaagagaataggacaagttgagaccgtgacagacaagaaggggacaaacaacctgtcctggtaaatgagaaacgcacgtaaggcaggagccactgagcgaaaactgcgtttttgtaagtcggcattcaattatgattatgtaactatatttaggtcccagaacaaggaagtcacttttcagtggatccaaagaatctactccttaaacctggagaagaacatgaggttattgtttcatttactccaaaggatcctgaagcctgcgaggaaaggtaatataaaaatgttataatggaccgggcacagtggctcatgcctgtaatcccagcactttgggaggccgaggtgggtg

SEQ ID NO: 88914 - DNA, 1052 bp, Homo sapiens
gtccgtatatttcttacctaatacatggtgtgactctgtttaatctcctttcatttaggttcagattgtcttctctttttttgactaaaaatcttcttttaaaccagctgaatcgaaatgaataaattactattttcaagtatattctgacaaaagtaaataataaaagatcaatttgatgtttctcactttttctcctgaaactattagttgaccttgtcagctattaagatatctttctccatttcttctccaagcccatgacttcttggcacccaaatcataagtgaatatcaacttagagtcagagccccactgtcgtgagtactgagcttgcttgcgtaaccctagcttaaagtacactctcctctgagacacacatggcttatccccctgcctgggttatagaacactttatcgtgtgctcagtctgttcttgtgaccttacagaagaggagagtcaggcctgcaccagtgtgaatgcctctgcctggaatgctagccctcaacctccctgggctggcgccttctgggagactttcctccactcctcccaaatgtctcataaatagcattcccaaagcacgatggcttctcacacccccctgtgcagatgccattgtgatcatctctcttcttgtctgtattctctgcagcacaagctctaagggtgggaatatcattgtatccccagcacccagttcagtcttttggacaatggaaacatataggaaatagttgcgaaaagaattgaatacaggaccttcaacttagaattctttctttcttaggatcttgaaaatatttgtgcagccatttggacctcagtatgaggtagtgttaaaaggcgaagtcatttcttcaggaagtaaacctctgtcacctggaccttgcttagatattccatcgattttgtccaacaaacaatttctggcttggggaggagtccctctaggtagaacacagtaagtgtcaaagactgacaaatcgtccactatttatacatattttggagcagactacaaattaatgtttgcaggaaaattttgtca

SEQ ID NO: 88915 - DNA, 1728 bp, Homo sapiens
tttgagtacatttaactgatgatatgactctatggaaacctagcctctcccatcccacctgataactaactctatacttgaaaatgataaccacagtgctttacaaattattaaataaatacatgagaatgaaaactttacaaaataatgtttctttcacgtaattcttccccagtcattgtacctgtggaaggcttttcctggagatgtcaatagccaaagttgtctgcgtttctcttaacacaaggtggatgagacgtagacctcagctgctgatttattagctgctgatcttccccaaatttgagtaaaacagagatttactcatgtattctctgttctccaatgaagacagcattcacatagtttccacaattgaagtgtttttatcagtcaggtgctattttatgtccattcttttgcattgtagcttctttaaaagtagagttaattcaatatactgtgtaaaagactactttgtgcaaatgagcctcttagcctaggaccccttgtttccctgaaagctcgcttggttgagccaggtattccaggtaggtgtgatattgacttaatgactcgatgaatttcttcacctggattttcattgattgatgttttatatgacagataatacctatacacatagtattaataataaggtcagctgcagagctataactggagagagattaaaccaaaaagcctctataaggtgagtcttgagcctacaatttcagaaacgtagagcctaggactgtggggagacaattccaggctactgaaatggcttgtatagttagtccatctctagacattgtggttggttttaattggctttattcttataatggtagcaatatccatggagaaaaaccatatttaaaatgtctaattgtttttaggcttcagaaactagctttaagaaataattctgcatctacaactcaacatttacgactgcttattagaggacaagatcaggactgctttcaggttcgtagagtacgtggattcttgttatgtcttctgtctgggtctggaacacttgcatatgcagacctttttgtgttatttagcttttaagaatctgtgttaatggtatgttttatttgtgctactgctttgttttatgcatttaactgtttttaaattgtagcttcagaacacttttggttcagaacagcgattgaccagtaactgtgagatcagaattcacccaaaggaagacattttcatctctgtattatttgcacctactcgattatcttgcatgttggctagactagaaatcaaacaacttggaaatcgatcacaaccaggcattaagttcacagtaagatcattttattgcctttcccttcccctggagtttatgccattttataactattggtttaatgttgtaaattatacagtctgccttttataagtgaaactatgtaattatctagacttacaaacaagttagggagtaatttatatgctttgtagaattggcaagttataatagcagccagcgtagtattcctataagtattagtctttctaatgcttttaagtttcattttaatttggagattttaaaatgtacccagctttttaggaacacatctttgggtaaatccatgtggagctgtttaagatattaactttcccattaaattttattttctcaattatcagcaaaaatactgtctctgtctgttcagtcggctataactaaatacc

SEQ ID NO: 88916 - DNA, 1051 bp, Homo sapiens
cccttgcacttcccaggtaaggcgacgccccaccctgcttcggctcaccctccatgggctgcatccactctctaaccagtcccagtgagatgagctgggtacctcagttggaaatgcagaaatcacccgccttcagtattgatctcgctaggagctgcagacaggatctgttcctatttggccaccttgccagccaccagttcatctttttagtgcatttcaaagtaaattaaaaatatgtgaatattttactctataaacttcttaatcaagcatatctgtactaatctttatattattcctgtgtcatcaaagcttggcttttgaaatagttaattcttagcctatcagaagccagatacttttgcagctctttggtttgttttttccttaagacaaagtcttgaatatactgctggactggaaatggggaactactacccaaagtacacaaacatttaaatttttaattgtattaaatctttctgaattttcttctcactgtaattcagtgtttcgctttctgcttaacattaaaataattttggatatgtatatcttttttagatacctttgtctggatatggaggaacaagcaatcttattttggaaggcgttaaaaaattatctgacagttacatggtaacagtgaatggcttagtacctggcaaagaaagtaaaattgttttttctgtccgcaacactggctcccgagcagcttttgttaaagcagtaggttttaaggattctcagaaaaaagttttgctggatcctaaagtattgaggatttttccagataaatttgtactcaaggaaagaacacaagaagtaagtacaaaagtttctgtgctaaaaacatcaactcattttaaaattgttaataattatgtattttaaagccaaaagctaaaataatacttgaaaataatgtaggaatagaagtacttatgtgatcttggaaatgccatgcgtatgcacttgtgtctgtgtcgaatttttaggctcgtaagattgttgaatcagattgaaattacttaaaaatatttaatat

SEQ ID NO: 88917 - DNA, 1062 bp, Homo sapiens
attatcacaaataatgaaaatgtaggacctgaaaagaatctaattttactcttcttttagggaattcttgtttgatgttaatatttaactgaaactgataattttactaccatgtgtaatttttcaaagaacttccaaaacaggtttttcttttaggtgtaaggtctgtgtactaatatatcagtattagtgggatttgccaaatgcattagtgaaaatctaattaaagttattttatatataacgtcacttttaaataataaaaaaaaatctctcctggcagggccctgttacataaaccagagatgataaaacagatacttccagaacatagtgtgcttcaaaacattaattttgttgaagcatttcaagatgagctattagtaactgaaggtaagaattccggcgtgtcttgatgtattaaatcttttgggtcatttatagtattatctatgtccaatgatgtgatataagaaggaagtgttagtttagatgcagtgtcaggcagagtttgagccacagccctgctgtatgagtttgaacaaattacatcattgaatgtcagtttccttatcttgtaaatggaaagaagagcgacatctagctcatctagcttttcatccatacagagttgttataagtattcgatgaaagagctttgctgctgtataaatgttacatgttactttctgcacttattctctaggcacccttgtaaacaggaagaggaaaatggtcattattaaatcaaattaattgctacttagatttgattgcaaacttgcactcattttgaggttactgtgctatcgtgcctattgtaagatttatggaagatgtagtggtggcaaaaaaacttcaaaatagatagtaataaggtgacactaacctagatggttagccctgtttacactaaacatttcaaatatttaacaatatttattattcatacaaaatataaatatattgagacatacagactgtgttaaaatgtatatacagattttcaccatagtgttgtttataatagcaagaagctagaagtaaccttaatgcccaaga

SEQ ID NO: 88918 - DNA, 1109 bp, Homo sapiens
gcctgtcaagattgcccatctaaggtggggttgagctaggactcaggccaggtctttgggacaccagaatttcacctcaaggaatactatattccttgtgattataagtttattgcccagaggaatggaggaaacagtttcactttttcatgttggttggtaccatagatcacctggagtataatgcagttgaagcttttatgtgatgaatttcagtaacatttgcttgagcatgttactattccaaggatttgtaacaatcttgcttttacaaaatgtgtaatttgtggcatgtatttttgtagttgatttaaactttttcagtcaggagtcttgcttaagttataaatttaaatttatagttactgtgttcttttaaaatttccatgtcaaaatatatgactcaaagactatctaatttaacatttcttgtttatacaaatttgggtgtcctaatctagagatgtttatcttgaacactctttcattaatctataaatatttaattaaatgaatagttctagtttctagatttactttaaattgaatgtctatgagactgccacttaaaaatcatggacccttaatttctgtgcttcagatttttcctctttgcagtagaggtaatagtacctatctcaaagaattgttttgaaaattaactaaattaatatatataaagggattagaacaatgtccacattaagcttcatataaatgtttgttgccgaatatatctacaaaggcattcttattttaatgctcacaacccctgatacagatcgttactctatattatagttggggaaactaagttcagggaggttaagtaacttgccaaaagtcacaaagtaaatgagtggcaaaggtagttcaaattcaggttccaagtctgagctgtcagccactggtgctgaattgactgtaattttgtgccaggtggtatactgctaatccaaatgtcacctcccccaacccaggaaactaatattctatagctataaatatacaaatgtatctgttactttgtggtatgcttgtgtgaacattcatgtatttcaaacattattttctatttcagtatatgatcttccccaacgacctaatga

SEQ ID NO: 88919 - DNA, 1325 bp, Homo sapiens
ctgtagcctgtgactctcatgacttcccgtgtgctcgggcccaggcatcacaccctggcgcctgcttggcttccacatgtgggcatctcatgggcacatcagatgtgatatgcccaagagaggccctacgcctcctccaggctcagcctcatgtcagtaagtggcaccactatctgttcattggttgttatttctgatttatcttcttcctccctcctgccactctgtccatcagcaagtcctttgaagcctgtcttcaaagtagaggccacacatgcgcatgtctttttctcccctttgccactgtccaagctggaggcagtcaccctgtgcatcatctcatagccaaactgctgcagccctgacttacctgggcttcctcgtccccttcaatgccttgcagtctcttttttacagagcagtctgtaacgctttaaaaatgtaaatcatcttattgctcctctgcataagcccttcggtatttttgcattatacttgtaataaaacctaaaagagaatatctgacatacctgatttttaaagaaaatactgtggttcttgttgaactcctttagggatctaatgattggggttttttaaccccagtatgaggtagttaggcctgtcacagtcatctgcttgttctccagtctctccgagtttgagttatgatatatgtgttccttttagagagctgtctagaactcgagaatcatggcaccacagacgtgaaatggcatctgtcatctttagcgccaccttatgtcaaggtcagtcatgactgcctcagatataatcgttttaatgtttagactttatccaggatgttctaaaaactgactatgagcataggttgatattactggttatttgcttgtttgttttctgagacaaaaaagtcttgctctgtcgcccaggctggagtgcagtggtatgaacactgctcactgcagcctcaacctcccaggctcaagcaatcccctgccttagcctcccatgtggctgggaccacaggtgtgcaccaccatgtccagctaactttttgtttttttgtagagatggagcctcaccacactgcccaggctggtctcgatctcctgacctcaagcaatcttcccacctcagcctcccaaagtgctgggattacaggtgtgagctgctgcacctggccttgctggttatttgttccaccaattcatttagttggttttctctttagatgaggatgatatatgcctagtctttttcacaaggtggttttgagaatcaaattagagaatatgtgtggaaatacatgtttgctccatttaatgctgtctcctagc

SEQ ID NO: 88920 - DNA, 3001 bp, Homo sapiens
ttacccattcctttgtttttcaccctttccttccttcatcttcttagtgtccaagcccctggtggtgtaattctctagtcagatgctctcctctccctgaccagtcctgcttttgcctccaggctctcaaaagccttgagctcaggctggctgggttattatgtttaaggttctgcgtgggcagaaattaggccacctatgtgttttaatgtttaagtccagactcaggaatactgatttgttgttaacctgattcattgttaactgattcattgttaagtgatcagtattatcaacactaaattatttgataaagctaaggctcttaatattggtaattgttataaaatgctgtttttaaacattacagttttctcatgattgagctttttacaggttgtacacatgcagggtgtttatcactgagctatgtgcccagggtcactggctgactgacatttggaagctaatcataatgcgagctgccactgtggagcgtctggcgcttgtcttgttctgcctcctgtagccgccgcccccctcactgttgtcagtcctctacagctcctggccgctgtgaggcccttgtcctggtactgcttggccagcagagggttccataagcacacaagggaagacaattgcgggtctgtggttggaccttcctcgtgtaggtgttgtgcttcacagctttagtgctttctgataacatttccccccacagtaaagcatttattgtacattttaagaaatatgttatataaagccttaagcaaaaatgtgttttggatctggtatagtaacccgctagaaatgaaattgtccaaattctttcaattaatggcaaaactagccagtgcaaaagcatttgttcctttaatttttttcataccaaatctttgaactggtgatctagctaacactgtgtttaatgatcagtgtctaaatttctcttctgtatgtatttcgtaggtctccatcacatttttgcccagaggtaggggggattatgcccagttttgggatgttgaatgtcaccctcttaaggagcctcacatgaaacacacgttgagattccaactctctggacaagtgagtagtacactgaatttaagtaaattattgtatgtattttaaaaacagaaagggaaattaataagaaaagttggcctgaaaatgcagaatatagccccataatcttaattttcttgtttgtctttattaattggcatgtttgaggactggatttggctgtattgttcatacagcccatgaaacccatgtttgacttagttatataagaaactctgtgcgtgtgcatcatgtatgcacatgggcacatgagagagaggaaccaggcaggacagagtacagagcttgcaatttaggggatttaaaaatcttaaattgccttttaaaaatttttaaaggaaatgatagaattcaaataagtaaatgtccatatattttcttagtttttatttcttctccgttaccctgtgatttttctgtatagagcatcgaagcagaaaatgagcctgaaaacgcatgcctttccacggattccctcattaaaatagatcatttagttaagccccgaagacaagctgtgtcagaggcttctgctcgcatacctgagtatgttgtttttgtcattcttatgagttttttcccagtactttattgaggaatagagtcagtaaaatgctcgatgactttacctgagttcacatgtgttaccagcactccaaccaagatacagaatattcctctcgcccagaaagttcttacgtgtccctttgcagtcaagatttgtcctgttctgatttctgtcatcatagattcattttgcttgaacttcatatatatacatatgtatgtatatattctttgtgtctggcttctttttctcaacatactatttttaaaaatccattcatgttattgaatgtacctatagttcattcctttttattgtttagtattccattaaatgaacgtatcacagtttattcattttcctgttgacttttggatgtcttataatttggaatgattattaattaaggtgctatgaatattactgtatgtgcatttctaaagatgacatacattttcgttactttttagtaaaaatacctacttttacccacaattgcgaggtcacatgataaccatgtgttgaactttaaaataaactgccaaatagttttccctaaatagttgtaccattttatgttcccataagcagcatatgaaagtagattcttaaaaagctttaaaatgtaaaacttataccagccgcatatatagctttaatgagaatattatttagtattctaccttatgaaaatatttcttataatccttaattaactagtaattaggtctaattaagttcttgaggaggatgcctggaaggacaatatatgttaaatatctgctgaatttaatataaatttagtcatttattttttaatgggagccaataatgcatttggaagaaattagagccctttaatgaatgcatgttcttggcacactccctccaggctgttatcccttgcttctctcttgctctctgagccccgcgcctccacagctcccttctggagacacagcctcgccaacccagagcccacacgggctgcggggaaacaaacgagaaactgggagaagtgacagaggcagcttggtctgtgaaacctgggaaggagttccctgaaaggggacatttaagttgaggaggatgagtggaaacggcctaggtgaggagggtcggagaagttcccaggagaagttcagtgtgaaaggggagtggtggggggcaaggccagagctgggcctaggaggtgtttgcttttctggagagctgggaagccagggagtgacatgatcaggtatgcgtgtgtaggacaatcccctagctgtggtatgactgataagaaggaggtgaggaggggctattttaaaggagtccaggagtaaaatagtgtcaagg

SEQ ID NO: 88921 - DNA, 1740 bp, Homo sapiens
gaatggcatcctcctctctgtatcttccctggagcttcaggactgagtattgaatgacagagaaggttctgcaaagtctgcacagggagactgccattgcatcaagtcatgtctgcattctgtatatggtattgtcttttctagtctttaactcgagtgtgttgtcatctgtaactctccctttgtactctgcacaattcttctggaatatagtctttgtgttcagtcaaggatcagagtgtcaaatctgagtcattacatagacaaatgaggatgtctgagtattacccatgtatatttattgaattatatttggtttcccatcaacccttgaaatgttatttgatggacctttctaagcagtgctttttaaaacagggggctaacttccttatgatctttgaaagcttaattctttttaagagcttcattttgctattgacattgaacacagtgttaggaattagggctgggaatgtaaatgccagtaagggatttgctgtaatggaattgtagctaccttcctcccttgttttaaatgacctctctaatttcttaacattctgctgttacccttggaagggcttgccattgttggccatggtcctggttcgtgtaggtttgtatttacattggagaagactcttcccggcaggtttttagggctgtctcttgaatcctctcatgggcttggtttgcaagaccacaatcctgcagtggaacgcagccagtgccagctgcttattaagggattttgtgccaatttgttggcacattatttgagactcctgcaccccaccctactcccactggagtatatacatacatagacaaatatttattttcccccaactgctgacagtgttctaagaatagttttcttgcctggcacgcggagagcaagggcccgtctgcagaggtgtttacagtttgggactgtgctgtagtcttggttgacttagcagcctggcagaccagcctcatagctcctgggacgctctctgtttttgctctgggctgctgcaggggtaacctccctgactgatagggaagcacagtcagaggagagtgacttttgctccttgtgcatggtttctggcaggcagtccagcagagatccctgagctcctgacgtctctgcatgtagccagcataaagtctccttgtggtgggtgggaggtgactgctctacgtcatcacgtaaaaccaaagccacctcagggccctgggcaggaattcttgaaattgtagactgctctgatctttctggtagtccttgccatgtttcttctcatctttctttggaatctgggcttatccagtctctatgatgtgtccttcttcctgtgtaagagttagtagagaaggaaaaatgttatccctcaagaagtgataaaacattgtaaaagaagagcgcaccatattaacctggaaaaatttttggaaatagttaacagaatgtatagcggcacatggatattaaatatgaatagcggcaaaattgctatgtagtccaaaattattcttttctttcttccttcctctctgtctccttccctctctccctctgttccttcctttttttaggtctcagaaaaaaatctcctggaagccattattttctgatgtcaaagagactttctgcctatatgaactgtgttagtttagaattacatcttgacctatattacgggtgtacatggaagatgagtcttaagtttcaaaataggaatgcaaagg

SEQ ID NO: 88922 - DNA, 1082 bp, Homo sapiens
ttgctagaattttgttaaggccaaacatcataatgtcagtggatgatctcagtaggtggggtaagacctttgtgctttttaaaatttgaataaaataaaataaaataaaataaaataaaataaaataaaataaaatagaattaaattctactcaggtaggttcagggcaataaacattctaataacatgtcttttaaacaaattataggatacgatgggcatagactgctcttggtcttcccccagcctcctcatcctccctctttaggggtagccttgaacttgcaatggagaatgagggccaggagggggtggagtcagcacctggctgtctggatagccccaccataccttgttcagtcgcttctcttcatttcaaatgatccctattggacctcacactctttgctagtcttgcccctaaggatgcagacagaaaattcatgatgggcagacagaaaattcatgatcctccatactccattcttgtgtcgtctgtggaggacctccacatcctctgcaaatgtgctaaagttttctgctttcctccaaggcatcagcccttccagagttgcaacaactatgaacagtgcctgacctcttaagctgttgctcctaaagcttgagagagatgaaaaaatcactttactaggtggtgatgaactaattaaagacagtctttcattgaggggttggaagcagctggaatggagggtgcttaccgtgctggagggagcaagatggcaccactttctctagggctggtcatgatcggtgtggttttgttcacaggcacctgagcacatcaggtggggagaccctcatgtactgtgcaaggtgctcacctgctctttggtgtatgctgggggtgcacttccacctggcattgcctggtggacagtgagtgggtcccacaggacctggtgggcccatgtattagtccgttctcatgctgctatgaagaaatacccgagactgggtaatttataaaggaaagaggtttaattgactcacagttccacgtggctgaggaggccttgggacacttacagtcatggcggaagtggaagcaaacatgtcct

SEQ ID NO: 88923 - DNA, 1091 bp, Homo sapiens
tgttgtctcgtgcatcttacatcttttactgtgattaaaaataaatgtcgtggggttcacgtcccacagacccttatgtactgcagaggtcaaactggggcgggtttctcacacgcgtcatcacgcgaggccagtgtccgtcggggtgtgtgtctacaagcacggggcttcgtggcctatctttatgaaccctccagggtgatgtgaagccagccacaaacaaacacacacatcatctgaaaacaataacaaaagatcggggttctaggaaaaagagaaaatagtttaacagagcttcattaaaccaagaacgtgcttctgacttgttgacctactggaatcgcttgttttcacgtctgcaggaaattcatcaaaacaattttgtctaggattccagtatttcaagttttacccggtcacgtcagtgcttgatttgatcatctgcattttccaattaaaggttaagattttaggaagctctttgaagaggttgtttaattcctgctggtactttggtttcaggcctggagctgtggccggggtgatcgggtgattagtggaatccaactaaggtaaggcaggcaagaccttcgtggacttcactttgatatggaaaaaccactttcacacacttactaatgatagatttttagaacaatagtaaagaggttggtaatattttaccctttaaaatcccatgtagtctgtatagtatatagaaaaagaaataagaactaaatgcaaatgtggtattttttttgcaagccactctgcattgttattttttaattaaaaaattaaaaaaatagatttatggggtacaagtgcagttttgttatatggatatattgccttgtggtgaagtcttggcttttagtgtaaccatcacgtcaatagggtacattgtacccattagatgtactgttttacttaactctaataaaggtaattttgaagtagtttatttaaatcttatccaacagctttggcctttcaggcagctctgaccccagctgttcgacttgggtttcagctgttacacagtgggcttatccacctacccatccacccatccatctgtgctggcagga

SEQ ID NO: 88924 - DNA, 1047 bp, Homo sapiens
tgcatgtgcacatacaggcatgtgtgaacatatgtgtgggtatgtgtgatttcccatagggcccagggtccaggtgggatgggagcccttccaggtttggagcagagcagtgtctgggtgtaggtttccagagggtcagggtctctggggaatagatcacggtggaggcccaagggagaggcagggtgccataggggctgttgcagcgttgaggccctagggacggctccccaggccagggctgtggggtgcttggagtggaggaggaaccagaggatgcactgaggtggagagctggccgagggagatgtggtgcgtctgaatttctgctgagcactggaattccattttatcaggatgaggatggctggggaagggatggctttgatcattgcttttattgtgaggagacaatttgtcatcagcattggtgttattttggcctgacttttatcactcttgttcatcatgatcttgtttctgcctaactttcgtgcttgctaccctcttagaaaatgatgtatcacttatttaggatattatgtgttaattgttgtccagaaatcaaactaagtttctttccaagaaagacgtgatgtaaagcactttgattccctgggagaacaggtgctgtgtgtgcacaaggttttgctgcctgattattctagggaaaatgagacagtgattatatatgttggcaggactcagatcacaaactgccctggatgtagggggaggcttgggtgaatctaaaagcatcctcctgccatttgaggtgagtcctctccatgttgggagtagaaatggctcttcttttaaaatagggtccctttcttggctctgtctctgagtcaccctcctggggtcacagatcagctgcatgggcacaggttaggaatgtggtctcagcctcagccttggaccccatccccccatcaaaatctgccttttaacaagatccaaggggattcttgtgcaccttaaagtttgggaaatactgagttaggacagttttaaaacattctgaggacttcttgcttcgagatc

SEQ ID NO: 88925 - DNA, 1026 bp, Homo sapiens
gttaatagtggctcccaagctgagcaagatttcaatgccaatggttatttttcagtggtctcatagagaaaatactgggaaatattctaagaatggtgtaaaatgaagaggaacttggtaattttttaaaacactggctcaatgaaatgtaagcagctggcttacacacagtgacaatctttacaatcagatattgtgctctgaactagtgctctgatgaggtagtagaagcatgtctctattttcaattaaaatgatccgttaatgtgggaatatttggagcatctgtgtcttttcaaatgaaccggggtagatgatctttttttttttttcctgaggggaagcccatttgcgtggtggcttctgctggtagcatccgtgcctgtttcccagcctgctggggccctagcgagctgtccgacgtcatgtgctcacacttggagtcagtctgagtcggcagtgtgggagttccttccagagagatgtgttcttttcatcttgaatggttcataggtttctgcagcaggcatggtctcattctcaaactcagtgtcctcacagccttcttcgaccccttcctcctggtatccccttggatgttctgtcctccatcctcccatgtggccctgtccgtcacctgacatccatgttaacatgcttatgggtatcactcgaatagctgccttcacagcaggctcttgctgctgtggatttgaacaagtatttgtagaggagtcaaggcaggctaccttgatctgcaaacacaccagggctgtctagagccgtgtcactggaccgctgtgctggtgtctcctgggggcttgctagaaatgtggaggctgggcatggtggctcacatctgacatcttagcactttgagaggccaaggtgggatgatctcttgatcccaggagtttgagaccaggctgggcaacacagcaagatcctgattgtacaaaaattttaaaaattagctgggcctggtggcgtgcctacctgtgatcacagctgcatgggaggctgagg

SEQ ID NO: 88926 - DNA, 1006 bp, Homo sapiens
acatcttgtgtaacgctgcaaattcgcggaaggctttgaaccgtcaccagagtagcaaatactcattgtgaaagtttttgcaatgaggtacggaaaaccatttcagctgctctgattgtcagctctcctgtgttttctttagctcctgacttaaagttacgtgtcctgtcagttttgatactcttactacttagtgctttaggttttatcagctggtgccacatcttttaaaattctgtcccactagcctctgtgctggtcctgaccgattcaccagctcttgggactgtgtccagatgccttttgtgatgcctcttttctaaaatgcttttatttgggtttaagatgtactaattctttcacacacccatagctgaataccaaatattggtatgcatactaccaaacttttgtgtatgaagttcgtacaaggcactaagtcatttaaaacattttaattgtgtgctgagctcgtaagtgtacaatatgactgtctagtaaattcttaattatttgtcgactctttatcgaagaaaaaagtaagtaggggaaaagataaaggagcatccagccggtggcaaaggaacaagccgtgtagctctgcttctcacccactctcagctagcttgggccacggctgcctgaagtgacaccaaacaggaaccccactgggaggactgtacgggccacacccatggacgtgatctgtctatgaaacaggtcttctcagtgcttcggggtgaattttgacttctcctgagccatcctcagagcacagctggtggggaacttcacccgtctggtcactcctgaagcagtctggctggcagccacaggctgggatcccagttgttggaggtcagtgcacacagcggctatctgctgtagcagaaagaatttaggggaggaaaggcttgagaaggaagggcaagagagagcagactttgtggcatcagtcaggtatatgtgcttgtattaacatgaacctgagaggctgatggtatta

SEQ ID NO: 88927 - DNA, 1014 bp, Homo sapiens
aggcttccaccttcatcgtcttcatcagtctccgtttattgtgagctttcagagcttatgctgaattttcttgctatgttcaaatcaccagggccccaagccttggacctatgttgggctttgatttcatgagagcgtgttagaggttactcatggaacacctgtcaggccaaggtaaaagtgtataaggtgggtcctaccctggcacacttagcctgtctttttaagcttgaaacatttaaaagtatttagagatcttgttgatgaagactctgattcaaagtcagaacttggagaaattcagatagacatcctgagaattttcagcagaaagtaatataggctttttcagctagaagggccatagctcaccattgtggatcaattcagggaactggggtgctggagaaagcatgatccatacagtcccaacagacttttgcctcttgccaggaagttggagagattggagattattgttgttgtatttcatgtgtactttgtcgtatatgttaactcttgtactaacttctagtaaactgtatataggtctcattccataataggggcccacccattttcaaagaatccataataactcgtggagggctgaagtcctgggttgtatcctgactctctctgtgaactgtgaccttggaagagtaaaccgtttctttaaacctcagtttcctcctctctacaatgagataataaaccaatttcacataattactgtgggaattagatgaatacaaataaatcacctagcacagtgtctagcatataataaatatacaacagatatcgattccatttataaagcttccttcctccatttataaagctaagagttaaataacccattctcgtataattgaccatggatatccgagtcaggtgggcctcgctgacaggtgagccaggattctagggccaaatagagacagacgaggtaatgggaaaggctgacatcataggccgtggtagccctctctggggactacttgttaacac

SEQ ID NO: 88928 - DNA, 1411 bp, Homo sapiens
acctatgtgtgaggtattaagaatcatcaattccagtggatgcttatgtccccactacccagttccagcagaagaatgttcctgtcatcttccacttcccttacacagacacatcttctttctctaactggatgactccccatgtgggacaactgcctgcacgatacacatgagtaatgatgtggttttccctccacaaggtcccgaggaaccagaggtagctccgttttggaaagagcttcctggttgcccatgggttatgaagtctgctggtgaggcttccttagatgtctgaatgtctctggtggccatctgtaagatgcagtcagtcactgtgttcagggagggcggcccgtggatgcctggcttccacacaagcagtgtggtcctggaggcacacgtggggttcctggaaggagtgcagtttgcagttgttgaagccccacaggtgggagaatatttcgctctagctacctctaggtctttatatgacatactgttcttataatatgtctggacatgactttctttttttttgtttgtttttgagatggagtctcgctctgtcgcccaggctggagtgcagtggtgcgatctcagctcactgcaagctctgcctcccgggctcatgccattctcctgcctcagcctccctagtagctgggactacaggcgcccgccaccacgcctggctaattttttatatttttggtagagatggggtttcgctgtgttaggatggtctcgatctcctgaccttgtgatctgcccgcctcggcctcccaaagtgctgggattataggcgtgagccaccgcgcccggccatgactttcttttcttttctttttgtcctgtttgttattttgtgagattcctagtctgtggattggtgtctttcagcagttctggaaaactcgcagattttcaagatctcctcaaacattgcctccgtcttggtctcattatcctcctcttgtgatgagttgtgggttagagcttcccactctgtcctctgcactccttctctctcttctgtatttcccatctttctgcttttacatcctgggtaacttcctacagtcattagttcactcctcagctgtgtctcgtgttactagacccatccagtaggtttgtgtttcttgtattatattcttcattccagaagctgtatctgttcttttcaaatgggattgtcattttaaaaagtcgtctttctccttatacaaagttcccaatgtcttcttttctttttaagctattaaacatacttaattttacccactctatctggtatttcccacatctgaagtctttgcaagtctcattaaacttcccgtgtttatgctggatctcactcatggtgctttgtttcttgtttgttttgtgattttcgttttttaaaagtgag

SEQ ID NO: 88929 - DNA, 1050 bp, Homo sapiens
agtcagaagttacgcagccagatgccagggaggttgagtaaaacagaatattttgtttggtttgttttcatgccaaatcttcccaatttatctgtgtttgtcttttttaaaaaatacaagttttaaaaaaactagcaaaagatatgggccaagaaattgagatccccgtaattctttgtttagtctgtaaggcagagtacatttgcatctgaaattaaatggccattgaataaacacagggactcaatatttgtaagggcactaatgtttgcagatgtctgcagttgttaagggcaagccaaggaaacaggaaatgctgggactcatattttttttctggaagaaatgggcattccaaatgcatcctatataacctttttttcttcttcttcttcaggtacatccataatagtttctgaaaggtattcaatcctggtggagagctggagatgtgtttatgctgggggttgttaaatatatttacagccttttcagagagttccgtgggggttcgtcagtggttatttattagtctgcttcaacatctgctggctggaaaataatctgtccaaggcaattcacaggaacattataaattgcttccgattataatgagcagtaggaaaggtaatttgagggaaattccacgcatgttagttacagcgtgtcagaagcaagatctggtgtgaaatgcccagagaatcagtgtctgctgataacagttataagatggaaggttctgggtgtctcgaccgtgtttttcttcctgtctcacttctgggcttgctgggcaacttgcctgcttgctggggttctttggagcctgtgggcaccttcatgtgggcactgagcagagccagccctgccccttcctgcaggcactgccagcggtccctgagtggaggtggaggtggaaaccttgagtgttgaggcccctgggggctgctgcattctagtttccaagacagagtctgcagagctgtggcaaccctcagaggcccacacacacctccaaagccagcccgaccccgcaaggcactctcaccgggg

SEQ ID NO: 88930 - DNA, 1050 bp, Homo sapiens
ctttcccagttttttctttcatacactgccgagctttggaaaatttttaaaaaatgaatggtacacaaagttaatgttgccattctaagtagcaaaattcaataaacaagcagtgcagcaagcccccgagatgggggcgcatccagtcatggctgcatggggggccgggctccctgcgcccacagcagaatgtctctgagcctgccagtgaccaacgccatgagccggtcctttgagggagggcttcggactgggtgccgggtgtctctctactagcaatcagtatctggcctgaggacatatttgaagtgctctgcaccagagccttcctaaaaagaagagccgctggatggaagatagaggatggcccctgtcagagaagggaactgttggttcagagaggaaggcagggatttggatggattcttctaggtcagagaagatttctaaaagtgcttccttttgagcctttctcattcttatgaagatgaaataaaggtgaaagagatcaaacggagatacgcagaagttcaagaagtcctcgcctgggtacaaaattcctctgctggtgtcaggaggcctcccccatttactgttggcccctatttcctgcctcataagtttgagccaaaattagtgaatggaaatgcagtcctcacgataaatcttttaaaaattcgcttctgctctcttgggatttcttgtggcttgggtgtgtgtccatgtgtttatgtggtggggagggtgaggacatgcttgtcaagcttctgtattagtaaattttggacactaaaaatagaagaactattgaaatacataatttgcttcatgaaatctcttttccattaaggattgcgtcagtatttaaagagaatgctagagtttctgaaaaagcaaacgtatgctggaagattgtgttcttatagatgggattcaagatgccttgggtctcctacaccgggaacaagggacaaaagtcagcggtatgcccaggagtgttcattcccaccaaatgttcttcctaacaatgcaatccacactttgctggaa

SEQ ID NO: 88931 - DNA, 1153 bp, Homo sapiens
gggagcctctttgctgcctgccttggaattcaaccacctgagccagaaatctatagaaccagaggtggggaattttacctattcattttgcagatgttaacattgttctcttttggatcatttgtatgttatgtagtattaagttagtactaaatgagattgcagaacgtactgcatcatgttccctgaggacaatgggagtcaagacctcattcttcctttctggacttgaatggtctgggggaccacacctccttcccagaattcatctgcaatcatgaattttggcctgaccttctggttcttgaaacatctttcccctgcatttggcgcttgtaacttgtctttgagaaatgctgagtcaggccaattgatgatattttccctctagaatttttcctttgtgacttttgtgtcaagtttgttcattttaagtagtcaaaacaagcttttaattgtcttgcttcttcagggttaggctttgaaaatcaagctgtattcttctttatgcatcattgacagtcaccaacaataataattacagatcataattatcttgtggcaattatgataagaattattttcttagtagaaagaatgcatcctgatttcagaaacctccagggcagtgtataacatgaagcctgttctttgttccggtgacttgattggacagtcatagtggagagatgcacaggccgccagaggcattctcagagtatcaagtctctacagatgaagggcgcttgtggagaagcatgtttcagtgcgttttctctgggacaacatgccccataagaaaagttgaatacaattaaacacgtcctgcctgcagccaaagcagattttcactgtccttgaaagtgaggattgaacacaacctcccttccctctccctccctctgtccagcttcttctcttttggattttgaacaatgtaaatgttagaaaaactttgaagtgagaaagaaaaagacaaatttgccctgagcatgtcaggtacacgttctgcttgacgcttctgtgtgggcctccctgttgcagtctctaggggaggataggcacactgtctccagaaagaggacagtgaacttccagctgcatttgactgatactaggccatttttagttcttagagaaacaacattaaaac

SEQ ID NO: 88932 - DNA, 1086 bp, Homo sapiens
ctcccagtagtgaaaataataaatttatcccttgaaatataatcgtgtgtttatttgtcacagaatctacacttacttacaaatgctttatgctcaggatgaaatggagatactggctctcttgtttcagtgatcttagatgataattccaggaattttaaagatatatatatatatatatatttttttttttttttttttttttttttttgagacagagtctcgctctgtcgcccaggctggagtgcagtgataacgatctcggctcactgcaagctccacctcccaggttcacgccattctcctgcctcagcctcccgagtagctgggactacaggcacccgcgaccatgcccggctaattttttgtgtttttagtagagacggtttcaccgtgttagccaggatggtctcgatctcctgacctcgtgatccgcccgcctcggcctcccaaagtgctgggattacaggcatgagccaccgcgcctggccttaaagatcttaatagtatgcgcagaaagatgtttgaagaaaagaaggaaattgtatatttgacacactgagcttctttctgtgttcttagtgttgggtttgggtcattcaggatttcttaaccaattcagacatgaatcaggctgctgtagaagatagtaattacaatggaatggacagaagatgatttttagccaatgaggcaaaaaaagtcatctttcctgctttttctgaaatgatatgttgagaagatgtttttgtgagatacacatttctgaattaaaggattccttctgaaaatataacttgttaggtaatgtggacatattttttctgttggccaaagttcattttttgaaatgggggccttcatttattttttattttcaaaattgagtttctataaggcctaaaataaaatagattaaatgtcaccaaagttgtttgtacctgtttaaatatcttttttgcaagccacttacattttttggtactgaaagctcactactcaattgtccttatgagcatggaggtgtctcagtgtgtctgatcatactggcccagatgcctgagtggcacatgtgcactcagagaa

SEQ ID NO: 88933 - DNA, 1907 bp, Homo sapiens
tagttgccgaaatatactagttctctgagggttaaagaagtaaaatacctttttaaagttaaatatcactagaaaaatcagtgttattacaagggaagaaatgaacccagtttaagaatttgccatcagtagcagtattaagcagtggttaatgtcttagaagtcagacttctttttcaaggtcttcagaaccacacttgatttctgttttgttgcagctgtaattgacacatactaggcagctgactccttgaatatccagtgtgacccataaaatagtctgttaataccggatcttaatttttatgttattcattaagattttaactatattcagtacgtaatttggagacaaactagcatcatcaaaactgcctgtaaataaggtgtttagtctttctataaaaacagaatagagcagttacctaccagttaaaatatcttatatgaagaaaatagaataaagatccagtcatatatgtaaataagatgtactgattgtacgtaaatgaaaaatggaccctttaaaaattatttttacctgaagcttgtcataatttttttaaagcaaatatatatatggtgatggtacttttcaaagtgtgtattagtggtgatcacctcaaacataaacctctgttgtgaatcatttgtgtccttttcaactgtctttcagaggaaaggtaaaaaatcattaaaccttaaattcattgttaaaatcaaatatttgtcagcagtaactcaagctcatggttctcaagcagaaaaaggtttgggagactaaaaatggagtcaggttttcatggagactgctaactccttggggtagacatgggccttgcctcagcaaaccagtgcaatttcccaatgtcttagtttcagaattcatgctgatttcattatggagtaaagttttaaattgtggctgctgctttttgtcttacattgaagggaaatatccttgtttgagcattctacttgattttttttttttttttttttttttttgagacggagcctccctctctctctcccagactggagtgcaatggtacaatctcggctcactgcatcctctgcctcccaggttcaagtgatcctcccgcctcagctttccaagtagctgggagtataagcgtgtgccaccacactcagctaatttttgtatttttagtggaggtggagtttcaccatgttagccaggctagtctccaactcctgacctcagcctcccgagtagctgggactacaggcgcccaccaccacgcccagctaatttttttgtatttttagtagagatggggtttcaccatcttaacaaagctatcattaaatcatttgcttgtaatgaaattcagccgttgtcagctgtgagcgttgcggggctggtggggtgtgtttgagtatgtaagtgtctatttcctgtgctctaacagtgactatttcagttctaacccttcaattgctaattggatgagggaatggcctcttagattgtccttgttttgacttatctgctaaggcgagagaatgtctgggtttgccacacagtcccgcagggacccctgctctttgccaggatttttatatcaagtacttagtttggccaaatttagagtatagtttaaaggggaaaaaaagtttgtatttgatgagtctaattactatattagaatgctttttaaatgaatatgctgtgattggaatctcttcttgggggccggggagagtgctgagagatgcagctgtgtctctgctctctgcagtcttgggcaggcagcaccgctgtctcctgatacagagggttgaatgcactgcttcacattgatgccacattttcaaatctaaacatgattaacatgttttttaagtatttatcaaataattcacatttttgcaggtttaag

SEQ ID NO: 88934 - DNA, 1029 bp, Homo sapiens
cttgctgtgtcacccaggttggagggcagtggcccgatctcagatcactgcaccctccgcttcccgggtttaagtgattcttctgcctcagcctcctgagtagctggaattacaggtgcccaccaccacacctggctaatttttgtatttttagtggagatggggttttgccatgttggccaggctggtctcggaactcctgatctcaggtgatccacccgccttggcctcccaaagtgctggggttacaggtatgagtaaccacacctggcctttatgagattttaaaattacactgtgcttaaactctataccctaacatcagtttttgtggattatgtagcagtgtctgtctttttacttcctaatggttaatgattgattttcaaatgaattgatttaaaatggaaacctaagtattacctaatttttttgaaaaattgtctttgtagaagctgaaacctatcaacactcttcaaaatgcaatggaatgtaccacggactgtatctcgactggcacgcaggacatgcttggaaccacataatgctggtctctttggacactgtcaaaatgtaaagggacctttacttttatacaatgctgaatccaaagtggttttggtacaaggccctcaaaaacaatggttgcatttatctgctgcccagtgtgttgcaaaggaaaggaggccattggatgctcatccaccccaaccaggagtccttcgccataagcaagggaagcaacatgtttcattcaggagggttttttcatccagtgccacagctcagggaactccggaaaaaaaggaagagcctgatcctttgcaagacaaatctattagtctttatcaacgattcaagaagacatttagacagtatggaaaagttctgattccagtgcatctaataacttctggtgtttggtttggaacattttattatgcagccttgaagtaagtttttgcttagttgaatgtctttccctgtcttaccagaatattaatctttttaattgtactaatgatagct

SEQ ID NO: 88935 - DNA, 1035 bp, Homo sapiens
ttatgtcttcttttcattcttgttattatacagtgcccctctttaactcttataatcaaagaatgtttgcagtctgctttgtctgaaattaatctccagtatcacttttttttttctttttttgagacgagtctcactctgttgcccaggctggagtgcagtggcgcgacctcgggtcactgcagcctccacctctggggttcaaatgattctcctgcctcagcctcccaaatagctgggattacaggcgtgcaccaccatgcccggctaatttttttttatatttttaggagagatggggtttcaccatgttggccagactggtctcgaactcctcaccaggtgatgtgcctgcctcggcatcccaaagtactgagattacaggcgtgagccaccgctcccagcccagtatcactttttaaaagacttcttgggagcctatttattttgcaagatttgcagtttcccttatcaactcatttgtactgttgttggattatctgtgagagtctgttaggagctgatgttaattattcatttgggagggatgagtcaggggattaatttttgtaggtggataattactaatgaatgtttttatatgatgacagtttttgttttgccagtcaactttgtacaccagataaagaatattcgtgtaagatggagtatctgtatttattgcagtgctcatttataggggtgctaattcagatctcactgtctgttacttaggatatagttaaagtgtctgttctcaacatgttagtagtaaggtagagctggcattgggagtgggaaggcatgtgtggtaccacctgatgttgaaggaaggggactgattgactatatggtaatggctactataattacatttaccactgggagaacctttgtctagagaggctaagtaattatctggaagtctctataattcttaaaaaaaaaaaaaaaaaaggcttgcagtcttgctgtattgtccaggctggagtggagtagctgttcacaaatgcattacagcctcaaatacctggg

SEQ ID NO: 88936 - DNA, 1044 bp, Homo sapiens
ctttaaggttacagagtggctgctggaacccccagaatccatatgtttccttgctcacccccagtttaggagagagaattaggtccccaaaccatggaatgtaagttctcaaaatccttagactcccctaagtcacatgcccatccctggaccaataacagtcagccagccacacaatgctatgagccctgtccttttgatcgggatccatcattggagctgggggctctggtagacagctacctgagcagaacagggcctctgaagagggaagaggggagaggatgcttagtaggcagccaacactttccattaccttatctaaccagtaatttagttaacactgttttatctattgttcttttttgtaactagacaatcttaaagtggaagtctttctgtatactatgaagccatgttgtctaatacagtagccatcagccacttgttactattgtattgtaacttaaagtaattaaaattaaaatagaaaaattagtacttaagtcacactagttacacttcgggtgttgagtaggcagctgtgtgtagtggctaccttattgaacagcacagatatagaacattttcatcatttcagaaaaatctgttgaacagagctgctctaaattgtttcaggtaaagtttttgtgtaagcattgagccacagtagaaacaaggatagcacctactttactaggttttcatcttatgttggggattataggatctgaaatttagccgaaatgggaaataggaattcattcatgttgaggtgattgaatataatgtttgatactacttaggacttaaaaatatcagagctgtttttaaaaatatacttttttccattaagaaagtacaaattattttttgttgtgtaataactctgtgcaagtttggtgatatcttgaagttcagaatatggaaaatgttgtaatgtgaacaactttatgtggtggtaacatacccatgataatgaatctcacagtataatgaaagtgactgcccagtttgtcattctagtagagtatgctaaacttt

SEQ ID NO: 88937 - DNA, 1305 bp, Homo sapiens
aagagcggcgcacgcggagcagttgccgggttcgcgccgcgagtcagctcccggacacacgcccagggttgaaggtgccctctagacccctcccgctgccccacagaggcctgggcccatgctacctcttaggacgctggagccgccgccgccgcttcccgccgcgcaggctggaccacagctcctcggatgccacggcggtgtcactcagcagagcagcccgacaaagcgtgggtccgcgtgcaggaacccgccgggctcagccggacgctagccccctgccgcccccggccccgccagccgcgcccactagcaacgtgctcgcgacctccagtgcccgctcagtgaagcttctgcatgccgcgcgcggcacgtcgggactcgtagttccggcgcggaggacgtgcgtcgcggcactctcgcctgaccgtctccacgtgactctcgcacctccggaagtgacgtaagcagacacgcgtggcgcgggccgccgtttccgcaaacagaatcgcgtttggctgtgctggtgagtgtgacggctggaactccggcccttcctttctttgtgtttgtccctcggccgccgtggaggggtggaactggcactcccacccctgacatgggctcacttcgcattagccctgtgcttcactacccaacgcgtgggtctattgccttgtgtcctcagtcccaaggaaaatgggaactccttggggtgggcgggcgctgttcctcctccagactgggcgagcccgggtgggagaagcagctcgaagagctgctccagctcgcgccccagggccgtgctggggaggggcgtggggtccgcaggtttgtcttcagcggcgcttcggaaacctgaaccagaggttgagtaacaggccgcgctaatgacggagggggtgaacttggctggagaagtcccttctcgcctctgtgcgtcctctcgggccccgtggtagagggtcaagcgggcgggtcgggacttagagcttatcccgcttgggctttatcccggcggccctggcggcctgctcgctcgtaccctgaggagctgaaatgacgcagagacatagcttgcttcggaggtgtgactggaaagccgggtcgaaatgttcgtgtggttatttatcgcgtgtccatctccatgtcagtcgaccacctttcgaaggtttcttgaagattctgagggacagctctcttccctatggagtgttttcattattccactttgagtttggtttgggttttttttcccccaatttgttaaattgatacatagaagttgcacatatttgcaggtgc

SEQ ID NO: 88938 - DNA, 1049 bp, Homo sapiens
tatacctgttggccatttgtgtgtcttttaagaaatgtctattcagatcttttgcccatttgtagtaggattgcttctttttttttgctattgagttgagtttcttctgtattccggttgtgaatcccgtcagatgaatggttttgcagatattttctcccattctctaggttatctcttcactcttgtttcctttgctgtgcagaagttttttagcttgatgtaatcccatttgtctgtttttgcttttgttgcctgtgcttttgaggtcttaccacaaaaatctttgcccagaccagtgtcttgaagcatttccacaatgttttcttcaagtagtttcatacttttgggtattaaatttttcagtccattttgatttgatttttgcatatggtgagagagagtggtctagatttcccagcaccgttttttgaagagactgtcttttcactatgtacgttcttggcacctttgttgagaacaagttggctgtaaacatgatgcttggttttaaacgttcttacttatttttgtggtcatctggaatgctgtgtcatttcttctgacctaattatgtttttattatgtcacatctgtgatatcatgaaagtgacataagtaaaattcatgcttaaatctcaatattaattttaggtaataaatatagctaaagataagtcacatttctttatttgaatttaaagccaatttccattaggaaatcaatggcagaggaggagaaataggaatttgataagttggtatccagtttttctagataatcattttaagtatttgttctgaaaatcacttttctgatttgttgttgttgttctctgattcagttctatttggtacttcttggtattttgttacctcaaatggtgggtcatgaaaactaataaccattgaaacccttacccattcatagtgagtgacttgttacccattcctttaagcaacttgatttcttattctttttcattatccaaaaggctttttatttatttacttttttttttaagcacaaacacttccttcatgaaaaa

SEQ ID NO: 88939 - DNA, 1072 bp, Homo sapiens
aatcccagcactttgggaggccaaggcaggcggatcacctggggtcaggagttagagaccagcctgcccaacgtggggaaatcgcgtctcagctaaacatacaaaaaattagccaggcgtggtggcaggtgcctgtaatcccagctactggggaggctgaggcgggagaatcacttgaaccccagaggcggagcttgcagtgagccgagatcatgccattgcactccagcctgggcgacaagagtgaaactccgtctcaaaaaaaaaaaaaattgttttaaagtcttagtgtttacaagtaataccaatttttttcctattctagtgttggttcatgaagttttaccatcaattcaagtaatcataaatggcaaattctgcaaaagcagaagaatatgaaaagatgtctcttgaacaggcaaaagcgtcagtgaattctgaaacagagtcttcattcaatattaatgaaaacacaacagcttctgggactgggctttctgaaaagacttctgtctgtaggcaagtagacatagcaagaaagagaaaagagtttgaagatgatcttgtaaaggaaagttctagttgtgggaaagacactccatccaagaagagaaaacttgatcctgaaattgtcccagaggaaaaagattgtggtgatgctgaaggcaattcaaagaaaagaaaaagagaaactgaggatgttccaaaagataaatcttctactggagatggcactcaaaataagagaaaaatagcacttgaggatgttcctgaaaagcagaaagtatgttcagtgtattttcatttattcataatagaatatgtaagtttgaaatgtggaacacccgtggattcatactggtttttacataatagcttaagaatgttctatttttaatagatatggtcctaagacaaagtaggcttttaactcttatgatttctgttaaggtgaaacatctcctgctaatgagatagattttttagtttttgtttgtttttattttctaatgagataatgtttatcttattttagaatatttaactagaaacttttttttccgagacagag

SEQ ID NO: 88940 - DNA, 2217 bp, Homo sapiens
tctagggcctcaggaagcacaaattgaaaactgttgggttacatgtaacatatataatagcattattataatagaaatcactaacgctgcacatagcctactgaattctaatctctctttttttttgagagtctcgctctgttgcccatgctggagtgcggtggcccgatctcggctcactgcaacctccacctcctgggttcaagcgattctcctgcctcagcctcctgagtagctggaattacaggtgtgcaccaccatgcccagctaatttttgtatttttagtagagatagggtttcaccatgttggccaggctggtctcaaactcctgacttcaagtgatcctcccacctgggcctcccacagtgctgggattataggtatgagccacctcacccaggcctaatctctttatatacattatcttatttaattttcacaacagctttataataataatgtaattatagcttattcctaatttattcctttgtagaaacaccaaacattgactgtcatttattgaactgaataaatcagaactctggaagagtactgggtttattaagacattgacactaaaattaatgcagatgaaatatcacaatgaaaattttaaacctagagatgtttttcaaaataaggtgatatggtttgggtgtgtccctacccagatctcatcttgaattatagctctcataattcccacatgtgtgggagggacctgatgtgagataattgaatcatgggcgcagttccccatacttttctcatggtagtgaataagtctcacgagatctgatggttttataaggggtttccccttttacttggctctcattgtctcttgcctgccgccatgtaagacctgcctttcaccttccaccatgattgtgaggcctcccccgccacgaggaactgtgagtccattgaacctctttttgtttataaattacccagtctccggtacgtctttagcagcaacattaaaatggactgatacacagggacacagaaaacaaatcttaggtctaatgataattagtgagacttctgtggttaattgccattgtttagtgaagtttaccaattctaatagcattttatccattcacaggtcaaatgttctgaggcttatttttaccatgttctgatccttgatttttttctattctcttttattttcagaatctggaagaaggacacagctcaacagtggctgcccattacaatgaacttcaggaagttggtttggagaagcgtagtcaaagtcgtattttttacctaagaaactttaataattggatgaaaagtgttctcattggtatgatccaacaccaagctactgagtctttaattcctattcatttaattatcaaaccttgactttataaagctagagccaagactaggtcttgaagacaaattcttctaatatttacttttggttgactgtgtaagattttaatgagtgtttaattattatgttaatcaggttttcagaaggcaatattttttttaatgcacagaattaaggttacctagtactattaagtaatgattctattttactctaatagttttggagcaactgcatattgttggttaaacattcaggtttcattaagtcaagaaataggcagtgtcttgatttgtttaggccttcaattagttgataaagatcatgtgtattacattgaggatagataaaaacattcaacttttttgagccaacattttatctatggaaactcacctttgaaattaaaatgaaagtgaacagagaaaatatgattcagaatacaattcttgtcggcaccgtaagatagggtaaaaaaaagaatataattattgctctgtatatttagtgcattaagtagactcttagataaatttagagaactttaaaaagtggtttgttttaaaatttttcataataaagatttttttaaagccagtcaaagaagaagtgagaatgctttcttaattatgctagaaagaataaagtgctaattatgggtacttcctactagttttgatgataatttactaattttcaaagataaattacctaatctgataagtattagcagtaggaactaactaggcttactttgaacacattttaacattttgtatatcacttgtttttaacattcatgttctgttacaaaaatatttatttgactctgccatgtgtcagcttaggctaaat

SEQ ID NO: 88941 - DNA, 1002 bp, Homo sapiens
tctaggattcagtattgtatcaagttttagaactgttgaatacttaacttgcctgagaatattaatatgcttttaatcgacgtttgaacaatttgcctattgatgtttggttgcctactgattttatctgttggctgttaatgtcatttagtagactggggtctaccaaatactgatgatgctaaaactaaaagacatagtgctttttttttttctagtttttatatttctcttggtggtaagcctgacatctttgataatcaggctcttttatcattccataacaactttgatttacttacgtgtctactgttaaacacctagctatggaaagagaaagctacaaaaaaaaatatgaataattagtttttctaatccttacttagctttttctctcatcctgaacaagtgttgtgttgtcttatattagaattttaaatatctgctatttaaaattcatttttgaaagttaacattcaaaatgctgcctttattttccaaaacaccagacacgtactctttaatgatagaggatcagattaatcaactcttagtcatatttttagttacttatcagaagttacaaattacataaatggatgtgtaatagtttatgttacatattgggcaaaagatagtaggttattagaggtaacagtttatacttcagtaaaattgaagaagaggtagtttattgtgactgatttctctcttttaggagaatttttggaaaaggtacgacagaagaaaaaacgtgatatcactgttttggacctgggatgtggtaaaggtggagatttgctgaaatggaaaaaaggaagaattaacaagctagtttgtactggtaagataaataatgatatgggaaagaataatttgtagtcagataaatggaaaataagaaggattgtctcaaattgcaagatatctgggactatgcatgagatgggttttttttaaattaattacggcctgacgcggtggctcatgcctgtaatccaa

SEQ ID NO: 88942 - DNA, 1996 bp, Homo sapiens
aataatagatctaggcaataattttttttttttgctacggaagccattaagggaaaagtcgatagtaacgcaatgaatcaatcaatcaatcaccttagcccggtggttagtcttaacactgaagtgggacaagcagacgtcagcgtctttctgatgtggtgagttaaaagagatacatacccccactactgaagtactgcccaaattagcagttctcagattttttggttttatgagccctgtatacttaaaaattattgaggaccccagaaagcttttttgtatgtaattatggtaagtagctactgatatttactatattggaaattaaagctgagaattttgaaaatattttttagttcattaaaagtaacaaggctggcttttacatttttgtaaatccctttagagtttgaaattgcaggagacaactggattctcacacctgtttctgcatccaatatgttgtgattttattttggttgataagtagttgtaaaataaagaagtattttaatagccttttttgataattgtagatattcctctgttactacatcaaaactcagtaagtggtagtttcttaaagagtagttacaatatggaatctgaaaccttagtgatgaactttttataccgtgtaacattaaaatccattaatctgtcttgcacttcctgcatgattttatagtacttggaaaatactgttcactaaagttatgcagatctaattgttgagaatcaaaaaatcacgtgtttaatatcactgccaatcagaaaagtattgggaagaagtccagcccacagtgatcaatacgagtttttcagggttgtaattcttatttgaaagtcaattttatttttggcaacaaatacactgtcccttgtctccctttaaattagcgatccctaacctttttggcaccaggggccggtttcatggaagactgtttttccacagaagcggggggatggaattctacctcagatcatcaggtgttagattctcataaggagtatgcaacctagcttgcctgccactcacctcctgctgtgcagcctggttcctaacaggccgtggacctgtactggtttgtcgcccaagggttggggaactttaagtgacaggttcactttgttcattttcaagaaaatatgtgccaggtactgaagtctgcataaccgtagtttgtcagtcattcaagtcaaaataattttctcagaaaaaaagtggccagtacagctcaaaactcagaacagtcatatcagtactgttcttgaagatgaccatcatactttgttaggtagcagaaatgttttgttacttcccatttcatcacacaacattttaaaaagtgtgtattcaaaagcccaggtttaataaaattaattttcactattttataaagggtattcttaaatgaaactgtttttctccccctgcatattgtatagtggtgaagaatacatgaagtactgccagtaccatttagtgctgctactttgtatttgtgataagatcccattgcctttgcattatcagtgtgaatctttaaacagggaaaagggcaggctgggcacagtggttcatgcctataatccccagcactttgggaagcaaaggagggtggatcacttgaggccagaagttagagaccagcctggccaatgtggtgaaaccccatcctctaccaaaaatacaaaaaattagctgggcatggtggcacacaacctataatcctagctactcgggaggctgaggtatgagaatcacttgaaccctggaggcagaggttgcagtgagtgaagattgcaccactgcactccagcctgggcaatacagcaagactctgtctcaaaaaagaaaaaaagaaaagggctaataacattttattataaaaatatacccttggtatttccaaaactgggcttattgatagtgttaggttttataattcagattggaataaaactttctcctttttactttgaataa

SEQ ID NO: 88943 - DNA, 2015 bp, Homo sapiens
aaggcaggaggattgcttgaggccaggagtttgagaccagcctggacaacatagtgagaccttgtctttacaaaaaatttacaaattagccagcatggtggcacgcccctgtagtccttgctcaggaggctgaggcaggaggatcacttgagcccaggagttggtggctgtagtgagctatgatcacaccaccacactccagcctgaatgacagattaagaccttgtcactttaaaaaaaaaaaaaaaaggtagcccagatataattaaaaggctaatcaagtgtgcatcatgtagtttttcacatgcataatctgatcaaaataagtctacactaatcacaattttaatctttttattttggttgggggataaccttgatagaagacgccttgaagcttcagaaacagaatcatttggaaatgaaatatatactgtgaaatttcagaagaaaggagattatcctttatttggctgcaaatatgacttcaacttggaaggtgttgtggatgttcctgaattcttggtctattttccattgctaaatgagtaagaagtcattaatctgttcactcttttctttttgtcttaagggaaagaaaagcggggaaaagcaatatttattttactctttattttaaatgagggctaaagaaaaagtataatcttgtttttttgtttttgtgtttttaaaaaaaaaaaacaaaacaagactagcttcacatctaggggattattgccataggtctcataatagcctaacttagttttctctcattcctggaattttttaatcctgtgggtgaaaaagggaaccagttgccttcagcttgtggcacaaaatgcctgacactgcaaatagcaaaagttttttttttttttttagtgactactggtaactttgatgataaacaatgagtcttcataaatcaaagatccggccgggcgcggtggctcacgcctgtaatcccagcactttgggaggccgagacgggcggatcatgaggtcaggagatcgagaccatcctggctgacacggtgaaaccccgtctctactaaaaatacaaaaattagctgggcatggtggcgcgcgcctgtagtcccagctactcgggaggctgaggcaggagaatggcatgaacccgggaggcggagcttgcagtgagtcgagatcgcgccactgcgctccagcctgggcgacagagcgaaactccgtctcaaaaaaaaaataaataaataaataaataaataaataaataaataaataaatcaaagatcctccttttgacagagatgagtattaaaagttgtttgcatttcactataactttgaaattgcctatgtctcacaggcaatgttgatgataaaatcctgattcaggaatgtattctcccatgtgcctgaattcctaggagtcctggcaaactgtagacacaggaaaagctgggggtaactgggccttaccaggtaaggcttcaaggccttgtgatacaccttggtttccagagtttccccggtggggagagtataaaagtcagcttaaatgtaggccatgtcatgattgattgaacttgattttctactttttagaaacaaaaatcttttgttttgaatattaactgagaaaaagaagaggtatattgtctgcttacttctgcttggtgcttattttaattgtaactcagtcagtctgtaaaattagggttacagtattttcaggagttctataatagcttattcaataatataagaaagccaagtagcattgtgactgaacatgaggaaaatactgtgcataattttataaatataaaccatttacaaaatttaaaaatatcaattacattttccttttaatttttaaaactaataaactggggaaatgttactgctcttcaactttatttaaaaaagaacttaattgtggaatgttattgagtatgtttaatatgttagcttgagattttagttaacagtttggtgattttagtataatcaaaaagataataaaacaa

SEQ ID NO: 88944 - DNA, 2258 bp, Homo sapiens
aacggagagacctaatataattaagatttaaggaaggtgcctgtaaagaatcgatgtttgagtcaggatctaaaggatggaaaagtaggtgggcagctgaggactggagggaagaatgctcctgacaagaggacagcgtgtgtgagggcccagcagtgggaaagctaggctagtccaagatgttgaaagaaggcccatcctgatttatatcgggggctgtcccaaaatgaggcagcattcctttacagatgaatgtcttcgagaccatgttctgtatcctaagtgcactggagcccagtggagggtgttaagggggtagtgacatgactcaggtccgcatttctgaaagcttaatctggctgcgattggaaaattcattgagggagagtaagaatggaagcaggggacaagcaaagtgagtttatggactggtgccactgagtggtgatggtgactgaagcagcaggatggtgccaaatgcaggaggtaagaagtggacctatttgaaattgatgttttctaggtaaaatagaaaggacttagtgatgtgtattgagcacagtgggtaaaagagaaggggagatggcatggatcactaggtggatttactgaaatggcaaagattggcagtaaaagagcagtgatgttcagccttagatgtgggacgttagagagtgccagtgacacatgcaggtgaagatttctaataagcagtagaatccatgagtgatgagagacagctgaactaccgatagctggggggtggaagtgagtagggctctggactgtactctacagaaccttgaagtttagaagttgggtaaaaaaaaacctgtaagtgaaaaggaaaaaaaaaaaacctgcaaagaagcagttcatgatgtaggggaaaaattaatagtgtatcttgccagagaagtcgagatgaaagtgaatctttaagaaggaagttggcagctgtttgcagtgcagctgtgagagatcaagtaaagtgaaatggaatcagtagaaaagagtttcctacactttttccgcatctcacagctccggagactctcatttacttcctgacctttatgttatactaatagagccctctgaaacccctgagatttagaatgcatgtttcttttaggtgtgatatgttactcttgattcattttgtattactgtattgtgaatttatcaagggagtggtagcttttttagttaagtccagaagatgtcattgctgtacaaaagtaagttgaggaattacaaacatgtggaagctttttcattaagtattcttttttggacagaatggcaaagaagtacaatatgaaactagtctacaaaaaaacatttctggaattctacgaagaaaagattaagaacaatgaaaataaaatgctcttaaaacgaatgcaggccttggaggtgagtatttagaaaagatgtacaaatttcagtcatggtgaacttgtttggctgttcttgagatccttgcaaggccatctgaacatgaaatagttatgtgtattacgctcttcagcacctaggacggagcttgatacagaaactgcatggtgagtgctcagtaaatacttgatgaaagaatgagtactggtgttaccaaattctgttttctaggatagtactgctttaaaataggatttctcagcctcaggactgttgacattttgttctggataatgccttgctgtgggatgctgtgcattgtaggatattcagtagcattcctggcttctacgcactagatgccttccagtaacactcttgtccccagttacgataaccagaaaactctctccagacattgccaaatgtcccctggtggacaaaattgccccaagttgagaaccagttctttacaacagtgccttttggttacgacagtaatttagaaccttcctggccagtgtccagacaagctcaaaccatacataattttattgcatggtaattctttagcagggttccagtcttttagactgtgttgttgctgagacctctcctgtcctaatgcagcagtgaaggtatctatataagcttcaattacacagccattgattgtttttcctttttctccttaccagacaatgtttggttggacagacctaaaatattcagtgagcatttttattattgatcagtagaatcatattcatcaaatggacattaaacttccttagagagtttattcagtttaagtactttaagcatactctgacttctttatccttataattacctcc

SEQ ID NO: 88945 - DNA, 3581 bp, Homo sapiens
ggatgaagctgaaaaccatcattctaagcaaactaacacaaggacagaaaaccaaccaccacatgttctcactcataggtgggagttgagcaatgagaacacatggacacaggaaggggaacatcacacaccggggggcctgtcatggggtgggggcctgggggaggtatagcattaggagaaatacctaatgtaaatgatgagttgatgggtgcagcaaaccaacatggcacatgtatacctatgtaataaacctgaacgatttgcacatgtaccctggaataatataccctagtataatatttaaaaaaaattggtttaagagaggattcttccttttttttaatttttttctgtatttcaaaagtatgtatagtttgtattcctgaagtagtacttacggattattctcctaattatgttatttcagtgatttagcatgtttaattctgaattgtaaatttccgttattgtaactaggactttcatttctttccccagccatatcctgcaaatgagagttctaaacttgtctctgagaaggtggatgactatgaacatgcagcaaagtacatgaagaacagtcaagtaaggttacctttggtaagttttaatttatgaaagtattttatagagaatgaaaaaaagaacatgcttatatggagacataggaaatgatttcacttgtttacaatacttaggctcactgacttacaaatcagttgtttccactaagtgatgttgacttgttataaccacagaatatggaataaaatttatttcaatggactgagaatggagtgctatatctaaggcaatgaggacagtgaaaaaattacagggttggtgtgcaagttccctgctaatgtaggcaccaatgaaccacagcatttcatacatagaatgcagcagtccaggaatttaaatgggaaaaaattacatcttcacctatactaatttctgcgtaaaagtttacattttaagaatgattactacaatagtaccacagtggtattagctgctgctgtgactttgtcatcagtagaagttacagatattttcatagcacatttttgctaatatcttagaatattgttttcatttatcacatctggaaaaatgacatcactagaactgccactagatcttgttattatagttaatggtgtgtgcaaagcaacacatatctttaatattttgatagctacataaatataatttatttcctttgtgtgatatgtactttattttgttattcctttgaaaaaacacaaaaattgtattttttccaccagtgctgtttgatatttcaagataggccttttttattttttcattttccaaattaagaatacaagatagggccgggtacagtggctcacgcctgtaatcccagcactttgggaggccgaggcaggtggatcatgaggtcaggaaatcgagaccatactggctaacagtgaaaccctgcctctactaaaaatacaaaaattagctggacgtggtgacgggcccctatagtcccagctacttgtgaggctgaggcaggagaatggggtgaacccgggaggcggagcttgcagtgagccgagatcgcagcactgcactccagcctgggcgacagagccagactctgtctcaaaaaaaagaaagaatacaagataggccgggcgcaatggctcaacgcctgtaatcccagcactttgggaggctgaggcgggcggatcacaacgtcaggagattgagaccatcctggctgacacggtgaaacctcgtctttactaaaaacgcaaaaagttagctaggcgtggtggcgggcacctgtagtcccagctactcggcaggctgaggcaggagaatggcatgaacccaggaggcagagcttgcagtgagccaagatcacgccactgccctccagtctgggcgacagagcaaggctctgtctcaaaaaaagaaaaaaaaaataatacaagatagatgcattttccagttacacacacacacacacacacacacacacacacacaatgccctcttcacacacattcaccctttggatgagaatttgagaatttggcaggaggataaaagtctgagaagatgactttcaaagtgaatctcaccgatttcttttatatgctcaggtcacaatatgattaacagtgaatcgaatgtgtatttacagtgaagttagggtcttttggccatctctgcccattatttagaaataagcatatgtttacttccatattgaatctaaaattttctttttctcttttgtaattttagggaaccttaagtaaatcagaatgggaagctacaagtgagtatatcatcagcatagattaactgataatttcaaaagtcctgtttcaaagtgatcattaaaacctgaaaaaaggctgggcactgtggctcacaccagtactctcagtattttgggatgccgagacagacagattcctcgagcccaggagttgagaccggtctgggcaacatggcaaatgcttgtctctaccaaaaatacaaaaaaattagccagtcatggtggcatgtgcctgtagtccagctactcaggaggctgaggtgggaggattccttgagcctgagaagtcaaggctgcagtgagctgtgattacatcactgcactccagtctgggcaacacagcgagactctcaaaaaaaaatctgaaaactttgagtttttctgacattttaggttgtgtttgtgtttacacacacacacaaatacgtatatctctacatatgtctaatcctcctttcttgcacagctgtgtagtgccaagagaagatacactgtacacagggtcttcctcagcataaacttgagtgagcatgtgtaaacattctcattgcctatttgttactaagtagccatctccatttgaagtgtttacctcagatttctactggaatttttggcttatagaatacttgcatgtcttttttttatttggccactctgatgtgacagtgaaggcataataatactagaacattcaatgaaacatccatgagcaggatgtgttagaggtgtgcatgataggggacaaatgtggtgcaaagatattctgaagtgaggttcctgtgttcagaagagaagccagaagcacagcaaatctgtgaaggcctgtggttcttcagcagtgggtgttgaggaagtcaggttgcagagcctcattgttactgtaggaatccccttacatggttgttggtgatgttgaggcacaagtggtcattaaggacaatccatttgataaacattattgatttacgtgaagttctgtgaaaggtaaagtaaaataaagatgttaaatctctaccttctagaagtctacactgtaatggaaggaacaggcacaaataaacactactaggcaaatttttaagtgctaatgatactgtagtggggcacaaaggtgaaagagagcttaatgaaaactaaactaatgacatctgggatgtagtaatattgatattactgagtgttgaacatgtgcaggtgcgtgtaacgtttttaatccttgtaataactcacatgttgtaactcatttaatcct

SEQ ID NO: 88946 - DNA, 1026 bp, Homo sapiens
cagtagtcccagaggggccgtgttctgtcctgcacaaatttgaacaactcatctcgatatatttgatatttctctgtctgttgattttaattctaaatgtgcaggatgctgccagaaactccaatgtagaaattcaacatttgctgtctgtgacagatgaacttttgcatgtgtatataagaatgagttgggacctctgtctttaaaaatctatttttaggtaatgttctaagaattccatttgcctctatgatcttagctcataaaaatataatatgacttgataaagcaactaaactctttccacagtgttcagatttgtcctgtgtgtgtttacagtattcaatttattgcagttatagaattggtcagagagcattttcatagtgtgctcatttctatggttttgttatatagcatttttcaacatttaatggtctgtacagttgaatgtaagtgttcaatatgtattgctgaagttataagtttaaaactcaatttcagatgctcataaaagttacttagctaaaattttagcaatttattgcattttgaaataatcattaacatgctgcaattcaggagctggttagaacattttaagtggcagcatagaattttggaattttggggctttcttttcagaaattgctaccatagtaattaatgtttccagttatcaagattgtgattagacacatttacctttcttcattgaacaaatggtgccatagttatttttctcaaaatttagtgaaaatccctcccatgtagacatgttgcacattttttccaaatttatacatggaactgcagtaggaatattctcaccatctgatgccatgtacccacttcagaaataagcaatacttgttcctctgttacaacctcagcactttgcaccgtaggagccattgttaaagttgtcacttgtgtaactgactgcttttccaaaactggtacttatgtgaactgttgtccttgctttacaccaccatttggaaaacttaccagtttttagatgta

SEQ ID NO: 88947 - DNA, 1035 bp, Homo sapiens
taagccatgatttacaaaaacattactttctgtaattcacaatacttgttttaaaaacatagtgtcttcattagtgtgcatctattaactgttcatggtgttagagttgcaaactttttagcaagaaaatatggatttcctcatttcagttccttctgcagcctgtgaatctccacaaagtgttaccagtttacaaaaataagtctttttgccttaagtcattttggaaataagtaatactgcatctgactctggtggctgtattagctaggaaaggtttgtaaatggtgtcagtgaggtggggaaaggaagtcttcctgtcacatatgcaggttcgttttcattctagggcagtgccaggaagtatattgatagctttgtaggtacaggaaaaacatcatcattatttcctctgttcacatttactggtcttaattaacaggtaataataatacatgtacttttagcctgaaacctcttccacgccatgggtaacttgggggagagaagaatcctccaaacgatggagtagccagtggtaatacaaagcagggagaacagaaaggtagagttactaaggccttcagtgaacagaaaggagcagagagcaagattagatctgagaagatgctctggggactgagcccactgttgttggtgtcagggaggcttactggagccacacctgcaggcgctgtgttcaggcaccaccttcctccttgagctttgcctgtctcttgccttatcagttcttcctccaccaccctacacccccctccccccggccccaagcccctgtgtctccttgttacaattaagtttctggatattgacttaagaactgttaggaagaggactagaaaaggcttcccctgcctatcctctccgatcaccaaggtggaagggagctagtaggactcttccttgacacaccttgtcgtctaaatgttcggtattctattcaggacttacggtaactattatgagggaggcatggctttccaccgtcgggccaggaagagcacctgttgctgc

SEQ ID NO: 88948 - DNA, 1064 bp, Homo sapiens
tgggggcaacataccttggacaaagctgagctgacagctaatgtttattagcctcctacctaagtcagtcactttgctaaattcttcacctgtggtaactcattttgattgttataacatctcagcaccgttattcccattttaatgatgaggaaactgagtcatagaggatacagacttgcccaaaggagagccaggattttcacaccccctcctcaagctgggcctgccctccaagtgcttgttatatacctccacgggtgtcagcccagatgactcctcacccatccaccacctgcagcttgagatgttaactattagagctccattcttttggttcaaaacgttgatacttacttagatgttccctgagaggagtgtttatttctgagtaaggggctttgttgaaagagggggttagagagagcaagacagcacttgagtgcactggcaggaagcagagataagacttgaatttcagtttggtagaccaccttctttagcagcccaacctgtagcaaatctagtttagcctgcatggcagggagagggattctcttcccaccctcaccatttgcaagtggcaggagctgagaatgccagtacgagagtgtagccaaagtgagaggctgagagcaaaggagacatttttttcagttttgagtcgagtatccagacagaggcaaatcattttgtttaactttttattaaagtgtaactatagaaacacatcaatgatttttcacaagtggagcacgtgcatacaatcggcaccccagaagccccccgtcagattcccttccagttaactacctctccaagggaaaccactatcctgagttctaagcgcatagattagttctgtctggtttggggagatatataaatggaattatgcattcttcgtatctggtttcttttcaccaatattatgtttgtgagatttttgttgcatgtatttgtacatggattttcattctcatggttgtataatatttcattgtgtgaataaaccacatactgtttatctgacagctgtttggttcatttaccatttggaaact

SEQ ID NO: 88949 - DNA, 1113 bp, Homo sapiens
tgctggctgcactctgagctatgcatgcttttcagggaagaaaagagtggccagattctttccatcagaagcaatctgttcatttgttctgaaatgtcttctttgctccccttgcctgaacttttgattcatggcttttgttcataattgtctgaataattgtacttctgtcaatcatggtgttgcgcttacccagacataaaaccttatgctagaaaccctgcctcatgtgctgtggaagactctgtgactctttcttactgtcttatttgggctcaatctggggtttccaaaaggatgactgggggcattacaggggctcaaggagttcaaggtgcccagtgctgcaagtagcacacgtccacagccaggcttgctttgagtggctcacaccggatctgtgttggagtctgaactctggcctgtgtacttggaggcatgtcaatctcatttcagcagccaacaaaggtcagggcccaacctatagcccagggagccccatcttctcccaacctagactggagcagagaaacccgagttcaggtgctaattctgcctttcactgctgtgtggcgtgaatcatcttatttcaggttccacatctgtgctgactgtacacgatggccatgagaactgcaaaattgtgtgagcttcttgtaaatttgtaaagcactatagggtttgctttttattttaaagaaatgctcggattagaggtgtgagccagaggttgcagtgagccaagattgcaccattgcactccagcctgggcaaccattcaagactctgtctcaaaaaaaaaaagaaagaaaaagaaaaagaaaaagaaatgactagatggggtaaatactaaggaaggacacgggggccaatggtcagagcagtggcctggacaccaggaggcttgtgtggtccttctctgaagcaaagggctggagtccttgcagctctcacagtccactcttgtaataacttttggtatgattcctattttctgctttgtattggacattcacatctagactgcacccaatgaaaaaaatgtatataaagcagaggaccattgggtcacacaacagtgagctgctagtgcagaagagggacccttcctgt

SEQ ID NO: 88950 - DNA, 2278 bp, Homo sapiens
atttttcctattccttgttttccaaattttgtgtaattgttaattattttatgtaaagataatgtatatttacctttcctcctaatgtttgtttcttgtatttttaaactgagtgcatttcttaaattagttttttccccctccctcaacagttaaccatgtgactgagtgccctgtggaatcgtgtgggatgctacctgataaaccaggcttctttaaccatgcagagcagacaggctgtttctttgacacaaatatcacaggcttcagggttaagattgctgtttttctgtccttgctttggcacaacacactgagggttttttttattgcgggtttgcctacaggtagattagattaattattactatgtaatgcaagtacagttgggggaaagcttaggtagatatattttttttaaaaggtgctgcctttttggatttataagaaaatgcctgtcagtcgtgatagaacagagttttcctcatatgagtaagaggaagggactttcactttcaagtggaacagccatcactatcaagatcagctcatggaaggagtaaagaaaatatctcaaaatgagacaaactgaagttttgttttttttttaatgacttaagtttttgtgctcttgcaagactatacaaaactattttaagaaagcagtgatatcacttgaacttcagtgccctcactgtagaatttaaaagccttactgttgattgcccatgttggacttgatggagaaattaaatatctttcattatgctttacaaaatactgtatatgtttcagcaagtttggggaatgggagaggacaaaaaaaagttacatttaatctatgcatttttgccaagccatattgagttattttactactagagacattaggaaactaactgtacaaaagaaccaagtttaaaagcattttgtggggtacatcatttctataattgtataatgtatttctttgtggttttaaatgataaagacattaagttaacaaacatataagaaatgtatgcactgtttgaaatgtaaattattcttagaacactttcaatgggggttgcattgtccttttagtgccttaatttgagataattattttactgccatgagtaagtatagaaatttcaaaaaatgtattttcaaaaaattatgtgtgtcagtgagtttttcattgataattggtttaatttaaaatatttagaggtttgttggactttcataaattgagtacaatctttgcatcaaactacctgctacaataatgactttataaaactgcaaaaaatgtagaaggttgcaccaacataaaaaggaaatatggcaatacatccatgatgttttccagttaacataggaattaccagataaatactgttaaactcttgtccagtaacaagagttgattcatatggacagtatgatttattgtttatttttttaaccaaatacctcctcagtaatttataatggctttgcagtaatgtgtatcagataagaagcactggaaaaccgatcgtctctaggatgatatgcatgtttcaagtggtattgaaagccgcactgatggatatgtaataataaacatatctgttattaatatactaatgactctgtgctcatttaatgagaaataaaagtaatttatggatgggtatctttaatttttactgcaatgtgttttctcatggctgaaatgaatggaaaacatacttcaaattagtctctgattgtatataaatgtttgtgaaattccatggttagattaaagtgtatttttaaaagataaaacgtggtcttgggctctaaaacaagagtgggaatagttcacatgaaaagctggctaaagtgtgttggaaaacaattctccatgggtctcttgcatttctacacatcagggaagcagaggctctgacaacctttcttttgactatcttttccaaggatatttatgtagtaaacagccttggaagatagagttctcccttgtgaggatgtcgggttcttttactgtccagtataataaagataacgtctcccacctatgatgcaaacccactgtgtgctcagcacccacctgggccactctgcattgcccacatggggcttggagggcaaagggaactgatggaacgtgaaacttatgctgcttttgctgtgctgtgaatgaagtcatctgactctgacccaggggtctcatctcttttgtcaggatccatgaaactgtgactggcagcatgcaaacaggataaaatctcagcacagttcc

SEQ ID NO: 88951 - DNA, 1130 bp, Homo sapiens
tgtctggcattcactgcctggatcagcatgcatgctgtatcacagaatatcttctagttttacagaggtagcttgagggaaagaatacagaccatagctattttcagataagaagcttatgttctttaaatacatttatttgttttacattttgttatatttctgattttactttattagtttgactaatttttttttttaatttcagccttatttaacttaaggagaatgagatattgttcatgcttaattaagcatattaaaacttttaaaaccttaagaacttgaaaaactatgcatttgataggttggattttaaaaaactatatggctttaattatgctttttttttcctccttaacatagtaagttatgatgtaacatcagcaagagatatgctgctgttagcatgttctcaggatgaacaaaaaaaatgggtaactcatttagtaaagaaaatccctaagaatccaccatctggttttgttcgtgcttcccctcgaacgctttctacaagatccactgcaaatcagtctttccggaaagtggtcaaaaatacatctggaaaaactaggtaaggatttgaaatgctaacgtttttaacaatgtgaaaatgattggataacagctattaaaatcagaaatctaattgtgcttttcaccacagagggcatcatttttaggtatttgtatgtgaattgcagtgactttataaattagtttaacttattcttgttagagtttaataataataatacatgcaatattatatttatttagttctgtgtctaattttattgtcataagttgctgtacatggcatagttttagcccttaatgctttaaccaacttaatttttttaatgcagaaattcatataaaacttttcatcatcttttctgttttttaactgtgttggcatagtttttctacaaaaaccaaaattgtttttcccttttttgttaacttcccatactatcccaacatacaaaattatttggtattatcagtgactatgtttttttaattattatactttaagttctgggatatatgtgcagaacatgcaggtttgttacatgggtatacacgtgccatggtggtttgctgcacccatcaacccatcatct

SEQ ID NO: 88952 - DNA, 1981 bp, Homo sapiens
tgcctcctgggctcaagcgatcctcctgccccaacctcctgagtagctgggactacaggtgcacatcaccacacccggctaatttttttaattttttgtagagacgggatttcaccatattgcccaggctggttttgaactcctgagctcaagctatctgcctgccttggccttccaaagtgctgagattacaggcatgagccacccgcctggccgaccttgctctatttagtgtcagttcgaaatcctgaccaattttatttttattccacccatttccctttaactatttataatgccttatatgcaccttagtgttcttagtattgggttaaatatgtcagaaatggacacattattggtgaatgctagttagaagatttgagttgaaaggtgagctggtgggactgctaatgaggaaagtgattaattttacccaccatcgtggctgattcagaaaggctaagctcatagtgccatcagctggcttcattggcagacttaggctgggaatccatttaggtttcagaatcctgacctaataaattgacttattgagcaaagagatttttaaatgtttctactagctccattttcagtatatttcttagaatattagtgtactttcaggaattttgtttttaaggttatcaaagtccaaaccaagtggggcggggagtactggtagccattctcccttgctagaagaggccagttaatacctcttttcctattactgtgttcttaattttgagactttataaaatctcaacagtgctgaaccttgactttcatattggaagtagaaattaatggatagtctttgtcaatattatttacctctctgtgggtcagatattttgctagtaaattgaaaatctgtattaaatccaccatttactagatgctcaaaaatggtccctggcaaataaagttaaggttttgcattcatatctaggaagaattgttaaagaatgttgatattcattcttaatattagatagttacatatcattcaagtgtctaaaaaatttcttgaaggtaatggctaatgattaatttttacttcagtttagaaaataagtaaatgaatatacgtactaaaaaggagagggctttgaatagattaagtttactccaagttaaaatgatggctttttgaaatatgggtcacatttttcagtttttttttaagtagttggatggataaactgacactgcaacttttattatttctcttatatttcatcattcagtataaagattataatttaattatcttgcacatctagaacgcagcctctatgaatccttagtggccattttgttattaactagcttaaatattaaatctcccttctaaaattcccaattctaaaaactttatttaaaaaatgttactccttctctgacttataactctttgaagttcttgaagtcaccttcattctcttaattcttttatgtctttatcttctctttggttctgtagcaggttgtgacctagcacacaatacaaacataaagattacccttacggttatgggtgcctgttgcctagatgacaaaaaactttaatgtgataactgtttcttttcctcattctttctctttccttcttttggaactgttaacctagacatctgaagagaatgtagaaatagatgatggattaggaaaacttggtattgatactccagtaatattcattatctcttatggattatttgtatcatacccttttccatccagcttgaccttaggttatgtaacttaaacctgaaaatggtggatctcttggtgtgtttcccaatatttgaatatatgaatgtttctgaccttgcccaaatctagtgatttgaagttggtgtatctgacttgttgagtattaattaattttcttttttatatcacttttgaatttaattaaagtgttttgaaatggttctttagccctgtttcttaagcagtatgtttgtgg

SEQ ID NO: 88953 - DNA, 3185 bp, Homo sapiens
cttccacatgattgttatgaggattaaataagacagtagacatagaatgattaatataacatataacaagtaatgattatatattactaaaagtaatctataaataaatgtttttattatcgttttcatcatcaatattcagataaagatattgaagtccagaaaaagtatgacttgctcggggtcacatactaggttaatcgcagagctagaactaaatacaaatttcttagtttgcaatctagttatcttgccattacatatgccccccttttgttcatacatatatctatatgcatacaatgaaataatttttggatgctgttaactacttttaaatatttttgatgtaattacatattttaagctggaaaccagacatttgctgtagttcagcagtgtctgacctgtctttatctagcagtatatttaaaggttactgcctgaaatacgagaatagcaaagaggctggagcttaaacttttgtgtgctttgtttagcttgaagaagcaaacagcatgctaaccaaagatattgaaatattaagaagagagaatgaagagctaacagagaaaatgaagaaggcagaggaaggtatgtagaatttttaaaaaatcatcatgttaaatcaaattcagtgatttatctttacctatgttgtgttaggtttctaagatacctgttttcatatattaagtaacttctgtagccttaagaattatcttaatgaagttactgaaagttactatgtaatgtatacttatttgaataattaaagacattgttagtttgaaatgcagaaattaaattaataccatacaataacatttaatataatttgttgacagaatataaactggagaaggaggaggagatcagtaatcttaaggctgcctttgaaaagaatatcaacactgaacgaacccttaaaacacaggtatacatgctttcgatcttttccacatgttcatttttgagttaatcattgctctttatgcactttttcctaaaaccaaggcttataaggttcaagcttttcatcagaacaaataaattctctccccgctaactataaaaaacttatttgtgaaatagaatttcaaggccaggcgcggtggctcatgcctgtaatcccaacactttaggaggctgaggccagcagaacacttaaggccaggagttcgagagcagcctggctgacatcgaaaccccagtctctactaaaaatacaaaaattagccgggcgtggtggtgcgctccagtaataccagctagtcaggtggctgaggcacgagaattgcttgaacccaggaggcagaggttgcagtgagcaaagatcatgccactgcatgccagcctgggcgacagagcaagacccagtctcaaaaaaaaaaaaagaaataggatttcagttaagaaagctaacttgcctagtaatattgtatagttgtagaagataagagtatgtggccaaggcatagaagctttatttgctagtacccaacatcagagtaggattagcatactcttgattcagtactgggttgtaaagttaaccaaagaaaggctcctggttcttacatttaagtagtgtgataagtcagtgttagttacttgtgctaccagttatcatgtctcaaccatcatgaagttgtcctaattttcatacacacagaaagtcctgcttcctgattttgaagaaaaaaatacattttagtattaaattggatgactacactattgatctttattaataatattttaataggctgttaacaaattggcagaaataatgaatcgaaaagattttaaaattgatagaaagaaagctaatacacaagatttgagaaagaaagaaaaggaaaatcgaaagctgcaactggaactcaaccaagaaagagagaaattcaaccagatggtagtgaaacatcagaaggaactgaatgacatgcaagcggtaaggtttctgtgtgtgtatggatatgagtgtgaaggattattttcttaaattatttctgtatatacttgttatctatttatcttgtttagattgggaacaatcaagggttctgcctgtttggtttcagactgaaattgggatatggctgttataatattaactataattggggtagaggttttgaagtattgtagcttatttattttctctagtcaagactcacttttttgaaatcaaaataacaagcttaattttttgataccccttggcttgttaatagaacaaaattgagaacctggtctcgggcacttagatctaagctttttagctccatcagttatggttttctgaagttttctatacctttaaagctacttcatttggagccagaaaagcattttcttttgttgtaacttttttgttttgatggcttatgtttgaaaacaaaaacaaaaactctttttaaggcaaggagaaaaggaatttgtccgagcattgtattactgagaaagaacttgacatttctgtagtgtatcaaaatctgtggtagcaaacattcatgaagtttactgtacatttttagtattagcaatttaaattatcatatttcaattagtaatgttggaaattgttttagcttgattatattatcttgatacttttcaaaattagcaattggtagaagaatgtgcacataggaatgagcttcagatgcagttggccagcaaagagagtgatattgagcaattgcgtgctaaacttttggacctctcggattctacaagtgttgctagttttcctagtgctgatgaaactgatggtaacctcccaggtaagaataattctgtatcattcaaacatgtataaatgtcatggaaattagtgtatatttctttcatttggttttctacctccttgtcattttgtccatggattcctaagaaggaattcttatttctgatagccaaggcctgatgatgattatacacttggtgtattttgtggagtagagcagttgtaagcaatcttaggctatttaaatagacctaagaagctttacctgaataaaaaccataagaggtttatgaacctattttgagcagcctaagtccacagtgagagtcaaagctgctactacacatctcactattttttaaaagttgtacatttttgtgagtaatagctctttaacattttatgtattcttgtgctaaaactaagaact

SEQ ID NO: 88954 - DNA, 1132 bp, Homo sapiens
agtttaaccatctcattttacagatttgatgaaactgaactgcaggaagtgtaagggacttgcccagtgtctctactcaattagttaatgataaaacagagataaagttctgggtctagcctgctgattaacaagtcaatgacttttccactatgccacgctgccttccattccaaatctgcaagaaatttcttttcaaaagcagactatttgctattgctttatgaccttttttagttaagcacaatatgggatagaaaactaaatagttcttttataatttttcaacatgtgagaggttaaattcattacttttatagaaagtttgcaatggatttaaatttattttaagcaataaaataattctttttatcatttaaagttaattgtgtttttaagaatatgattaagttggaaggatgaactgaatttgtttacatcagtttctcttaaaaaattgttgcagagaaactcttgctactcagttggatctagcagaaacaaaagctgagtctgagcagttggcgcgaggccttctggaagaacagtattttgaattgacgcaagaaagcaagaaagctgcttcaagaaatagacaagagattacagataaagatcacactgttagtcgggtaagtgtgatagtcaggtaagttatataaaatttatttaaatcacaataggtcacatcttaaaatattagggtaagtgtgtgtgcaagtgtatttacttctatgttaatacatagtggtcattctgtactcatgtataaaatagtttgtataataccaaacatttgttaattattgaaattcttgttcaagatattgggcttttgtttgtataggcacagaaccaatgcaatattgggctgtttttctggctgtagatcttattagttatatttcatatgaagtaatggcttagcttaaattcatttgttgttctcttaatacattgcaactgattttatgggccagaattctgtgaaatatagagaaaccatttgggaatgaggaattcttgggataatatataaatccattataagaaaaccaatactccaaacaattacctattcctgaggtttatactgtaatctatatagaatcatgcgactaaaaagaggagt

SEQ ID NO: 88955 - DNA, 1008 bp, Homo sapiens
taatatctagtatgcagtactgaattattacttattaaatatagtactatgatatgtagcactgaattattattaaatttttcatgcccccctctttttttatttactgtacaagacattttcttccctatgactgcttttctctgtaaaaatttaccaaaaatatggtatcaattttattttttcattttggatagatccacaattaatattctccaaaaagtgatcatcagtagaaaagggttctcactacttttgcatagcgtcattttataaggagcaagatagaaccggtgtggcctgaccaagttaattagtaaaataatgaataatgaagtatgtttttaaaaaataaagattgttttagtaaacttttttatattagcaactttaacaaactaagaaaaaatgaagtctagtataagtaggagcgtttgttcacttgtttttcttttcatctgaagacagtatagaggaaatgaaggacagatgcgggagctacaagatcagcttgaagctgagcaatatttctcggtaagtgagaatcatttttaacatacacactgtttcaaaacctgacttaaaacaaggtatttagattcttttatgtgaactgtaattctttttcaaatgactcttcatcttctaataaacattgtgacttttctgctttttgtttgtccatttgtttcttggcatattaggctatcattggtatatgtttttaaattgtaaaaacttttcaggccaggtgcggtggctcacacctgtcatcccagcactttgggaggccgaggcgagtggatcacttgaggtcaggagttcaagaccagcctggccaacatggtgaaaccccgtctctactacaaatacaaaaattagccgattgtggtggcaggcacctgtagtcgcagctactcaggaggctgaggcaggagaattgcttgagtccagtagttggacattataataagccaaggtcatctgtgctgcagcctgggtgacagc

SEQ ID NO: 88956 - DNA, 1179 bp, Homo sapiens
cacctgcctcagcctcccaaagtgctgggattacagacataaaccactgtgcctggcccagaagtgagttttataatcaccttgtactacagaattttcatgctgattggggtagaaaggaaccagaatttttttccctccacaagatctcatgtctgaaatttgggaattaatttgacttaatagtaaatctactgtaataaacacgtggaacaatgaagactctttaaaatactaatattttctactagtaccatgaattataatgtacttgatttggttagtagtctttcaaataatgtctaataaattatttaagagatttaagatcccaattatttttctcattcataggttaagaatctaaccctgcaactggagcaggaatcaaataagcggctgttgttacaaaatgaattgaagactcaagcatttgaggcagacaatttaaaaggtttagaaaagcagatgaaacaggaaataaatactttattggaagcaaagagattattagaatttgagttagctcagcttacgaagtaagtctttaaaataacattgtgatttctttcttttttgtgttcatcattgacttgtgtgtttgacattttacatatgtacagattatgtacttagagtttgtgaaagacagaaaaaaagtatttagaagtaaaagaatttacttgcaaaggttttcaggggagttcaggctttggaaagaccacagttttctcatctgattttcatgtccacaaaagtcatcacatttcttcaggttagaattacaaaaatcacggtgccttgtaggagatgttcaaggtttatttcagaggctagaattagacatgacactttgttcgttttgttttgtgtctttggttcatctcaaaatgcaaaaatgtcttttttctttttctgttactcttgggatgtgatatgcctccttatttgaaatggagaacaagcaagatcaggaacgctttcacaatttgtcgaagaatatgcttcacaagtttaatatcaaaagtggatatatcttatgccaagtcttgtgtttttatttcctccacgtttattttatcatatcatcacttgctagcttcatttacaaaagtgattcttggattaaattgtcagttttcataaaattggatttatattggtgaaattcttttcctc

SEQ ID NO: 88957 - DNA, 1050 bp, Homo sapiens
cagtaataattaaaagaggtatactactgtggaatcttattcatctgaattgtataaattggagttcctaccatagccttaagcctcttcaaccttttctggaacaatgcagggtataaattaataaccacagccttatttttctgcttttgcttgatgtatgttcattgttctttgttaattcacttcctttctagctatactcttcaccttcttgtctgaaagtggtaccgattaatctctcatcactgggcaagagctgggtttagaagattttattactgtattatattttataactccttttctttagagatttctgctatataaatagtttacataatgtgagaatttctataattactagctctattcaagtcccagaataaaaacaatagagacatttgaaaccagtttacagcccatataaagtgaaatgtgttaaagtactctttctttaaatgtatgtttgtaactttttgctttcccagagatggaaaaaaagctgaaagaagaaagagaagctcgagagaaggctgaaaatcgggttgttcagattgagaaacagtgttccatgctagacgttgatctgaagcaatctcagcagaaactagaacatttgactggaaataaagaaaggatggaggatgaagtaagaaaaatagtactgactttgttcatctattaaaagagaaacggttatataagttatgactggagttatctataatttaaacaccatgaaggagatttgaatgaaataattgacatgggtctgtgttcactgctgtatggtcaccccagcacctagaattttcctcttcaaatagttattgaacattcactctgtgtgatctatgccatttttcactatgacagtacaactatattgaaatgtcatagttccttccctgaaaaaactgaccatctgctttaaagaaaaaaaaagtctttattataatgcatcttatatccccaaagaaaagagcattgctcttagatttcaataaaagtgtttaactgcagtctttcctggcttagattgatagc

SEQ ID NO: 88958 - DNA, 1046 bp, Homo sapiens
tgcttaaaaattagccaggtgtggtggcatatgcctgtaatactagccactccagaggctaaggctggaggatagcttgagcccaggagttcaaggctgcagtgagctgagaaggtgccactgcactccagcctgggtgacagagtgagacctcatctctttaaaaaaaaaagaaaagaaaaaaaaagatggtatcagaaatttttaaataaactgaaaatttgtcttattcatttccgatcttagcaatgaactgtcctgaacataaccaccagcacagccttgttctgccctccgccatgattaatgattcaaatgggaagggagggggtaaagaaaagattatcttttgcttttaattatatgtgtttattgtgatttttaaaataaggcatcatatctcttccagaatattaaatgtaagatttactaacatgcatgccttctgcacagtttattacatgactcctactcccattttacaggaaaagaataatttagagatagatttaaactacaaacttaaatcattacaacaacggttagaacaagaggtaaatgaacacaaagtaaccaaagctcgtttaactgacaaacatcaatctattgaagaggcaaagtctgtggcaatgtgtggtaagtgtcagttttaatatttttacaaaattgactttaaatagtgactagaaaaaatttggttttggtcaaaattttgtactctttaactcgtagaaagtataatataaattataggcctggcacagtggctcatgcctgtaatcccatcactttgggaggctgaagccaatgggtcacttgaggccgggagtttgagaccagcctggccaatgtggtgaaaccccgtctctactaaaaataaaaaaattagccaggtgtgtgtcgcacgcctgtaatcccagctactggggaggctgaggcaggagaatcgcttgaacccaggaggcagaggttgcagtgagccgagatggtgtcactgttctccagcctgggcaacagagtgagactgtgtctcagagaaagaaatt

SEQ ID NO: 88959 - DNA, 1435 bp, Homo sapiens
caagagtacttgtctatatatgcttaaattaaatatatattagggaggagagccagttaagggagactcagaaggggcaaaaatgactaaatggagaaaggaggacttattctatactatctaccatttggtaccttttaaattttgtatttttattaagatattgaattatcaagcaattgaactcttgaaaaataaataatattaaaactagctttataagtatactatcagtgatcttataaagggaataaaggagtttgagatttacaacagtaagaagaaatctttttgcactctgtattagaagataatgttctactttttaatgaatttaaaatgcaggtacttccaaattggaatttggctttgggagtggacctaatgtagctgactattatggcctaagactaaatgtctttttttaaaaaaggatttatatgtttcccctatgaaaatgttgtaatttctatatattattctttcattttctagtttctacattaaaggatcagttggaagacttaaagaaagtcagtcagaattcacagcttgctaatgagaagctgtcccagttacaaaagcaggtaagtgtttcaaatgaggttcctttttaaaaaaattgtagataattaaattatatcgtactttggtcagaaacctatttttttgctttctttttaaatagctagaagaagccaatgacttacttaggacagaatcggacacagctgtaagattgaggaagagtcacacagagatgagcaagtcaattagtcagttagagtccctgaacagagagttgcaagagagaaatcgaattttagagaattctaagtcacaaacagacaaagattattaccagctgcaagctatattagaagctgaacgaagagacagaggtcatgattctgagatgattggagaccttcaaggtaatattttttcttattgtggtaaaatatacgtaacatgaaatttattataacattttaaccatttttatatatacagttcagtgggattaaatgcagttcacaatgtatgcaaccatcatcatataagtggaatcatacagtgtttgtccttttgcgtctggcttttttcacttagcacaatgtcttcaaggtttatccatgttgtgtgtgtcagattttccttcctttttagggctcagtaatattccatggtatgtgtataccacattttgttcatccactcatctatcaatggaaggaatattttataatttttatttttaattgttaaaaatatataacataaaatttaccatcttgaccatttttaagtctaagttaatatatttatgatcatattaccctcataaagaaaatgactttggtgaaaccagaaatggttgcattcttttttattgtttacgtttttttgagataggaacttgctctgttgcaca

SEQ ID NO: 88960 - DNA, 1127 bp, Homo sapiens
aactgtattcaattaacatacatatacagaagagcttcagggtggtttttgctgaagcattctttttttttttttttttttttttttcgagacagagttttgctcttgttgcccaggctggagtgcaatggcacgatctcggctcactgcaacctccgcttcctgggttcaagcgattctcctgcctcagcctcccgagtagctgggattacaggcatgtgccaccatgcccggctaattttgtatttttagtagagacagggtttctccatgttggtcaggctggtctcgaactcccgacctcaggtgatccgcccaccttggcctcccaaagtgctgggattacaggtgtcacccactgtgcccagcctgctgaagtgttaactttttgtatttttatcaattattctttgacttggtttctgaaacactcaagttgttgatataaacaaccgccaatgtttttgtattttctgtagtagagtccagcagttaataactttatttaggtttctctgtataatggtaaccttcagttaaataaacatttattatactatttgtcctacattatcatgcacttgattatgttctctagcttttcttcgtattcatgttttatggcccaaactaatttttaagtttcttaaaagtagaaattatactgtgttcttaactgtcacagcctattgacaaataaatatagtattttttaagtaatcacttactacctgaacaggcaaaggtacggttgctgttcataaagaaagaaccaacaaaatatatatatatttttgaaacaagagtctcactctgtcgctgaggctggagtgcggtggtgtgatcttggctcactgcaatctctgcctcctgggttcaagtgattcttgtgcctcagcctctgagtagctgggattacaggtgcgtaccaccatgcctggctaatctttgtatttttattagagatggggttttgccatgttggccaggctgttggccaggctggtctcaaacccctggcctcaagtgatccacccaccttggcctcccaaagtaatcccagcggattacaggtgtgagccactgcacctggccctggcaaaatattgattagctttattgtaata

SEQ ID NO: 88961 - DNA, 1179 bp, Homo sapiens
tgtcatatatttcctttttattcctcagctaatacattattgctttcttttgtgtttagttttttcccctagtatgctattttgattccttcttcttttccttttctgtatattttttagtcattttcttattagttaacgtggaattacacttaacattctaaattgaaaacaatctaggttgaattgataccagtttactttgagtagcttaaaaacctgcttctgtttacatttatctaaatagttacctttactgatactcctttttcttcttcatatggctttgagttaagacagtttgattatggcatgtgattatgatgtgtcttcatgtggagcttttggagtttttcatagttggcattcagcttcttggatgtgtagatttatatcttttaccagatttggaaaggtttggccattatttcttcaaatagtctttctgcccctttctctccttctggaactcccataatgtgtatgttggtctggttgatgccacagtttccttagtctctgttcactttttcatcctttttctttctgttcctcacacttgataatttcatttgtcctatcttcaagttcactggttttttttcctctgcctgttcagatctgctgttgaagccttctagtgaaattttaacttcagctattgtacttttcagtgctagaatttctatttggttctattttcgatctctttcatgatattttttctttgttaagtcatcatcttcctggtacttcatccatagtgttcatttgctttttgaacacatttaagagagtttaagattttgttgagtaaatctaatatcttggtttcctcagaggtggtttctatattattttctttttttttttttttttttttgagatggagtctcgctctgttgcccaggctggagtgcagtggcacgatcttagctcactgcaagctccgcctcctgggttcacgccattctcctgcctcagcctcccaagtagctgggactacaggtgcccgccaccacacctggcttattttttgtattttttagtagagacggggtttcaccatgttagccaggatggtctcgatctcctgaccttgtgatccacctgcctcagcctcccaaagtgctgggattacaggcgtgagccaccacgcctggtggtttctaacatttt

SEQ ID NO: 88962 - DNA, 3684 bp, Homo sapiens
tggtcggttggggtatttttatacgaaatgcttgtaggtgagtaaggaagattttatgtctctctattacagttgttcatctcaaaacttgccacttggctctttctaatatatttattatattaagcaatcttgattttatttgtgggtaataaacatgatccaaacctgcttcgtatgtgtttttaaaagcatttagaggcttagagcaactttgtgatgtgttcttttatatattaggtgtatgtttttagtttaatacatacctaataatctttttaaacgggtaactttgactcttcctttgaaactgactttttaaaaatgtatttcattttgcttttgttttctttatcaatttttcaggtgatacacctttttatgcagattctttggttggaacttacagtaaaattatgaaccataaaaattcacttacctttcctgatgataatgacatatcaaaagaagcaaaaaaccttatttgtgccttccttactgacaggtaaataattttaaaactgagcctgtattaattctgaggacttctcatcttctgctccatttttaaggtccatatctgagcttctacatgtaaattgttagaatataaatgacagtgaaacctgatgtaattttatgatattctagatgtcttttgtagatctcaactcacttatcatacctaagaaattgtgataataatacagtcttggctgatggctaaactagatgacttttttcttttattgttcaatttttaacttggttaattataaaaattactgtgtattttactgaatctaaaaaaattttttaacataacatctctgaaattagagtacatctcacagtcaatggtatgagttgggagcatcctttttcatagtggtataaaaacggtgatacaccttatactttaaaccattttagatttgatgatgtatggtatatggttgttgaaagagtcaatagtataaagccatttttaaaagtatactatcttttttcttctagacataatagttggtgttccatcttgtagatccaacaagcattttaataataatgtctgtctgcatttttgaaagaaaaatggcatattatatatacctttgtggtttacttttgaaatttgaaagtgaaccagatgtattagtaagattatatttaatgtttatgattgtatattgttaaatattagggagacctagtacttttaaatatgtttcaagttgagatttgctttaacttgtctcccttcattatgtcctttagagcttgaagtatggtttttcaaatgtttactttttttttttttttttttttttaaatagagacagggttttgctctgttgcccaggctggtttcaaactcctgggatcaagtgatcctcccacttcagcttcccaaagtgctgggattacaggcctgagccacccatgcctggctaatttttacattgattgattgattgattgagacagagtctcactctgttgcccaggctggagtgcagtggcatgatctcggctcactgcaacctccacctcccggattcaagtgattctcctgcctcagcctcccaagtagctgtgactacaggttcctgtcaccatgcctggctaatttttgtatttttgatagagagggtttcactatgttggccaggctggtcttgaactcctgacctcatgatctgcctgcgttggcctcccaaagtgctgggattacaggtgtgagccaccgcacctggccaatttttacattttaatataaagcattgtattatgctgtttattaggtgctagggatatagtagtgaggaagatacagagccacttttctcaaatacctcatagtcctttgggggaattagataagcaaatcagacatttatagtacacacagctaattaccatgagataagtaccatgtgccggagaaccatggagaggttttctaatccagtttgagagttagtgaaagcttcttggaaaaattgtcacatgtctaagccaacttatcttttagcttatgcaaaaacttagaatttagagtattttctttatttataagcactgtactagggaaaaaaggtgctaactttctttttccaattcagctaaaatcacatttttaaaaactttttgctcaccaaaaaagaggctggtatcagtaacttgtccagtgaaagctctgaattctgtggcagtatcaagaattagtagtcattggcttttgaatggtcagaaataattaatagattataaattggaagttcaaaattttaaatgtgtttctggaggtttttggtagcatctggtattgctgcctaagtaaagttttggttggggaaaaaaaagcctaactttaccattgtaagaaaaaaataacacacacacacaaaaaactgtcaagaaaatgcatggtgctttattcattttgctaatgaagtaaggtggtgattaatctggatttttgttgtcagtagaaaagtcatgggtgttttttgtagttattctttagttttcttttttttgagacggagtctcgctgtgtttcatccaggctggagtgcggtggcgcaatctcagctcactgtagcctctgcctcccgggttcaagcgattctcctgtctcagcctcccaagtagctgggactacaggcgtgttccagtacacccgctagttttatatttttagtagagatggggtttcacagtgttggctgggctggtctcgaactcctgacctcaggtgatccaccccacctgagcctcccaaagtgctgggattataggcatgagccaccatgtccagcctttctttagttttcttttaaaaaaattctttaatgttctcaatctttaacatattttctatttgggctgatactatgctgacaatataatttcaccttagaactatatttgtcgtcctacactgatttaatatcctgcccacaaataaacctggacaggttataataagatcttaaatgattgattacttttctccttctgtcattattcagggaagtgaggttagggcgaaatggtgtagaagaaatcaaacgacatctcttcttcaaaaatgaccagtgggcttgggaaacgctccgagacagtaagtttttttttttctttcatattttagtgaatatttgaaagtagttgtggtagtttgttgaaactacattgctaaatatttgtgtgtatctgatgaaaatcagaagccacaaatactatatgggaattgtcctaacctattaatttgataatattgggcagattatattgttactcctcttatgtcccacgcaggatacccagatgaaatataaatgtaatggatttaggctcaccagtcataattttacatttgatctttgttgaattgttcattttaggcgttagttatcttattatggaggtggtcaataagtagtaagtaatgagattaaaatatatgtttttgtgagaagacaagttattctcttgtttttattaaaacccaaaatataagaaggttctattattaattccagaattcaatttaattttatttatgagtttataggatattgtgatatacttgattccatcaggcttttgcagctggcaattcagaaacaaaaatgtattgtataagaaactaattttcagtcagtttagaacact

SEQ ID NO: 88963 - DNA, 1049 bp, Homo sapiens
aacagctgaaactgtaagccaaatttatcaaagacttcttgagcattgtgatattgatataaatttaatagtagaccccactgatgcacaagttaaattagaaatacagtatttctttgcctaggagatttgtatatttactgaaaatattacagtttaaaaaaattctcagtaaaagaaattcaaatagtgtagaaaattatgaagaaaggatatctccatgtaactcttctgaataattatgttatagtcattttgcatatacaagggtctttgtggcatttatgtttgtctttttttaaaactagacttgcaacttctgtaatttgattattttacttaaatcttttattaacatttttgccactttttaagtgaaacaattttgtttaacattaatgaatgtgttttgtttgttttttctatttgtatagcttttttatgcattccaagatgatcgttatctctacatggtgatggaatacatgcctggtggagatcttgtaaacttaatgagcaactatgatgtgcctgaaaaatgggcacgattctatactgcagaagtagttcttgcattggatgcaatccattccatgggttttattcacaggtaaagataaaagtgctttaaattttctcatttgttgagggaaatagctaaaaataactttaacatttcttactctcagttcacccattcttcttccgtatgacataagtgacctttcagaactcaagactctggccaggcgctgcctcacgcctgtaatcccagagctttgggaggccgaggcaggcagatctcttgagctcaggagtttgacaccagcctggacaacatggtgaaacccatctctacaaaaaaaaaaaaaaaaaacacaggtgtggtggcatgcacctgtggtcccagctccttgggaggctaaggtgggaggatcgcttgagcctgggagcagaggtttcagtgagctgagatctagtcactgcacttcagactgggtgacagagtgagattctatgtcaggaaggggggaaaaaaagaactccaa

SEQ ID NO: 88964 - DNA, 1616 bp, Homo sapiens
taccagttggaaaatttactgttttttttttttttagtgtgtttgcctttgatatcttaaattacatctttttttaaaggatcactaaaactgaccttataaaaagaaaaatttattccagtattaatctaaaatatctactcatgtttcctaaattcagatttgatgtgtacttaaaataccaggaactaattagctaattattttcagcttttgtttgtagtgtaatatttgtttttaaaacattctgttaagtcaaattttgattaataaaaacctttagtagttgtaatgaagttattctggaatttactttaaaaaatcttagcaaattgaacatttagctactttatagcttcaagtttcaccatattttcaaataattcttcatgaagtttgttgtttttcattgtgtttcttaagaactcgaatgtaaaataagtagtgctagttgtaatgctttagtgatttaaaatgataaacttttcttttcatacagataaagacacaataaataaaatcagagatttacgaatgaaagctgaagattatgaagtagtgaaggtgattggtagaggtgcatttggagaagttcaattggtaggttattttaatgagaatacaaaaggactttattaaattaaaataatccacttgtgtgtttaacatattatttgggaaaatactgtttttatagaattgttgctttaagttcctttagacattgttgcctgagggtatggaagcctagtgtcaaatctagccatagtgggaagtgttttccccaagtatctgtggcagaaaagaagtgtcaggcatcagaagataaatctttgctcctaatattagactaaaatgctgtagaacagtaagctttataaacaggaagcagcttacatagccgtgtggaggggggaaagtgtcttgtaatataggaaataaaaatttttttaaaacattacttctgataattaaagtcttgacattagctacttggaataatttggcagaagagaagaaataaaaataactgaaacagtaaggctaaattatttagcaagtattaaaagcacttagtaaattgttctgtgaaaccttgagctttaaatgttaacaaaaggttcattattttcccttttcaattttaaaggtaaggcataaatccaccaggaaggtatatgctatgaagcttctcagcaaatttgaaatgataaagagatctgattctgcttttttctgggaagaaagggacatcatggcttttgccaacagtccttgggttgttcaggtatgactttgctactctttcattattgctgcattagtttgtaactaaacatgtctgagaagcttagtttgtgttttagaatagtagtagagaatttactggcagttacaaaattgtctaattaccttttaaatcttaaaatttaattgtattgaatcatttctagcaagaaaggctagaacaaaataaccatgcttctgtagaatttatatataggaaatttaatttaaatgtagaatttgtgctgggcgtgatggctcatgcctgttatctgaatactttgggaggacaaggcgggaggatagcttgagcccaggggtttgagacc

SEQ ID NO: 88965 - DNA, 1248 bp, Homo sapiens
ttttttttgagacagggtctggccctgtcacccaggctgaagtgtggtggcatgatctcagctcactgaagcctccacttcccgagctgaagccattcttctgcctcagcctcttgagtaactgggactacaggcaagcgccaccatgcctggctaatttttgtattttttttggtagagatggggttttgccatgttgcccaggctggtctcaagtgagccattggcctcagcttcccaaagtgtaaggattacaggcgtgagccacagcacccagccctcaaactaattttgaaacagtggactgcaattaactttcctttttctcttttctgttattcattcattcatttgacaaatgtttatttggtgtgtactgtgtgctaggaattctgctatgcaatggaacaccatggtgagtaaaaacaaacatgtcccactttcatggaatttatagtgtcaggaaaaggattaattaaatgtctatcacactaagataggagtggggtatggtgaagggcaggtaagagatatgatcatgactttcctttaaggtttggtttacttgtagtaaagcaattaagtgtatagttttcagatatgaggctgtagattgtatcagattcacttgaggcacttgttaaaaatggaatctgggatcttgcgtagacaaacaaaatcacaattttttgggatgattcttaggatttgcatgagatgtggattcttagacacactcaagtttgaaaactgtagttacagtggaaagaatgtgaattttcattctgtttggtaattttatgataaaaatttcaaatatacgcagaagtagggaaaataggatagtgaactcctgttactcagattttgcagttttcaaaatgtcatcacatttgatttcattaatcaccctttttcttaccaaaatattttaaagtaaattccatatattgtcatttcatccttacatacttcaataagcatctttgaaaaaaaaaaaggacattttcttacataatcataatggccattatcatgcctagcaaaattaaaagtgctttggtatcattaattcccagtttatattcatatttctgattgtctaaaacagtgtctattttacagttgctttattagaatctggatccaaagtccaaatgttgcttttctttggttaggtcctttaagagtcttttaagtctcttaatatagagaaatctcattcccccaacttctccaactcccctt

SEQ ID NO: 88966 - DNA, 1826 bp, Homo sapiens
gggcatctgccgggacagcgatcagaagcagccagagctccgcctccgtccggacctccaaggccgctccagagccctgcatggctcctcagagccggccaaggcgagaaccttgccggcagctgcttacccgcactcggctcctcccagcggtccgccttctccaccgcctgcccgcaaggccccgcccacctcaccgccccgccccaccccaccctgcggaggcgacagagtgcgcgcgcgcgcgcggggtcccggctggttccccttccgagcgtccgcgccccgcatgcgcagtctgccccggcggtctccgtttgtttgaacaggaaggcggacatattagtccctctcagcccccctcgccccaccccccaggcattcgccgccgcgactcgccctttccccggctgggaccgcagcccctcccagaagctcccccatcagcagccgccgggacccaactatcgtcttcctcttcgcccgctctccagcctttcctctgctaagtctccatcgggcatcgacctcgccctgccccaccggacaccgtagcagcagccccagcagcgacgggacaaaatgggagagtgaggctgtcctgcgtggaccagctcgtggccgagactgatcggtgcgtcgggccgggccgagtagagccggggacgcggggctagaccgtctacagcgcctctgagcggagcgggcccggcccgtggcccgagcggcggccgcagctggcacagctcctcacccgccctttgctttcgcctttcctcttctccctcccttgttgcccggagggagtctccaccctgcttctctttctctacccgctcctgcccatctcgggacggggacccctccatggcgacggcggccggggcccgctagactgaagcacctcgccggagcgacgaggctggtggcgacggcgctgtcggctgtcgtgaggggctgccgggtgggatgcgactttgggcgtccgagcggctgtgggtcgctgttgcccccggcccggggtctggagagcggaggtcccctcagtgaggggaagacgggggaaccgggcgcacctggtgaccctgaggttccggctcctccgccccgcggctgcgaacccaccgcggaggaagttggttgaaattgctttccgctgctggtgctggtaagagggcattgtcacagcagcagcaacatgtcgactggggacagttttgagactcgatttgaaaaaatggacaacctgctgcgggatcccaaatcggaagtgaattcggattgtttgctggtgagtagcgctgttctcttttgcttgtctggggttttgcatgtctttccttcctcttgcattagtctggttcgctgcaaaagtctcaggtgtgcataatcgtcttggaaaatgctagatttctgtttcctgaagaatcttggagtaccattaacatctcatggtgtggtcctatttgccatttgactggctctgtactaactactctgaacttttaattctgactcagttcatgagtacccgaaagatacttacaaactgctattgcaggcatcctataaaaagttatcacgtcagagttactgcaatgtatacagtttgttgaatggcgatcgtagtaattaatgttaatctttctgatccgtttgacagttaaattggaaagactactttgcattttttttcctttttgcgatttagctcctaggggtttagtttttagccttgaaaatgataacggagaattgctattgaggaagtgatttttgagccaaaatttcataggtgatttgagtttgaaggaactttttgctaa

SEQ ID NO: 88967 - DNA, 1041 bp, Homo sapiens
ataaaaatgaataaaacacaaactgtgactctaaagatttcaaaatctaaaggaaagatggattttaatacaacttcgtaggccaggtgtttaatagctggtcaaaggtaaattcagggtcatctgggaactcataggcagtcttaaataagactgtaagaaatgaaagaaacttacagtaaaatgctggccagtgttcctactcttgagttggtgatcgctactggagaaaatctctcatcattgcagactgagatcactctaaattcattgtccctatccctaaatgtgacctaattatatctttgactgcctttggctgagttcctttcctttttatctaatcaattattccaaatctattccactctcttcaagcctgtacccacctgcccctttctcagcaggctgctcctctcacttctaggaatccctgaagagtcccattaattgccttgactttagctgaccctaagtactagtgaagccaagttctttatctccaaccctgggttcccttgcacttcagaccctattagattactgctggatatttccatttggttgtttcacagccatttcgaaaaccatatgtctaagaactgaatggatcaccttctgtccagaaatctcaccttctttctcagggttccctgaatcagaaaaggtaccatcatccaccccagtttgcctgaaaaaagaactactctggctggaacatgccatgtccaggtaggaggctgcagtaatccttgtcgtggtctttaacacgttgtgtataattgcatgagaaatagcattgtcaagtgattaaaaacatggctttgaagtatgatggatctgtgtttgattcctggcaccatcacttgtcagtcagctgtgtgaccttgagccaactattaaactttctaagactgggttaccttttctgaaagatggagaccataatagtacttacaggccaggtgcggtggctcacacctgtaatcccagcactttgggaggccgaggtgggtggatcacttgaggtcaggagttcaa

SEQ ID NO: 88968 - DNA, 1092 bp, Homo sapiens
tgccacttcagcctggtccctgtttgttccttcatggtgaccacgcagatactgaaacccaggatgggcttaacatttgggcctggaacatctggaaaatggtcagagagggagcggaggaggcagaagaaagagaactgttgcattttgtttcaccaggtgctaggaggaagcaacattagcctttttgatatgggaggcacattctgtggaccctggagttaggctgcaacaattgaggaggtcaaaggacagctgagtggggtcagtgagacaccatggggtgtattttgttacttagtaaaaggagcagcctcctaaaccttaaaggattctcttgaaaatctgtgttgtgaaaaggttttatgagtcttatggcaaaaactcctgatttatctaaggaatgctcgcttttgtctaatggaaggataatccttaccaaatgttggcaacgtctataagagtcaatataggtctgaaagaacagttggagtttgaagtgtactttgcttttcaaaatgtttatcattttagtgtttctctctcaggaagaattttgcactgttgaaatatcacctttttctttccttggagcagaaagcggtagcgggtggggagtgagggagggtggacggggagaggtaagccgggaacttacattaatttaaaaatcattctacaagcttttggcctaatctgcaaacaaggtattattattaaacctttaaaaacaccaaaacttgttaactctaaaaagtaatatttgaatttattttaacttacgaggaaaatgggtggtacatgaagtgtcatgtttctggaatacagatttttttatttagttgttgatagaaagggctgtcagttgacaaacaaccttaaatcttgtgtttcttcctgaatgtggtcaagaagaaaatcagtgtcagagtcaagaatagagaataagaaaagcaatacagtaaggagttttctctttgaagggaaatggagaagggaaaaatctgcatattgtaaaagctctctttaccacaacccatgacctcaagagaccgcttatatgattgtggatacctttgaaaggtattagcc

SEQ ID NO: 88969 - DNA, 1047 bp, Homo sapiens
tttggagcatccaagtgaattccctgggattgatatgtttgagtgatttgtttggtagctatctcagagggcagggaattttgttaagcagctttgatcgtcgttgagcaagtgtacctggttggaccataaaaagaaatgttgaactgtactgacctgcttctattgggacaggctatggcactttaccctatttctatggaaatgttggtgacattgttgtgagtcctctgctggtgaattgctacaagattccacagttggaaaacaaagatttggaaaaattagggttgaccggcagccaatttctgagcgtggaaaacatgattcttctgacgatacagtatcttgtgcggctgggtaagtcattttccataatcatttgctggtgactacttttgaggattttttgtgatgtactttttctttctttctcacatttatcctcctatctcttattttccctctttcgcttctaatgttctttcccttcaaccccattctctgtaacttttccctttcctctccttcatttcttttctactcctttcctttcctcttctttgggtcctagaggagatgaattgcaccacctagtgtccagtctcatgatgctgcaaaggtctccaaagtagttaaggtaggcagaaccttaaagggttgtgccttgagcaccccttctctggggagcttggccaggccacctttctgaaagtgcacctaccatctggagtgcaaacacagccattgtcttaaacaattattttccagttttccacttagcctttttatcttgtttatccactggccctacacccattttttttcttctccagctacacccctttgatggagtcccatcgtgctttccatcattgaggtcataactgtggacctccctggaaggtctttaagctatagggtaagggggatatgtaggtcatgaacccttcacttcctctatctgatatattctccgaagccccaaagtgggtgtatgcaggtgccctgacaatactagagtggcttagcagcatttacatcgaa

SEQ ID NO: 88970 - DNA, 1023 bp, Homo sapiens
aaggactgcaggaaagcatatgggtgtgtgtgtctctcctccctgtgattctttaaattccagctgtaattctcttctatataggtcctgatcaggtacctctcagggaagaatttgagcaaattatgctgaaagctatgcaagaatttactctgagagaaagagccctgcagataggtgctcagtgtgtccctgtgtcaccaggacaactcccctggcttgctagattaattgccagcgtatctcaagacttggttcatgtggttgtgacccagaactctttggcggagggcatttcagagaccttaaggactctcagtgaaatgagacactatcaaaggctgccagattatgtggtggtaatttgtgcatcgaaaatcagaggaaatgaattttgtgtggtagtgttaggtgagtaatttttttgttttttgtttgtttaatcaattcattcgaccatttttccatttaaaaatgtgtgttatgtgtttcaggcatccacataatcaacctctgattaattgctggagcttgggctcatcctcctaattttaactttccctttccttctcagatcaggttttgtgtagccctcagtttggctggtgcccctgtcagctggttgtgggagcattatttcaaagctctccctagtaacagatacccctgtctcatgtaactgctgtcctttaaagattttggaaatgttactactctagcatgtgataaagccagtgccacaggtggcctaagccagttaatcgaatttgccagaaaattagctcatatattccccttctcactgaacagtctatttaatattgtaacatagtctctaaagaaaagattcagaaagttggtacactacaaaattggggggtgggaggggatttttgtttgtttgttttgcactgtgcagattttctatcaggcaccctcttgggtagccatttggactacattttgcttctctcttctctgtactgaatggctctcacctcttccagcaaagaagctaagaaa

SEQ ID NO: 88971 - DNA, 1054 bp, Homo sapiens
atcccattctgtctgcttttgagtattagggaagtcaagagagatacaacatgtgaaagcatgtaaattataagcactatatcaatgagagtagttcttgatatagagacaccagtatactataaagatggccaagtgtaaatgctgatatgaattgctggctgaccaacaaatctactgagaacagcctaactgcccaacttgggcagttaataaaaatgaaacaaacatatccttccttgtaaccttcttatctctattttgtaataggcgatgacctagacaagctgctggaaaaaatgcaacaaagaagaggagacagtgtggttacccctttcgatggagaccttaatgaatgtgtgtcaccccaggaggctgctgctatgattcccacacaaaacctgggtaatgtcatctcagaccaagaggaggaagtcagtccttgggacagacattgtaaaaactaagtcattctaagggttttgaggattcttcaagtcacagaccacaacagccttttcctgattgtctacatgataaacctggttgaaattaaaaatgctttcccatgtggcctggatcaaaggctttgttcctagtaaaagtcttctggaatgaaaatcaaagtcaaagactttatcttaagcactctctcttttttctctgaaagattccaggacattggctcattttccttagctccaccagctgtgcccagaggacttcaaaaaaccgtctgaaagagtcagactacaggcagtgcagggtccccagctcctgctccttcacttcctgtctgacttgtaaaacacacattatctcagggatagtgaggctttattggcagatagagcagcgctaccaacatgtcatctgccctacaacaagcttcaggggctcaaagtgggagtgtcagggatgaggagtctgatcattaagactggattcatttgggttcagatttcttccccaattcactgattgacaggaatgacataggacaggacagaaaaaagaacaggagaaaggatagttgggagacagacccatataa

SEQ ID NO: 88972 - DNA, 1037 bp, Homo sapiens
cggttccagcactttgggaggctgaggcaggatgattgcttgagcccagcagttcaagaccagcttaggcaatacagtaagaccctgcctctacaaaaacgttagctgggcatggtggcacgtgcctgtagtcccagctactcaggaggctgaggtgggaggatcatttgatcccaggtggttgaggctgcattaatgcttactataatctggggactcagggttaagtacagtgcctgaaggtgtgacgctgtaaggggtagggccaggattcacacccaggtctactggctctcaaccgtgactgcatattggaacactctgaggcgccttaaacaatatgactggatcctgggcagtcagacattctgactgaactattctgggatgtgtggcctgagtgtgggaatttttaccagctcccagctgattgtaacgtgcggaagacattgggaatcttgctcagtgcatcctaaaatctcttgggtgtcagtatattaacaccccacagttaaaatctcaagacagaaataagatcatccaaaattaaacttttaaggaaatttggcctggtggagactaggttatcttacagatgccagagtttgtgaattgggtctgcagagacgaatgctgggggccagtgagggcaaatgttcctctcagcatgggtgtgaacaattctgcctcctctactgggacaggggagctcatttttcagaaatgcctttgtccacccatctgggctctacgtcccataaaagccattctctctgacacatggggaagagggaggccagtcacctgctctgcacacttccttcttgtcctagatcacaatgaaagcagtgaagtgagccagtcagagggagagccctggcctgacatcgagagcttcagtaaaatgccttttgatgtcagtgtgcatgaccccaagtacagtttgatgagcctggtgtatactgagaagctggcaggggtcaaacaaggtcagtgcaatcagccaagttcacctcctctctgggttaaggggacac

SEQ ID NO: 88973 - DNA, 2189 bp, Homo sapiens
agaggagaccctggagagaagaaacacgtgggttcaagaaaactactcaggtcttatctgccctccagtccagctctaggctgggtgttattacttccctttaaaatgggaacaagcagctcctgacttggcactgaggcaccgacagaagcagatgggccaaactgtttagaactgcagcgcaagaagtgtccagaagagcgcagctctaaaacactggattcagttagagatgtcctgcctgagaaaggaaaatgaaggcattctgacatctacagtctccacagctctgtcatacatacaacaagactggccccctttgagaaatcagcgcattgctcttaaactccaggaggaaagcaggacttctttcaggcacattcctgtgtcataggcagtaacgatgcttccagctccctggttgtacaacagccccctataacttgctacgtgccttaaagatgagatgacctaggggcccctcttgatctgggtgaaccactaatgctgcctctcccttagaccatcttttttctcatggttacattccttccccagagtgctcagctcaggaacatttgcagcctacatggggaagaatcccaaaccttcccagggtgctcagtacaccagtgacttcttccttaattaccagtcctcagagttaattctgcaaaagtgcagataaagggaaaaagaaaactcaaattcaagggagagtcaaaaagcttttttttttttttttttccgaagagtggtgaggagggcaggacaatttctagaggcaggggaatctgaaagtttcatgccaggggaatggagctcagtttatcttcgaagcccttctccccatcccaggggggccccttacccacgcctgcattattgaacatgccgggaagcaccagcatgatgtggttgggccagtacttgcggtacagaggcatctcatactctttgaccaccaggaggtgaaggtggctgatgccctccatggcgtggaaaaggtttaggagtccgtgctcatgtcgaccactggaaggagtgaaaatagggctcttgactgcattcaaattctgctgaaagggaaaaaaacagaccataaagggaaattaaagcctctagattgaagacgcttaaagaactaggtctggtgcctgccagtccagatgctctcacccaccttgtctgaaaccaggggcagccgcatgctctccaggtgcttgccctgcttgctgaagacaaaatgactctctttggatttgggaatgatgaaatagagctgaacctcttctcccagcatagaagaagagaatgtgaaggcatgaagggtggagtcagacatctacatttgcaaagaagaaagggagggaacgtaagtaagcccacagtttccaaacttccaggccactccttcaggttgttattaagagatggaaactaacatgaactggtaagtgccaccagagcaggctgtgagcagccacgtctaaaaggttgataaggcaaacacttcatttaggagctgccactgacatgacagcccgccgtcttgcacctgcatagcctcagtggaagaagtacttgttgcctggcactgcattctgtgtgctctcagagccacagctgcttcatcctgtgcagaggtcagatatatctgtgggatgtcctgctctgtatgcattcctaaaggtcccctgttaatcggagggaaacacttctgctctatgcgggtcagatcaaatgaatatcagctttctaaatatcaggtttgacattaaaatgcctctccagccccatctttccaggctacagtggatgctgaagaggttcaatcatttagcccagaactctggtttcagaaaagagaccatttgactcactgaagccaaatataaatctaacctacatttaaagtgctgcagagttcacgttttttcagtaacctatctcagtgaataattatataataggtcttttcacgcttttaatgtggataagatttggcttaataaaaggataccatcaattttcatcagcaactagaatcgaagtaggtttcccaatggttttaaccaaaatactatatttcatagaaaaataacattacacttcttcccttaattctagtttattctgcctcagaaatgtgggaatatactacttagtactgtagtcacacagaaact

SEQ ID NO: 88974 - DNA, 1048 bp, Homo sapiens
cactgatatgtcccctgctttagatacttcaaggaaactgacggcagcttctttgaagaagacaactctggaaactggcaccctttccctagatctgccttttgcaagaggcaatatggtatagagattaagagaagagacaggagccaaactgtctgattttgaatcctaattccaccactttctagccatgtgaccctgaacaaattaaacccattgtgccttggcttccccacctctaagaagacaataataatgccgatctcatagggttgctgtatgatgctcaggatagcgcctagtaccctctaagtactcggtgaatgttagtgattatcaagatgatagtcagtaatcagccaaattttatgagtgggccatcgtaaaatgaaacaaaacgtaggtgataaatgaaagaaaagctattaaatctatggaagaaccagaagcagtgtgaacagatcaagggtaaaactgggatttaggaaaatctaccttccaagaacgtgtgtgtaatagtttgcattctcaacataataaaggccatatatgaaaagcccacagctaacatcatcatagtcaatggtgaaagactgaaagcttttccaaaactgagatcatgaacaagacaaggatgccacttttaccatttctatttaacataatactggaagtcacggccagagaaattaaggaaaaaataaataaataaaaggcaaccaaagaggaaggaagtaaaattatctctgttctcaggcaacatatacatagaaaactaaaaattccaccaaaaatcccctttagaatgaatatgtgaatccagcaaagatgcagatgcaaaatcaacaccaaaatcagttgcatttctatacctcaactgtgaacaatctaaaggaaatcaagagttccatttacaatagcatcaaaaagaaagacttaggaatcaactaaggaggcaaaagacttgtacagtgaaaagtacaaagcattgatgaaggaaattaaggaagacaccaataaatggaaagacatcctgtgtttatggatt

SEQ ID NO: 88975 - DNA, 1044 bp, Homo sapiens
tgtatttatttatttactttttttttgagacggagtcttgctctgttgcccaggctggagtgcagtggcgtgatctcagctcactacaagctccgcctcccaggttcacgccattctcctgcctcagcctccccagtagctgggactacaggtgcacaccaccatgcctggctaatttttgttgtattttttagtagagacggtttcaccatgctagccaggatggtctcgatctcctgacctcgtgatccacccgcctcggcctcccaaagtgctgagattacaggcgttgagccactgcgcctggcctcaagtgctttttaaaaatatctttatcttctgtattttgctcagtgggaaccaatagcaattacaagcaagatactaaatttgacttaccttttagaaatttaaatttcttaagatcagcacctacaaaagagtcacagaggtacaaaaggagtccactgaaaaacaccccttcacagttgacattgctggagtggggtctggagctgatatagcatatggccacctgaaatcatcaagcaaaaatagcatgggcatttcaagagcaagcaaaatatctgcagttcagcagaatgactcagtaccttcctttttctctatttcaggataaggtaaaggagatgagttttttccaatattaacttaaatggcttggttagttaagctttgcagcctcctttatgtagcgtgccaagtgttaacctgtttaaagcttctcttatttatgtttcataataaaggactattaggagacaaattagtagtaagaaacaagcccttccatttaagagtctttatcaaatttaaaaaactaccttccacaaaaaagcatacttaggaaagattaaatgtttggattgccttattggtgagaataaaaaatatttttgatcagctttccatttagatatacttaaattttcaattggatagaagcttaagacagtgcatgggctgggtgcggtggctcacgcctgtaatcccagccctttgagaggccgaggtggatggatc

SEQ ID NO: 88976 - DNA, 1023 bp, Homo sapiens
atattcttaaagactggaaacacatttaaagagtgggtaaagcaaaggaattaggctaggagaagatgcataaatgcacacaatgcctgctctgcatttactgatttgtttgttcagtttaaatagtaaacttctaactcctgtggaaattttgccaaaagtttcaatacatagaagattataaatcttaaactaacactgcacagagaaagacaaagctacttctttttttaaatacaaatatcgtctacattctatcatttcaaacccctgagtaatactgtaccaaagtacagatctgaagagaaactgagggttcaggcctcaaacgttaatcttcaattgattccacaccaatggcatgagtctcatgtaacacattcaggctagttaatcctgacagtcagtttccccctaacatagtaatagaaaaaaataatgcaaactccatattcactctccaaagtatatcctcctcaggatcccatgggcagaccgtatcttaagtaattgcataactgcctaggatagagtttacctgaatttaagggtcctgtaattggaactgaaggaaagtgatgtccccaaagacctggatcagatttggggagttctttggagaatttagacaaatatgttgcactttgctccacagtgattgtactttaaaggaaaaagaaaaatcccaaattgtttctgtcccatcccacctaggcatctttttgctgttttggtctcttcaaaagctcatacatgacgtccagtaagaaagtagagaggcttgtcatcactgctgttagcagtttgaaactcgtcccggaggcggaactgccactcatcttctagctctaagcggacaattgtttggcgcaaggaacttctgtcttggcagatgacacacagtgtagcaccttcaggaaaaaagacagaaatatgtcctaggctcagggattgaatttataaagaactttatctctgattatatttcctaagctaacacatctgagaaccaacagatggata

SEQ ID NO: 88977 - DNA, 1037 bp, Homo sapiens
atggaatctatgtcaaattcttttaatttactacactttattaatagattgaaagccatttttctgggacaacaaagttgttattctcaaaagttggtaaaattttttaagaagatataattcatactacaataacagcatcttcatactacatagttctagcaactttgagacactctcaaaaagtttgagaagttttaactggagattaacaataacaaacaccttgtattagttttagcaacccaaagttgttctgtttccagaaggacatcaaagtgagtgtagttgcaatctgtcaaataaaagattggtatctactatgtatgttttcaacacctctttaatcttggttgtccaacctataatgtgactgacttccagcctttttaggacattgccagagtcagggagcttgttttcttaacaaacatgccagaaaactataaagaaaaaataactttttggagggggtgggagataactttaatacattaagcaaattaaatcaaaggacaaaaatataacagtagacacaagacaattttgaatcattaacaaaatgtgaggtagactagtgaaattcaccaaattttggttaagaacattttacagtaataacacgggtgccccattttctaaaaatcacaaaaagcaattgcataaattacagccaaaaaaaattataacaattgtcttctagtttttcgtttacattcagtattaacctgtgtgaactgtcatacatgctgaggttcagcaggtctacaggtgagttactgtgtgggcctagcgaatccattcatcccacatcagtgtcctaagggattgcaaagcttaaagctgaacacactaggatatatatatatatacacacaaatcatggtgtcctgtgcttgtgcaattttatccttaaagaaggacctaacatactcaagaattatactgatgataagatgattttaaaagatccaaacattagtaagataggctttgaaaagaataggcagatcaatttctccattataggggtgatg

SEQ ID NO: 88978 - DNA, 1138 bp, Homo sapiens
cacttatttatttgaaggttcacaaggtcaccctggggtttgtaaaatgagaaggtagaagagagttgtgaggtacaccatcatttaagagtctcaaagaagactgcctaagaaggcatgagcagcaaggtaggagagccagaagagagtggtagaaaccaagggaaaaatgtcaagaatcaaagaatgatcaaccctgtcataccacagttgaagactgaagagagcccaagtgatgttaggaaaagagcagtctcagtggagtggtggaggcagcagggacacggtgagtgtacactaatggccacagactgtagaagagggtgagtctgtaattgctgactatataaaggtgcttatagattttttgttagcagccctcatgtagttgttggttgtttataaaaatatctagcatagagacatggtaagagccacaaatatagtcaggaactacaagattttatgggcgatgcttttatctgcatggacacacagataaaaagcagtattttactacttcataatatgcaagagtgaacttggtttatctactgaaagcctgactgttgtaaggacagtcagtgagtacaacaaacctgcagtgttattttaattgttcttgtttactttgcacggctgcccagctatagagtcttatccttctggatgggaacacagctgtattcctgcccatccacattgcagctagggttgagattgctgagtgagttgatttctagggtagtgactctagacatacattttctttctcatggctcctgagtctttaggcagaaaaagggatgagttctgtcttttagcaaccccccacccccacccttctggtaaaaataaaatacactggactagtaaaaataaaatatgtggaatgaagtggtcagaaaagaacttactggtgttgccttttttttttttttttaacttaataccatcatctattgtcatagtcactgaagtagatgctttaactcaacaacacttgatagttgagagcacagtgaatttattatgtgaatgactttttctttggccttagcggcaattcctaaagtcatctttagcagtatttttactgttgttgttttgttttcagtgaagccaaggtttcagtgtt

SEQ ID NO: 88979 - DNA, 1282 bp, Homo sapiens
gaaatatttctactcttagttgaatatttttatcatgaaaagatgttgggtaaatgtttttacattgttgcttttattaaaatttaacctcaggttattgatattatagatgaataattattttcaaaaattttgagcacatacagcagtatctaaaaagcttttttagtcaaattgtatttgacaggttattccagttttaatgattagaatttttttttttttaacatttcacacttaacccttccccccccccatttttttttaataggagtaactttatatatggctcatatttgagcaaagaagaaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcct

SEQ ID NO: 88980 - DNA, 1042 bp, Homo sapiens
aaaaaaaaaataaataaaataataataatttcttgctgttagaaatacaaattaggaatataaagttttctgcttttcatgaagcagaaatggatgaagtaagaaaaaatgggttttggaaaatactacttgttagcagagggttatgtgtaacatactagtcctgaaatatgttggagctaaaggtcagaagtgtaagtgcactgcattggaatttatttctttgcaaaaacgttgtggctatttgattattcttctaaattgcatgcactctttcctgaaccctgcttctcctctgccttaattttaagcattggatggactttatcgcctctaagtttctctgaagtaaggagggtcatgtggttattgtgactagcagttaactgtagttgaggcatagatatgtcttgagtatgttatttgaacaaatattagctaacttgtttctttcatcttttatttgcctatgatttgaatttattgctgtatttacccttgggaacatttattgattgactgttttgttagattagtgcattgatcttagtttgatactagtaagaagggagaatggaagttgctaagagttacttagtggctactctttgagcagtcatcttaaatacagcaccctcgtacctacccaagtgatggaggtgatgatagccattttttagaatgctaagatcaggaaacagaatcagagttccagtgatttgcctaaggccatgcatctagtaactaccaagaacaaggatctaaaccctgaacttttactctagagttacttaaaagttttcactgaaatatgctttcttagcttggcatggtggtgcacgcctgtagtcccagctacttgggaggctgaagcaagaggattgcttgagccccaggagtttgaagctgctgtgagctgtgatcttgccactgcactccagcctgggtgacagagtgagactctgtctcaaataagtaaattacattaataaataaaacttgctgttttcatgaacattagaaatctaagcaatactaagta

SEQ ID NO: 88981 - DNA, 2314 bp, Homo sapiens
gttttttaatttttcagaaacggcagcacaaaaggaaatctatattaatagaatattttgttgaacaaaggaggttagataagaactgcaaaccaacagactcagcaaacaaggaaagaaacgtgttagccataagacatgtttcaagtgaatcgaagtccaataactgtagacttcagaagaaaaaagttttcaaaaattttatcaaaacaggtcactgataaataactcctccagtaatagagctaggcctgaaaccaaaattaattaaaaaattaacaaaacagattgaacctgaattaaatttcttttgataaaaaaacttattaaaaataatcaaaattttcctcaaatttttattaccttgtccaaagtaaagcaagtgtcttttagcattcatgccagcttttctcatgttctaggaatgacagaaaccttacttgaagcaaactagtatttttgttgaaaatgtatatcagcatcagttaaagttgatttttcagacctgctcctcagtaataatactagctagtcagcattcacgcctaccaggacacaaaaatcctcttcaaaactactcagaaaagaaagtcattactcaggaatgatgtccattcaggagaaatcaaaagagaattcctccaaagttactaaaaaaagtgacgataagaattcagaaacagaaattcaggattctcaaaagaatctagcaaaaaaatcaggtccaaaggagactataaaatcacaggctaaatcttccagtgaaagtaaaataaatcagccagaattggaaacacgcatgagtacaaggtcatcaaaggcagcatctaatgataaagctactaaatccattaataaaaatacggtgactgtgaggggatattcacaagaatctacaaaaaagaaattatctcagaaaaaattagtacatgaaaaccctaaagcaaatgaacagcttaaccggagatcacaaaggctacaacaattaacagaggtttcaagaaggtcgttacgcagtagagaaattcagggtcaagttcaagcagttaaacagagtttgccaccaactaaaaaagagcagtgtagcagtactcagagtaaatctaataaaacaagtcaaaaacatgtgaagagaaaagtactggaagtaaagtctgactctaaagaagatgaaaatctagtaattaatgaagtaataaattctcccaaagggaaaaaacgcaaggtagaacatcagacagcttgtgcttgtagttctcaatgcacgcaaggatctgaaaagtgtcctcagaagactactagaagagacgaaacgaaacctgtgcctgtaacttctgaggtgaaaagatcaaaaatggctacttcagtggtcccgaaaaagaatgagatgaagaagtcggttcatacacaagtgaatactaacacaacactcccaaaaagtccacagccatcagtgcctgaacaaagtgataatgagctggagcaagcaggaaagagcaaacgaggtagtattctccagctctgtgaagaaattgctggtgaaattgagtcagataatgtagaggtaaaaaaggaatcttcacaaatggaaagtgtaaaggaagaaaagcccacagaaataaaattggaagagaccagtgttgaaagacaaatacttcatcagaaggaaacaaatcaggatgtgcaatgtaatcgttttttcccaagtagaaaaacaaagcctgtgaaatgtatactaaatggaataaacagctcagccaagaagaactccaactggactaaaattaaactctcaaaatttaactctgtgcagcacaataagttggactctcaagtttcccctaaattaggcttattacgaaccagtttttcaccaccagctttagaaatgcatcatccagtgactcaaagtacgtttttagggacaaagctacatgatagaaatataacttgccagcaggaaaaaatgaaagaaattaattctgaagaagtgaaaattaatgatattacagtagaaattaataaaaccacagaaagggctcctgaaaattgtcatttggccaatgagataaaaccttctgacccaccattggataatcagatgaaacattcttttgattcagcatcaaataaggtaatctgtttttattatgcacaatagaggtgccgaaatattttctgtaagaaatgtctttataacattttagcataagaatgaagtcataaaagattgaagagttgtttaagttctcctgttaagttgttagcgagagttttattaacccagtcttgtgatagaacttcagatgtctca

SEQ ID NO: 88982 - DNA, 1445 bp, Homo sapiens
gacggagtttcgttcttgttgcccaggcaggagtgtagtggtgcgatctccgctcactgcagcctccgcctcccgggttcaagcgattcccctgcctcagccttccgagtagctgggattacatgcgcccgccaccacgcccagctaattttttgtctttttagtagagacgggggtttcaccctgttggccaggctggtcttgaactcctgacctcaggtgatacccccgcttcggcctcccaaaatgcgacagtcctattaattggatttaatctcttcgaatctccctctcttgtaggacatttttctccaagaccagccctcgataccctcagccgtcgcaaggcaacctccagccgccaggggccgcagtcgcgctcctcgcggccggaagagagtgcggcccagcgcagcctcggcgtttccgccatgcgcctgcagtgctccgcgcgctcttgacgtccggagcccctggagtaggcgcttccggccattcatactgcagtcggtcagtgttcggttgaaggattctgtgtgctgtcggacccagagggtgacggcgccgctaggatgaagctcgtgaggtgagggagtgaccaagcagctctgggggctgtgaagggagggcttggcccggagtccggaaggctgggctctcccatttgcaggaggcgggaaagccgcgtgtgcgcggcctgctaacggccggccttactgcgcccgcagctcgtgctcgggcctgggcttccgcctgggtcgctcgcggatcccgcgtgtcttccaagagattggtataaaggccgagccttttcttcctgcctagtgacttagaggctttaaagatgcagcgcctcctgggacacatctccctcttacagttactcattttctttttgagtggaactccccagtcctgcttaacagtacttagaaagctgtatgagcttatctggaaacaaacctgtttgcaaaatattttaaatcagagaaggacttccggcttcacaagtttttgtttttttaaataaagatggtgtctcactttgttgaccaggctggtctcgaactcctgggctcaagctttctgcccgcctcgcccttccaaagggctgagattacaggtttgagccaccgtgcccggccgatttttaagtttacctttttatcctccttagatttgtgattgattattccacctctatttccctttaaggtaggctttttatttaggaaaatctcccaatatagggcagaaattatcacaacgtaattgtggctgattactcagataatatatagttctcctgttttatttcttaagaaataaatagaccctgtcagttaggtgagtcttctgaaaacttgtttgctgatgtgaataattctaaactacctgcaagtagatttggttttggtgtttttccttgagactaagcctggaac

SEQ ID NO: 88983 - DNA, 2057 bp, Homo sapiens
ttctcctgcctcagcctcccgagtagctgggactacaggtgcccgccaccatgcccagctaattttttgtattttttagtagagacggggtttcaccatgttagccaggatgatctcgatctcctgacctcgtgatccgcccgccttggcctcccaaactgctggaattataggcgtgagccaccacgcctggcctatttctttttcatggtttataatgagtctaagatcttgtatgtctggatttcaggtttgagaattagaaacgtccaaatgacagtttatgttagtattgttgtgttccttcataaaggttgaggatataattcaggaaagctgaaattgttatgcagattattgataggaattgatgcagatagcatctagcaaattttcaacatcgagttgtttcaccctttcaccttaataaatgtgattttaaagtgttacaggtaaaaatggttttattcctatttatagatttttgatgaaattgagtcatgaaactgtaaccattgaattgaagaacggaacacaggtccatggaacaatcacaggtacggaggttggactgcttttataacattttttttcttctcttttacctagccagagtttatttttttattgcttaatgaacattattgtagtacaaatccttattttttttgtctgaattatgtaattttttttttttttttttaaacagttttgctctgtcacctgggccggagtgcagtggcacgatctcagctcactgcaacatccgccgcctggggtcaagcaattctcctgtctcagcctcccaagtagctgggactacaggtgcctgccaccatgcccgggtaaattttttttttagacggattctcactctgttacccaggctggagtgcagtggcacaatctcaggtcactacaacctctgcctcccgggtccgggttgaagcaattctcctgcctcagcctcccaagtagctggggttatgggtgcgtgccaccacacccagctaattttttatatttttggtagagacggggtttcatcatgttggccaggttggtctcgaactcctgacctcatgatccatcttaacaaaagcagtaacaattcttatatacagagagaagcagaaacaaaggtgaggatagtttggtggaatggggattatgaggaagttacaaagacagtgggagaaacatgaaagaaatacctgtcacatcagtagtgagcctaaagcccagtcagggttcttccatggcttgctgcattcacttctgtaagcaaaacattagtgtgctaggaaaaatctctaggaaggaaacactgctgacattcccccatttaccagttgcacatgtgctaaattgtgtcatagaaaacttgcactttgtagaagaacagtaatcttttgtagtccagtatttactgtggctcagtagattaattagttgccttaacttgtatcatactaataactgcacaattattttcctctttaggtgtggatgtcagcatgaatacacatcttaaagctgtgaaaatgaccctgaagaacagagaacctgtacagctggaaacgctgagtattcgaggaaataacattcggtattttattctaccagacagtttacctctggatacactacttgtggatgttgaacctaaggtgaaatctaagaaaagggaagctggtaagtttgaaggattataaacatttttgtgaatgctaatcctaatccacactattcataatatagatattatttgcaaacaacacaagtgtctttgttgtttaatatttcctatagtatgtatagtaattcttggtgttgctattaaaaacattgagcaaccggacgcagtggctcacgcctataatcccagcactttgggaggccaaggcgggtggatcacgaggtcaggagttcaagaccagcctggccaacatggtgaagcctcatctctactaaaaatataaaacttagctgggcatggtggcgggtgcctgtaatcccagctactcgggaggctgaggcaggagaatcgcttgaac

SEQ ID NO: 88984 - DNA, 1022 bp, Homo sapiens
attgtgatttgatgtaatacatttaaactttcctggttttgaattaacttgcttggattttattcagttaccaaaactctggcatcaaggtgatcatgttttattctgtgatatatatcttccctttttttgtgaggttcaaatcattttatggtgaatttgagacatgatataaagaaaaagtatttttaaatttgacacatttcttagtaaataaattgaaatgaaacaaataataatctccctaggcctttagttattggttctgcatgataatgtgttggggggtggagggaatctgaagtctaacacatttaacagaagctagttaaactttatttactgtagctactaataaagagctataaacagggaaaggtgtgtgtgtaaatgttgtttgtggtgtctaggtaacattggtgcaggagagaattgaacttggtttgtttttcttttccttcagttgcaggaagaggcagaggaagaggaagaggaagaggacgtggccgtggcagaggaagagggggtcctaggcgataatgtctctcaagatttcaaagtcatatgagatttgggatattttttgtacaggttgtgtttgtttatgtcagtttttaataaacataaatgtgggacagagctgtctatttagtatatcaaagttttagtagtttcctccacattcacgaaattaccacagtgagagctaagcatttctactgggcagtttcatttttagttgatcaggttttaagtttttgaactaaaatttttctttttctttttatgatgaataaggttaaaataaaagccttagacaaattaaatttggcagagtttaattgagcaaaggacaattcacaaatcaggtagcccctgaaccataataggctcagaggcttcagcccagctgcatagttgaagatttatggacagaaggaaagtgatgtatggaaaatggaagtgagatacagcaacagccggattagttacagttcagcgtttgccttatttgaatatgg

SEQ ID NO: 88985 - DNA, 1032 bp, Homo sapiens
tgcactccaggctgggtgacagagcaagactctgtctcaaacacacacacacaaaaaaaaaaaactctaggtgattccagcatgcagtcacatctaaaaaccactcttagggtggatttctcttatgtttgacttcataggatacatatataaggaataactatgatttgtcccatttaccacatagttgactgcaagacaaataaatatatgaatataaggaaagaatgaagatgcttgcatgcttttccaggatagaggacttaaacactagtttatatttttcttctccatagttaacataaagtctgtagttagaaatggatgtcttctgtgatacaacaaattaatcactgagtttcctgtttctccccattttagaatgctgcttctaaattacttgggcaaaattgggtccaaaacgcctttgatggcagctgcaactttttccgttggttggaacaccttcgcttgctcagagtcattggaaaaaccactgaactggctactttttaattactatttgacaacctgccttcagtcttcagttaataagtgagtcatctttaaaatctgttgtctccagggccgggcccggtggctcacgcctgtaatcccagcactttgggaggctgaggcggggggatcacgaggtcaggagatcgagaccatcctggccaacatggtgaaaccccgtctctaccaaaaatacaaaaaaattagctggccgtggtgatgtgtgcctgtagtcccagctacttaggaggctgaggcaggagaattgcttgaacccaggaggcggaggttgcagtaagccgagatcgtgccactgcactccagcccgggtgacagagcaagactccgtctcaaaaaaaaaaaaaaaaaactattgtctccaaatgattacatgccccaacagtaaaaaaatttaaagcgtaatactaccaatatatgtatatgtgtttatacactgaataaatttactactgtaccaaaatattatctttgttgtaaatgcatataaataaaaaa

SEQ ID NO: 88986 - DNA, 1777 bp, Homo sapiens
ccggccccctgcgctcctcgcgctgccggccgggggagagcgtggtttccttgcggccgtcgctgtagcctggccggggagcccggaggaagcgggagagtccccgcccacggccccctcccctctgcccgctctccgccgccgcctccgagcagccgcgggccgccctccactccgagcggggggcgcggcggcgacagctgggcagcggctttgggctccgcggggaccgcgccgccgcccccgtgagttattctcacgtcccccggggctcgctgccgcccccgccgacgcctagagtccggcccgggcccaactccctcacgggccccccggcggcagcggcggcggcggcggcggcagcggcggagcccaccgcccgggccccgatgagtaactcccggaataaccgggtgatggtggaaggggttggcgctcgggtagtgcgcggcccggactggaagtgggggaagcaggacggcggcgagggccatgtgggcaccgtccggagcttcgagagccccgaggaggtggtggtagtgtgggacaacggcacagctgccaactaccgctgctccggggcttacgacctccgcatcctggacagcgcgcccaccggtaagccgcggccacctggccagggcttgcgcgcgcggggggaaggggcgagctgcggtgggcgtcggtgtcgcggggagaggtctgcagtgggacacctggtgggcagcgcccggctggagcgagcggaaaggcaaagcgccaaaggaattctaggttccgaacgggtgaacaaacactttcagaaaagaccctctacccccaagggaaatgatggcagcaccatcaccgggatgctttcaagcctggaagacacaaagcaccgggaagagaacagacacaggtcccccaacccgactcctcctcttgggaaggggtctggagaggcctatctaataagccattgaaattaatcagccaccaagtgataactgtctgaagggaggcttgctttgccatatggtgctcagctgaccgtttataattgccaaggggccttggtacctcggatttgtggagatgccttttttttttttttttttaacctcctgtgacacagaattacttggagttcagtagccaaatgttacttgggactctggaatgatttttcatccaaattgttctattttatatctttatatcaatagagagaaaaacatcctgagctcttgaaccatttctttgtgttaaatactttttccaagtggcagatcggcgtgggggacacctgatgttattttttgttacactaacgtccgtctcagtaaggtgatgtcagaatcttactcattcacccagcagtgagtcagggtccttgattagtgaatcttgattagtgaattttaggggtctgttattgacgctagagtttctaaatgattaaaccaaaggcttgctttcacaaaataaataacaaattcattttcatatagattcatctttggtattatttatccttgatatttatccttgattctgtagaaaatagttcacatttaaaattgggtacttttcagaattcctaaatgagctacttctaagacattgagtttggcaaagccttacaaatcttggaatgggctcacagttattatcagtagcaataaagaaattaacacaagccaactcagtttttgaacagataattcgtaaaattgtgttccttagctggctttttaaaaacatttattaaaaaaaatttttgttttagagacag

SEQ ID NO: 88987 - DNA, 1058 bp, Homo sapiens
aaaattaacactaatacggtaatactgtattaactaatctatacaccttattcaaattttatttattcaaattatatgcagtggttattattagtgtcctactagtattctttttctcatccaagatcacacgttgcatttagtggtctcttccaatctgggtgagttcctcagtctttagtcagtgtcaaagtaatgaaaaacaatcttgttatctctcaaattgggtgtttctgctgctttttcatgattaaattcagattatgtattttcggcaagaatatcatagaaatgatgttttgcccttgttagtgcatcgtaccaggaggtacatggtgttcgtatgtctcattaattatagcgttaactcggctaggtcaccaggaattttaccaactgttgcttttgtaccagcaatgtgatgccagtatgaaaaagataacttgtatcttacatattattgtgaaaatacttttgacttcatgaagtccctcaaagggtcttgaggatttccctagaggttgaagaataacactttaaaagtcactgccctggagagaatctctatttgagcacatagaagcttgtataagaatgttcacagcagttactatggttttgagataaataaaatttaaaaaagaatgttcacagcagtgttgcatgtaaaaacagaaaattggaaaaaacttaaatgtaccttagcaggagactggataagttgtatgaatttgtatagtgcagtactgtatagaagagaatgttaagcaaataaagtaagttgcaaaagaaaacctacggtctgttaaagtgcggaacaaaactattttagggtagggttttgcagccttggcactattgacattttgaattggataggataattttttgttataggaatgtcctgtgcattgtaggcaggcatccctggcctctacccattagcagcagtagcaccccacctccttgtggcaacccacaatatctccagacattgccagatgtcccctagtgggggcaaaattgctcccaattgagactcattggtttagggatat

SEQ ID NO: 88988 - DNA, 1092 bp, Homo sapiens
ctgggagacggaggttgcagtgagccgagatcatgccaccgctctccagcctgggctacagagtgagactctgtctcaaaaaaaaaaaaaaaaaaaaaaaaaaaaagacagtctttttttttttttttgggacagggtcttactctgtctcccaggctggagtgcagttgtgcgatctcggctcactgcaacctccgcctccctggttcaagcaattctcctgcctcagcctccaaagttgctggaattacaggctcatgccaccacgcccggctgcttttttgtgtttttagtagagacagggtttcaccatgttgaccaggctagtctcaaactcctgacctcaagcgatccacccacctgggcctcccaaagtgctgggattacagatgtgagccaccacacccggccagtcttttaacattttaaaatatgtctgagatttatttgaatattgaaataggatttaataacttatactctaaatccagtagagtgcatgggggaacatgatgccctagatacgtaattattctttaaataagatccatgctaggtgcggaagaaaaaccacaaaaaaccgtggtagagtgaatgaagtgctttaagaggccatgttttgtgatcagacccagttgggtttgaatttgaacctgccacttactaatgttgtgtgacttcaggcaggttacttgtctgagactcagtttcttcatccataaaatggggataacaattgcttactttttagaattgttgggaaggttaaataaaatgtgtgtaaagaaccaagcttggtactaatagatagtggctggtattattaataacaacaatcctattttcattaatttagtatttctctagagaaaggaatgtggactttaccaaccagctggcaggtcacaaaggccttgccctcactgggaattttaattagagttgaggcaatttctaaaccagttaaatattttgatggttcagggaaaataagatggatattcttgttggttaaccctccttagtctctgtaatactttttgttacatttgatttgcggttaaagttgaatgaatccataaattagaattt

SEQ ID NO: 88989 - DNA, 1022 bp, Homo sapiens
ataccctgaaatgcttagactaggatcatatgtggagtccattacattttaacttttgtggccttgggcacattacttctttgagactcagtttcctcatttataaagtggataatatagcggtaactttctcttaaggagtgtaacacactttactcctatgcaagtgcttttacatattatataataaaagcttagtaaaagttagctgtgattattattacagctactactgccatcatcatcatcacctgtggaatataaaaggtattcctgtatcatgctattatggtagtaaccagaacaatgaagaatctttttactttcaaaataacatttttataattttgttttaaaaagtaaattattgttacctatttttatataaacttgaaaataaataattttatttttagggttctgttagagtctcgtaggaaatctaagaagattacagccagaggaatctttgcaggtgccagagtggtgcgaggagtggactggcagtgggaagatcaagatggaggaaatggacgtaggggaaaggtacagtgtttctctgaattcattatgtattctagagtattatatgttcagaacctttttattactactataaatgaatttcttggtccattgttttccatgccagtaacagtttttaaaatcttgatttcttttttctctggaagtaaaaagattgttcttgctttttgtaagcattgatgttccttagagggtcattaggtaggttttaccttcccaccttcaggtttcatattgtcattttgttacctagcatgcttttctgaacgcatttgggccagtccctccctaagcagtatctcatgtcctcaactttcctgctatttaaatttcatttgaattgacttgttttatattctcttccctcaaagacctgtttctgaggcacagtgggcaattatgctgttatcgagcccacctacctctgttatcctttgcagatagcatagcgggctcagagttttaggagtaggtca

SEQ ID NO: 88990 - DNA, 1052 bp, Homo sapiens
tgtgtattttctattgtatcatataaaggggcacataaagtctgattattctgctattagtgatgttaagattgatgaacaggtgcaaattttgtcagatgtatcctttacagagtttcttggcaacattatacctaatggttttaacagctgttccttacatgtgaaattactgtagttattttcttatgccctccactttgtttcctcctcaataataaatcaagtcatattaacaaatgaaggaatttcatttaatgatttggagcttgactaatgaacttacttctatttcaagtaatttgaaatttaaagtaaatttgatttaaaatttgtctttgttttttagctagccaaatgcttttttactcatcctataaaatacagacttaatatagcatcacattttttaaaacaaatgaagttgaatctgaatatattagaatcagaaggaactttttgctacagattgcatgttttaccttcgagtgctagaaactgttactttagaaggttatgtagtggttagttgagcaggaatcataaagcaaattaaggtaaatggtggactcttaacttcaggatggtagttacctctaatggaaggcaggaggatgggattgatgagatggacataggggacttgaaaagtactggttctattttttttcttaggttgggtaataattacatgggtgttcagtttatttttttattccttaaagtttacatatgctttgggaggctgaggtaggcagatcacaagatcaggagtttgagaccagcctggccaacatggcgaaaccccatctctacttaaaaaaaaaaacgaaaattagccgggcatggtggtgggcacctgtaatcccagctacttgggaggctgaggcaggagaaccacttgaaccggggaggcggaggttgcagtgagccgagatcgtgccattgcactccagcctgggtgacaagagcaaaaaaaaaaatttacatatgctgtattttataatgtgtaatgtatttcaaaatttaaaagagtaaatggactaaattac

SEQ ID NO: 88991 - DNA, 1027 bp, Homo sapiens
atgtgtttttcaaactattataattatttattaattataagcattttagtctaatgtaataagattcagacattttattttatttatttattttttgagacagagtctccttgctctgttgcccgggctggagtgcagtggcgtgacctcagctcactgcaacctctgcctcccgggttcaagcgattctcctgcctccacctcctgagcatctgggattacaggtgtccagcagcacacatggctaattttttttgtatttttagtggagacggggtttcaccatgttggccaggctggttttgaactcctgacctcaagtgatccgcccatcttggcctcccaaagtcctaggattacaggcgtgagccaacgtgtacagccagattcagacattctaattttgagctttaaaagaatgctgaaagtaaataaaatatgacctatctgaagatcaggtttctagtttttacaagtacttttgaaagcagtgtttagtgtgattgttgacctagactgttcttgatttctgttttgggtatgttctgaatgaatattcttgcctgtttcagatactgagccatatttgaagtttcatgggtgatttttctggtttcttttcttcttagtctgatctgaaatgtgtccaggatgccaagggaggttctttctacagagatcactgccctgtgctaggtgagtgagaagattagagagtattactaaataatgggtcagagttcgtggaatcagtaaaatgcttaaattggatgttagaaaagttaattaccactaaagttacttagagaaaaaattttttggctttcctttggtcttaaagtattttttcttttattatgctttatttggactcagagttgtcatgtcttgagaattcattggccatttatgtcataatatacatttgaaacttttatgttttaactgcaaattatattgttgaaaaattttgcattagattacaacaattgtatgttatacactattgagaataggatttgacact

SEQ ID NO: 88992 - DNA, 1024 bp, Homo sapiens
ttgacatattttaaaaagctctttagggcaagaatcacaggaaccatttgttaaaataagatagtactaagcacttaatggaaaaaataattccagggctttcattcatattctctagttagttattgtggttctaatgcagtgatagtaagttatccaggcataaaagtgagtattttcaacacctggaactttgtgttctgatacaaggttgaatagtcttttatagactctacttttactcagtctttgttataactcatattatttcaatttttgagtctgtttggcttttttctttttttaaaaaaagctttctagttctaaaattttatacttatagggaattctcaagaccttttaaaactagatggtacctgaaactaaaatatctacatgttatttaaagataatgcagctgcctgttgttgtgaggtttttttctccctttattcaattgcctctgaaattacaggtgagcagaatggcaacaggaatcctggtggattgcagattggtgacctggtaaatatagatctcgacctcgaaattgtacagtctttgcagcatggtcatggaggatggactgatggaatgtttgagactttaactacaactggaactgtttgtggcattgatgaagatcatgacattgtagtacagtatccaagtggcaataggtgggtgatatctctcaatttttgacaatgacaaataaaactaatatagagaaaagtcttagagaaagcaaataaagtgatacaaccaaatactcattaaagctagcttttagatggtaagtaaaaatccagaatatatattggtaaggtggagagaaacaaatgataagaattacgtgtgtgtgtgtgtgtgtgtgtgtgtgtgtcttgtgtgtgtatgtgaatttatatgaggatgtttatgatacagtgttctgtacactatttttccttcaagaggagaatacattatatcactattaggtctgaatacagcttaaaagttctgtgttcgtattggacta

SEQ ID NO: 88993 - DNA, 1025 bp, Homo sapiens
caggagttcgagaacaggctggccaacgtagcgaaaccctgcctctactaaaaatacaaaaattagctgagcgttgtggtgcatgcctgtaatcccagctacttgggagactgaggcaggagaattgcttgaacctgggtaacagagtgagactctgtatcaaaaaaagaaaaaataaagcaaacaaagaacagtttacttgtgtggttacagaaagttagtaaacaggcttttatatgctaataaccatttggactaaggagaagaggatataatatgccaatattgtagaaacttacttgacaagggaacctttactcttggagttcagtgtggaattagggtaggtgttctgttatcaattgtggtacatctatttgatggaatattaagtagtcattaaaacgattattttgaagatgatagcagcgtggaaaatgcctgtataaagacatcagcattcaaattagtttgctacaatgattacaattatggtaaatatccatgcatggaaaattaaaactagataatatttttatccattaaattggcaatggtgtggggaaatggtacactcattgtacagcagtttggctctattggaattgtaaacaaatgtatgctttgatcagatagttcttttaagaatctctactgaaataccgacctcatgtgcacaaagatgtatacgcaggaatggtctttacagtactgtacatattggtgacaatttggaagcactttaaatgctagtcaataggagaatagttaagtacattagtgtatatccaagtgatggaatactctgtagcagttaaattgaattaaggtctattcaatttaggtctgtattcttagacctatttaagataggtctgtatctgtgacactaaaaaataaatcttccaagatgcattctttgaaaaaaaagtcacaaaatatatgtatgtgtccctatgtctgcgtatacatatatatgtatataatattcccatttatggaaaacaactagattatgaatgtca

SEQ ID NO: 88994 - DNA, 1002 bp, Homo sapiens
gacaaaggaaggagaaggtccagataaaatttagaagggatcatggttaaattcccatacacagttattattgaaaaaagggaataaggaatagaacttctctacagatagtgaaagtatatcaggccagacgtggtggctcatgtctgtaatcccagtgctttgggaggccaagatgggtggattgcttgagccaaggagttgagaccagcctgaacaacgtggtgaaactctgtttctactaaaaatacaaaaattagccaggtgtggtggtgtgtgcctgtaatcccaggtacttgggagactgaagtgagaggatctcttgagcccaggaggttgaggctacagtgagcagagatcacacttattgcactccagcctgggcaacagagtgagaccctgtctcaaaaaaaaaaaaaaaaaaaaaaaaaaaaaaaggcatatcagaaagatacgtgcagaaaaatgatgaaaactgtacttttataatttaaaatgagctaaaaggctgggcacagtagtgtgtacctgtagtcccagctactcaggaggctgaggcaggaggatcacttgacttcaagagctctgggtgtagtgtggatgtctgcactaagttcggcaaggatgtgacctcctgggtgaaccccaggttgcctgtggcgtggggaactggcccaaaatcaaaaacagagcaggtcaaaactctcgtgctgatcagtaatgggatcatgcctgtgaatagccactgcactttagcctgggctaatgtagtgagactgactcttaaaaaaaattgcaaaaaaacgaaaaatgagctaaaagaaattaagaaaatgaaaaaagtgtaagagaatgaaatcagaaattaggtgatataacttaggacataattaaaaagaagtgaaaaagtcattttataagtgaagactaagctggaaggaacacagagcagagcaaataaatgcaagagataatggctaagagaaatagaaggtgaaaaag

SEQ ID NO: 88995 - DNA, 1040 bp, Homo sapiens
atcatccttagcaaacaaacacagaacagaaaaccaaacaccacatgttctcactcataagtgggagttgagcaatgagaacatgtggacacagggaggggaacatcacatactggggcctgtcagggtggggggcaaggggagggagagcattaggacaaatatctaatataatgcatgcggggcctaaaacctagatgatgggttgataggtgcagcagaccaccatggcacatgtatagctatgtaacaaacctgcactttctgcacatgtatcccagaacttaaagtaaaattaaaacaaaacaaaaaaatgtcccaaacaaaagctcctatttcctagctgtattcatgaaaatgcctccactgtgaccattttagtaataaccaaacttagtgcccaggttatggttttcaagcagcctttctcaataaagagccaaggctttttggagaaatggctaattctgactctttgacaagaggtgaacaaaatgagcctcgtaccaggtaacaaggaagctgtcactggtttctaggaccatgttaaaaggacctaggagccaacttgaaggggttcttgctgactatatacagagggctgacgagttattaaaactacaccaattagtaaaattcaaatggtaagaaactttgtaagataaagaactgttttttcaacaaataatttgcaaagaaaaacatgtacttgtggactttatgtggatcttgatttaaacaaacaaaaaattgattatgtggatcttgatttaaacaaacaaaaaattgataatttatgaggtaattggaagtttgaacactggaattttgtgatatgtaactattgtaactttgggtgagttgataataaatagcattgtagaatatgttatcaaaaaaagagttcttattgtttggaggtacatactgaaataatactggaggagagaatgggtaggggaataaaggaaacaagattagccatgagctgataattgttacaaatggttgatgggtacatgaggattcagtatgctgtt

SEQ ID NO: 88996 - DNA, 1051 bp, Homo sapiens
aaatcagatgattccaaaaagggtttaaacatagatgtaagcttgagcccttcttggccaaattagtttatttttttattttttgttttttttagaaatccaattttctttttcaggctatattgatgatagattttagactacttgagttgcaagttctcaaaatgtaccttacagatttcagaagtaaggattgaacatcaaaatagatgtttatgaactcgtatgaataggatagactttatcatgatttgtctcatattcttgtggaagtagttttattattattttaaaagatattttttaacatttgtacttattcaaataacccatttcagtatggttatcctttgaaagttttttcattagtaataagtaaaatcattactttaagcatataaaaactagtgattgactttatggtatatactttagacttggaaacatgaatctatttttttccccaagactttaggtaaagttggccgagtacaacagatttattcagacagtgatttaaaggtggaagtttgtggaacatcttggacatacaatccagcagcagtttccaaggtggcatctgcaggatcagccattagcaatgcatctggtggtatgttttatattgtgtttctttaagagtaatgtggtttacattaaaacctttgctaattccccagttctcatatacagataatgttgtacatgtgcttggctttgtcccagattacacagccttacttgaatgttgaccaccttttaaactttcactaaaaatttttgttttttataatgtgttgaacaacctttattctggctgaagtactccctggagaagttccataaaatgtgtgctttttcttgggcatatcaggggattttccacatcaaatttgagattcctaaaattcagaattctactctttagtcagaacttttgttttctgccaaagaaccatcactttcttagacttctttattttttctgtatttccaacattattgctagcagatggctttccttcctgtatatttttacatatcagttatt

SEQ ID NO: 88997 - DNA, 1047 bp, Homo sapiens
agagattgttgcttttgatcataaccattaatctgttgaattattttaaagtctgtagtattgagctctgagagtcactgtagtgtccttaaaacctgaaaggaagtttgtatcattgtggtactcccatggtagtgtgtttattcataaacttcttatgatgacttttaaatcttgaattattattagtatataatgcactactttttctaaaattataatttgatatacatgaattggagaaaacttggaatacttaagggcttgcatttaatacagctttttatagtagtgattataacttgcatgggtagaaaaataacattaatgatggaaagaataaaataggaaaagattatagaaatattgggtaatacttgtttcttagtagttaaggtttgagatcctcctatattagcagctttatttgatgctttacagaaagactctcacaactcctgaagaaattatttgaaacccaagaatctggtgacctcaatgaagaattagttaaggctgctgccaatggagatgttgctaaagtggaagatttgcttaaaagaccagatgtggatgtgagcattttaaaaattattttgaagcatacaaaaagtagaatagtataatgaaccttatcctcaacaattactaagattttgccagatgtgcttcatttatttcttctttcttgtttttgtgaagtattttaaagcagacatcagacattcttcagtgtgcatttctaaaaaaaccagacatttttgtatttaacattatgaccttttttatgatttacacacttacattttggtttttaaagactagtatccttttgggaaattcagcgattttttttttcctcatgtaaacatcattttatgacatcttctaagtatattttagtgaattttataagcaattttctttttatttttaatttttgtgagtacatagcagatgtgtatataagcaattttcaatccttcttttcaaaatatttaatgtaactcctctccaccccagtgatagttgactatttcacaattt

SEQ ID NO: 88998 - DNA, 1097 bp, Homo sapiens
tatataactaccttgctaacttatttatatatccttatttattgtccttgcagtttgcctgcaagttgatgtttggtatttttgttgaattgaatttatttatccctagcagctaatatcttttctaaaagttttcttttcacttcagtgctttttttcattgaaccatggactcagagattaatctaaaaagaaatatatatacaaaaccaacttaacttacttcctttctttctcccttctttcaactttgcagattgcctaacagttatttcgtaactctttggacaatgaaacttttgttttttaaaacaatgcttgcttcccttctcaaaattaagaagtctgtagttatctgaactatgatatatggaacaccaacctaaattattctcgtggaatcatacagtatactagacttaaacctacaccgtatgtatatattgcctgtttctgattattcattcattctttcattcttttttttaaaaaatgtaggtaaatgggcaatgtgctggccacacagctatgcaagctgctagtcagaatggacatgttgacattttgaagttacttttgaagcaaaacgtggatgtcgaagcagaggtaagtaaacttgaaaaatattttaagtaaacatttatttcctagaaataatacttctatatcatgagatggattgtttttatttttgaaatttagtatccaactaaggcttttctgattgaaaataaaaatctgacagaggcaacttgaaacagttcttgtctttctgtgatcctttatattttagccatagtcctaggtaaagataggagttgagtttcatattactgtggtgtaaccatcatgttttaggagctaaaggtgggcttgtccaagaatcaagaatcatactagggaaattgaaggacgaggaatataaatccactgggtcagaatctttcctgatctctgtgacagttggaaactttttttgttgttgttttgtcataactgaattagcattttttaagttttattgtttcttgaccttaatgtgaatatttgaagagttcataatgcatgtttatcaccatatgtgtgtatatatgctt

SEQ ID NO: 88999 - DNA, 1575 bp, Homo sapiens
aatcttatagaggttagctgtaaccttgttccttgaaattctcttttggcactaggaacaggacaggcacatgagctgtgttttaggtttatttggagtatttaagatggattcagaagaaagcaacaaaacttacaagttaagattttattataactgcagttttctaatttagaagagaaacctggaagtaaatttaattatatttaattgtaattttctagtgtgcgtgtgtattttccataatttaaaaattattcttatttatttccttttgacaaacatatcagtttttaattctttggtgtttatttttatgtaaattattgacagcctgcattaagtgtttcagtagtgattttctaacaaccatacagtgttagtggcctgatgttcccttttttaatggaaggtgaatcacaaaatagggttaaaaactgtaacagaaaaaaaaaaaaagactggaagttaggaagattttaactctaagattctgaattatatctgttactagagagattaacttagagagattaacttatgtatacatgcatatatatcttatttttgttttgttttttaaaacacttgtttttctgggatgtttgaatataatgctactcagaggcacaagagttgagagaggtgccaaatcctaaccacaagacccccagggaaaaggcacaagagttgaatcttaaatcttagatgtggttgtttgccagttcctttctcaaaattgatacgtaacaaaaactgattcagctggaaatatcagtaaggtagaaatatccctgagttgtaggtccctactgttgtggattcctacatgagtgcttttacctttaatacctgtttgagaaaatacgcaaagaccaaaaactactttgagttctgtaactgttttgaatgaactatttaagtgcatttaatcataacagtgtttatctgtgctttctttgaaagtagttcagataatcctgggtgccatatggattgtcagaccccttgcaaaactagggagtccaccaggggctggcacagtggtattgggaatcggaaaccactgctttggatggaggaagtcttagagtaccaggatcagggacagacacatggtcttggtgggtgttaaaatttgcaatgcagtattggaataaatgcaatacgcttatacctactacccttttccatctgcttctggcaaggcagtgagacttcttttcatactttttggtataagctatgtatactaccttcatggcgcagtgcaggcagtttttcccctttataaagtaccttcttttagttttaaaaaatttaagcaatttggtctttcctgccttctcatttcttcagaaatatgcctgttacaggaggtgaggcaaatctatttgattcttctgaaatagttttggaatttttgatatatggaattttggtagtttatgcttcgtttttatcttttaatggtgtatttaattttttttctgttctcgaatatacagaaaaatgtatgctcatcacttaaccagttttaatgtgttgataaattgctccccattaaagccagtt

SEQ ID NO: 89000 - DNA, 1072 bp, Homo sapiens
ggtattgctaggatcctattaaagggaaacattaagttctatggtaagcattcctttgttaccgttctcatatgtcatagtaaatgataccaaaggcgtaagatgttacaaaattggcagctatttcttttttaaaaagttgtttttttttagggaaaatgccaatagattgggttttgattgggcagggagaatgaggacttctttgtaaaaatatcagcttatgaatggatttaactttattgatcatgacagtgagctcaacagcttaaagaagtgtaataggctatatttcataatagttacttcataactatttaaattattttaattgtagcttttattgtagcttagggactttgaatagtcgttagtgtaatcttcggagatttctgttttggaaaatgtataggattttagagttgatttacagtaggatctaatttttgaagcaatgattgcctaagaaatgattatccccagctacagttttataaccagataaattaaaccacaaatatatagaaaatgtagtctgtgtccattttctgcttagtttggttactaagcaacttgtcttttgtgcacctgtttgattaaagtttctatacttagtaattttgtagctcctgaatctaatttgccaacttttaggttccttaaccgaataggcttgaaacaacatattatttttaaataaaagtgttccctgaaatactatttgaatatgtaaaacataatttgtttccattggaaactcaataatgattttttaaaaagtagggcagtggttagaatcataagctgcttgtagtttagataatttacagcatccaggaattggttgctggattggatagatctcagagaagaaataaagaacagtagtagtgggaatgagggcttgagaagaactgaaagaatagattttgttcagctagataattattagaaattaaggtttttgaagtgcagctgttttggaactgttgggatctagagtatgtccttgtaagtgggaggcaggattggaggatgagggaagaattgggggggtgttaatctgtaagga

SEQ ID NO: 89001 - DNA, 1049 bp, Homo sapiens
cactttacatcaccttttctgtattatggtctgtctgtgaagcaagaccaaaacacatgggcagtgaatgtgtcaatacctcattcctcttgctgcttcattgcttagagttatctttgctctctcaccaattcttagcttccaactagttttaaaattttactcattctaccaatccttccaacccattccattctgttcccactgttgctgacccaattaagtactcaccacatttacctagactattatactattcttctaatttttttctttgatttcagtctttttcttgatttaaattttatacatttacaaattatccattctgaaagcataggtctaaatggctctcttcccctgtttcccaacttcagtttttgtctgttaacatagaatacaatctacacactttggcttggcattcagacccatattctgtgtgtcctgagtctgtttaactttatctcctgctaatccaatccctcagcccgctttgcccatcgtctattctcctttcctaaaatatgctgtctgctttcttcttctattttttggagcattttctttctttgggatgccccatcccgcttctttatcttaaccgtctttcttccagagctacctcctgtgtcatcactggaattattttgtttgctctatacttccttgttctgtgtgtgttttttttgttttttttgtttttttttttttgaggcagagtcttgctctgtcacccaggctggagtgcagtggcacaatctcggctcactgcaagctctgcctcctgggttcacgccattctcctgcctcagcctcccgagtagctgggactacaggctcccaccaccatgcccggctaattttttttgtattttttagtagagacggggtttcacgacgttagccaggatggtctcgatctcctgacctcgtgatccgcctgtctcggcctcccaaagtgctgggattacaggcgtgagccaccgcgcccttcctctgtgttcttatttattatacttactatatactctgcttagtgctgttta

SEQ ID NO: 89002 - DNA, 1035 bp, Homo sapiens
gttgtgatgctttttttactttttaaattctgaaatatggtctgtaaacaagactatgttggctatttgaagatttgataagctgtactgtattttggtgtttaatgctttccttacaactgtaaacatgctgagtgctatctacaaaatatagctgagtctattcggtaataggatacttagagtgtgttttctctaatgtatgctcatgcatctactctcaaacaccatattccttgtaatacacaaatgtactttctgtgactgaggtgtaattaataggaggaagaagatcttgaatgaagtgataagatatatatttatatatgtctccttttgcccacagtcttttagagaatgatgttcattttgaaatggaggagtggtcaggagttgagaatgtgtgaacatctgggtctttaaactactcttgtcttcagtaatcttcattaattgctgaaatgtttgtctctattaaataatattaaattatctatagttttattgcaatcattaagaaaattatacggatgttagagtaattgtcactttttttctttacttcagtttatccccactgaaggagaatattgtgtgtatattttttataagggacaaagaagacagtgaggagagtcatagtatttattgttagcagagttcttcattttacagctgtgaaaacaaatatggagaggtgaaatatttcatgagtaaaagtagtgatgcttagcattttctttcttttttgaagactaaaaacctttgattcagggtcagaagaactagataactgttttaagcctctccacaagatattctacagttatcatctttttcaccttacctgctaacattcaggtaaatagcggtaaaattaaaggccaatactatggaagatagtgactaaacatttctagagtgttatataatgttacagttttctttaatttaaatatgcacacatccatgtaaaccacactgtacaatcccattatgtgttcaggtgggttttaggtgacctttccagatatt

SEQ ID NO: 89003 - DNA, 1602 bp, Homo sapiens
agtttggaatccaaaacagttaaatgcttttcattggtaaaattacagtcatggaccttctacaagtgttagaaattatcataccaatgcttcagtcactgaatgtcaaattttccattttgaagtcactttcctactgttttcctgcgcttaatggtttaaaaatcttttccttttaacacattactgcattaaggaatgatcaatgtacgtctttgttttcaacatctttgcttctttttctttttctaatcttgtccacagccgaagtctttgcttaattcttacatgtagacaataagctatttcaaaaccaatagtatttaaaggaacaaatagaccttgatgtattttagagtaatgttttccatttatctctaggcagcaaaccagataaatagttaagctaaaaggttggggaagagttcagttagtcacccccttctactgccactgcttcttttagcattatagttgagggctaatagcaaattgttgatgggtgtaggaatatcagtggccttaagaaagtacctctgccctttgatttataaatagatcacatgtgtattcagtgtattgcttggacttgtgtcgaaaggaactaccatgcatgccagtttttctttgtttttgcttacgtggtgttactaatcatagcttagtaatttaacccttttaaaggtctatttccttgactaagttctttgtcattttgggtacagattgccaagttacttctcattatcgccttagtaatacatggtggttagttacaatccatggatacaagtattaaaatctattgtgtggataatacttgaaaaatcagagtaaatttttgttataatgtggttttactgttgatttcaatgtcttgagaggggtgtcttcttgcataaaataaaagtttgataaattataatttgcctataaagttaagtgctctcagagaaatatagagtagagaaatattctttacagttactattttaaactgagaggtcaacgctaattcaggcagtatgcaaatgactcttacactaagtatattctgcgtctgttggttggtaagtatcatactgctggtgaaattaactacaattctttttcatcattttttctagtagaagtgaaacaggtgttaaactgcctaaacttaagtgctgaagatagcaataatactggcttctatttttactagttatatgggagctgtttagcagatccagttgctcaagtgtgtttttggatggcagttcagtttcatatactggccatatcggggcaaggagaggccatgggaaaaaaatagtacagcatttgataatgtcagcatctgttatccctgtcagggagacagttgaaatgtttgagttataccagtgtcagcagatgcccagagtttaatatgtactcagttaaaaatgaacagctgatctaagtgatagatgtgacattttagagtgattgaaaatactcttagataagttaaactcgcaagcaccagaatcagcatataattttacttttaaaaatgaatagcctgtcattttattttctaaggattatttatatagtcttaatattatagcaaagaga

SEQ ID NO: 89004 - DNA, 1035 bp, Homo sapiens
ctaactttgtcattagtagcttaaaacaggtactgcttataaattttgctaagagcattatttggaattttttataaataatatacaaactgtgtgaaataaaagtattttgatatttctaaacaatggattgatcaagtttagagaaattgaattgtaattgcatagtacaataaaaacagttcttcgatctgtataaattggttcttgactatagtgctttcattttacatgccctctttggagaaagcaaattcgaagataatacagataaattaatttcttttaaatatttggtagtctgttaccaatataccctgctgacttacagctgtggaccagaattttgtcatttttcatgcttaaatcttacattttaattaattttaagttttaacttcacatttaaagtagagatttgggttaagaccctgataaacttgagaaggaaggacaagggccactatgtttgtagctgtcaaaaaagaaagcctttttaaaacaacaaaacttttggtcagaaattcctctaatattaattatacatttatcaaaatgagaagaaatagcttattatgtgaatgaagccagctcttagtatcttatttttctgtacaaatcagtgagccctactaatgagatatacttaagattaaattgtggagacagaaaataggtcatgtgtattcctcattcttttgtgctagtaatactattttcccttttgcagtcaaattttaataatgagagtgcctaatttaaaaatgtaagatgtctgttttaaacttagatgatttaaaaggagtttcatgataattgaaatctacttcactggatcttcttttccttcatgaaataaaaaccttagggatagtttctatctatcagtagtagataaccttttttttttggtgttagtattgccaaaggtcatctgttcatgactaggttaatttaccatatgacggtcattcacgtagaaagaagcaagagcttcttttagctcagtttaattctcccttggtggtttattgc

SEQ ID NO: 89005 - DNA, 1027 bp, Homo sapiens
tgaaaggttttagtctgtgagcacctgggttttatttaccttgatagtttagaatgaaaagaaattatagttggtaagtagccttcagttattgtggtattagaaggttaatttaaaacctcaagaaattttcagatttgtcaaaggaggaaaaaaaagggcagggatagtagaatttctgcagcttgtgataaaaagctagtgcagcttatagagagcaaatcagaatgtagcagtagatagcccagcactacagcagtttcagcaatgcagcattagaattacaccatgcacgttctgatttatttttgtggccaattattagtaagcattaaaaagtattttatgatctgccaagtttcttggttgactaaaccttgaaatagaagctaatagttttagaaaataagtatactttggaagcaggatgtgacttactagagatgcaaaatcatcacttaatctgaaacaataatgactaaatctttaataatgtaaatgacaataatgtatttgtacatttttaagataaaaagttactgccatagtatctgaacaatattcctttttacactacattagctcttaacttgaattgtgaaattaggctatggttagatagaatttaatttaacaatgagaacatatattgagtcaataataggtaagcatgcagaaagtcataagcatccttaaaagtacaggccttatggtgctctgttacctgtaagcttagtgtcatgcagcatttgcagcaggaagaaaggtagtaacctagagaatcacatcaacagcagccatctcatcttgattgttcgttcactctatttgctgattcagcatttcttttcatgagcccggtgaaggaaggggatgtatcagtgaacacagaacctcaccttttaagataaatttgaaaaacaaacgagcaaacaaaaaacaagcttacttttccctctcctcccctcttccctttaccaaaaacaaaaacaaaaacaaaaaccaccaacaaaaacaactctaaaat

SEQ ID NO: 89006 - DNA, 4210 bp, Homo sapiens
ggttgctacaaaggccaagaaaatgaacctagcttgtcagatgaaatgcttcagaagaggggaaaaagttgcagaagttaattttatagtctaaaaaagacaaaaaaaaaaaaaaacaaaaacagaacccaaaacacaccttactccccccaaataactgtaaacattcaccctgtttttctttgccctccagaatacattgggttcttctgacttcttaggaaatagtctgcatctttcttgcttttagattttttttttttttttttttggtttttagtttccaggattaaatagtagagctgtagtgaagctaccttgtcacatccagaggtcaagtctgcaagcgaggtcaggacttccacatggtcactacgaggctaacttatattcttcctcagtgaccactggctaaactgttacagctttataggcagctaagcatttgaaacatgcactcccaggcaaacaggctctcttgtgcctctctcttccctgaccatatttagtcaaccatagcaaaaaatagcctctcagctgtcgattgtcgatccaaaagctgaggaagcctcaatcttgctttctgcctattgattgttcatcctgcggtccaaacactgcttagccatttgtcctgccccccacttttttttttttgagggggggtaagcactgccaaataaagcggtctctcatgtttccacttacatttcccagattttcactgagcttgcgctgagactaggaaagcctgatgcactgtcactatacttagaagcactgcagagaaaaaaggaaagaggaaaaaaattaccatggctagtagcaagacaatctttagacagttatggaacaagtgaagtccctctgctgccaaaatacattttataacctgattttttgattgataaaaaatgttatggatggtgatatgttacatatctaaaggcctgaaaggattttgtagggttatctttagagctagttgttgccatatacatgcttttaaagtttattgaatggaaaatgtatagaaatggtaggtaagacctgtatattggtggtggagagacatcatcaagggagaagaaagtagtatgtaaatgaaatcttagaagtgctacttaaaacaattcactgtcaatttcagttaattttttttataatgctttggtaaaaaacagggtccagtatgcttttgagtaattatacaagtattcagatgcattttattatgaattctactttatattcaaatgtgtagtgtttttgctgtcccttctacattgtcatgtttctctaattttctgaagtgacttttaggcatgatcattgcacactttacacagattgaaatagtcattaacctgtctataactctattacatagtatgtgactcagaggtaaaaatacttttgttttaaattttaatagcatattcacaatagattttgatactgaaatttttttaatcaaagagaaaaaatattaaaacatgaagtccagtaaacctgtggagatatagtttaagatctcacataaaaatgcagaagagaaaccagctataccttgttttttaatccaaatatgtcctcttaagaaacaagaaaaactattacgagttttctgagcttactcacctacggaagtttgtccttcacattcttgttgtctttagcatttaatatcatagcagtttaattattttgaatgtctgttttaaaacagtggcataaggaatacttctttagatattgggcaattttaaacagctttcctagatattgaaataattttactcatattatgagaagatgacatgtctcagagtataaagtaggttaattttcagttttctcaagtaccccattttgttaatgattttgtagcagtgaaagtacttattttttaagcaaacacttacataatgtgttatgtgccaggttctctttctaagccctttataaatattaactcatttaattttcataacaaccctataaagtaggatttgtgattcttctcacattttacagatgaggaaactgaggcacagaagttaagtaatctgctgaagtcactagccattgtggctagagccagaatttgaactcagataatttggtttcagactgggagctcttcaccactatgccacattgctcctcagatttgtgataatgaaatgagttaggaaattattcctcttgggaacaaaaccatgcatcaaatatatattgccaatatctttgcctcagtatattcagaaagatgattatttgattatttgtttattcatttcttccattcaacaaaactttgagttccctatactaggtatacaaagtatacctttttgatcaaaatgtgttcagttttatagtaacctgcttttagcatgcccaaaagaactactggcagttgatcagttttcttaataaattcctttttgaattcttgactaatctacattaccgatttgagggattgtttattaatttaccaagcatttattgaacacctaatatgtgctacagtgctattctaatgttgttttgccttaagtagtactaacatgtaaggcctccacagtttagctagtagggtttgggaaaatgttgcctgcctctgaagaaagattgcaaagcatggcaggccctaaaaattgacccagtgccacttgaatactgcataccagtgtagacagctgcttgtcccctctgcttctttataactcatttgttcatcattcagcaaacgtttgaatactatcatgtgccagggattatggtaggcactgctattagttgttctggaacttaatgcttctttggcactattcacaaatgcctgcttaactggtagtaagatcttatctttaaaacatccatgtccttaacctcttggaaaacaaccaaattgagcattagggaaaatatctctaaatctcatatactatgctccacaggtgagacagtctattggcttaacaaaattactgaattctcgagctggtaacacctttttcccagtaactctacggacctcagtgcttgcagcttaacagtctcctcttaattaactaaagtgctgcagggaacagcctgctgctgtccttgtggttatagtgtgtcttcctaagattgcctgcctcatggaaagaaaggagacaggctgctctgaactactgctgttgacgtgagagtgatgggaccagaaactgttttgcttaactttcccttagcttaccttgcaggctgggcccaaagatgacctcttttcttgaggccctgtattattatttttttttgagggggttggcaatttttgattaagatgagagggctgtaggtctctgttcaaataatttatgtagcaccctcaaggaggtgaactataacttcccgctccttaagtgtgggctgtacatagtcacttccttcctaagagcatagtttagagatacggaaatgtttacattggagaaacatgaagaacactacttcagccagatgatcaaggttaacttctagagtcatatggcatgttgatagtatgtacccttggtgtgatgtgattaaatgacactttatctctgtggccttcttactaagaaccaatagcacagcgtaatcatgagaaaagcatcagacaaattccaactgaggaatagtctacacaatatcccattagtactcttcaaaactgtcagactcatcaaaaacaaggaaagtctgggaaactgtcacaaccaaagggagctaaggagaaaagacaactaaatgtaaaggggtattctggaacagagaaagaacattgaataaaactaaggaaatctcaggtgtggactttggttaataacagcgcttcaacattggtttattgaaacaaatgtaccatactatgtaaaatgttagtaacaaggatggaggagtatatgggaactctgtactagctttgcaatgttctataaatctaacattgctttaaaatagatatttaaaaacaaaaccaaaaagttcaccactcctggctagttgacccttgcattagttttgatttggggctatctgcagtgtttctccacagcttagtaaatcaagttgattttgctataattgatttcaagaaaatattatgtttagtctcatgttcttttaaaagtgtattaaaggcagggaagtatattttagaattttttttttatca

SEQ ID NO: 89007 - DNA, 1102 bp, Homo sapiens
aattattatctggctgttcttcattaactctttcattaataaatactgttgatactgaacctgagaggttccccaaagccaaagtggtgccctcattagggtatatttcttttctctttggttttttcctcttaggtttcctccttgtagcacttccattctgttttgattctatttcccagatagtaatagtgtgtctacctctcaaaatatcaaaaagctagctgggcatggtggcatgtacctgtagtctctgtcaaggccagcctgggcaacatagcaagacctcatctcttaaaaaaaaaattaaattaaagctgcacatttgagattagaaaagtagaatttctatttgtctctaagagcatttttttctttaaagaggagtatcttcatttgattgcaaacttttcttttgagtatatcaaattatgcaaatatagaaataatgtgaatttaactttcagtgcaatgcgtgttttactatctaaattaccaagaccatggattgtggatgagaagaaagatgatggttatactgccttacatctggctgcccttaataatcacgtagaagtggctgaactgttggtacatcaggtaagaaaagagttaaataattccctcttttttatttttttttaaacaatttgggaccattgccattcatttatttattgctttataaattgcctattagtaggttccagtaaaacctcatgatgatgaaaattcagatataatgcatattctgtcttctgcctaatacttcttaaatgcaggatggtgatgtgtgtttgagagtgagtccctcaattcccaggatttcctctgcacagtcttcctggattggtcctgtgaaatgggcatcaactaacagagatttcccagaatggctgccactgttacggaagtatcatcaaccagagcaccaagaaccatctgtgttgatacttaaacagtatggccagttgtcatcagactgcagtttgcagctaagatcaggggatttatttcgtaactactgctgacccctggaatttatggctcgatagcagtacagactcaccttggtcatttcattcatctcagaataggatga

SEQ ID NO: 89008 - DNA, 1963 bp, Homo sapiens
cgattctcctgcctcagcctcccaagtagctggcattgcaggtgcacaccaccacacctggctaattttttgtatttttagtagagacaaggtttcactatgttggccagactggtcccgaactcctgacctcatgatccgtctgcttcagcctcccaaagtcctgggattacaggcatgagccaccacactcggctgaaaagactttctttttctactgaattgccagtatacttttatccaaaatcagttaattgtttatgtgaaggtctctttctggatcatgtattctgttctgttggtctatgtttttagctatttgataccagcccccagtcttaattactgtctacataatacgtgttgaagtcaggtagtgtcagtcctccagttttcttgttttttcgaagttatttgactattctaagtccttcacatttccataagaattttaaaatcattttttagagggtaaaaaggttctgagaccaaagtgtttgagacctctgccttatttatgaccatgggtaagttctcttagctcggtgtgcctctttttttctcattttaaaatgggaagaggagagcacttacctcgataaggttgttgtaaagatcatggaaagtgtgtaaaataatacttgatccattttagacactcaataaatgttaacagttattgtgactattttcacataagatgatgagaagaatctcagataatattatcagaacctaatttgtctcattctccgtatcttggctcaattcctagtcattggttcttttctcagttgtctctcctgtcattgtttcaagttggttgctagctgctccagagccaaattaattaggaaagagagtactgtttctttagtatctcaatcagaagttccacttttgagttctgttgggcttaattgacttgatttgtgttatgtgtccatcccggttctagccatataggtaaggtagaggtatctgactggtttgggccatgtttggtccacctctgcagctggagaatgtaggtccacctctacaactggagaaagcatacttgtgtgtatgcttgagaaaaccaggggtagagtggtggggagggaacattaggactagaactcataagtgtccaccacacacacatacatatatatgatgacaagaattgatggcagattcctagagggaaaatcatgactctttattttattgcagttaataatgggacttggtacccagggggcagagaagaagagtgcagcatctattgcctgtttcttggcagccaatggtgctgacctgagcattcgaaataagaagggtcaatcgccacttgatctctgtcctgatccgaatctctgcaaagcactggcaaagtgtcataaggaaaaagtcaggtttgtattatttattatcataaaacttaatattctgtacagaaaatatcatgtggtttcgtaatggaggacgtggctacttgaaaatgtcttcatctttgctcttcctgtatatttgtgttgaccctttctttcctgaaatttttcttccttgaaaatttttctgcaggcagcatgtctcttattttatgccatattccccacattattgagtgcaatgctctatacttaataagttctgagaaacttttctaaactagtctgatcttctagtactcccatgtgttagagggatttatgagaaaaagtcttctagtaaaattgctgttgttaatgttacatgtattttaaattgtatttattttttattgtattattattattttttaaaaatacgtcttgctgtgttgcccaggttgggcttaaactcctgggctcaagcaatcctcttgcttcatcctcagtagctgggactgtatgcatgtgccactgtgcctggctctatatttaaaatttaaatagaatcttcctaagacaggcaacttatactccatgaacagggt

SEQ ID NO: 89009 - DNA, 1100 bp, Homo sapiens
ttttctgtagctgtaggtggtcatatgtatttctgttccttgtatctgtgtttacggatgcagtctatctttctgtaatataattttatgttccttaaggatacacttaaaaatgtcaaaacagcagctgaagtgttaaattttccaaagtgccctatctgttgtggactctgatgatgctttgttccgtctttagtaaggcaactaacatgggggctagtgaggatttttgttttattcctatgccttcctctgctggttctatatagatacaacaggttctgagcaaaattttgtttatgctaagttttttttttaattgctgttttttatttcattgttagaagattcacccttttccattgggtgagtgagtgttcagtttgaagtttgaattgtgttagaagtatctaaagatgcagagacgcatataaacacaaaaatttaatgtttcacatacagatgttaaagcttaattttttaatatgactagtttttatgtatactaatgatgctccaggtatattttaaaacattttaattagtgaatttgtaataagataggcttgatttgaaatactttcttttattagtggtcaagtgggttctcggagtccttctatgattagtaatgattctgaaaccttagaagagtgtatggtgtgctcagatatgaagagagatactctttttggtccatgtggacatattgctacctgttctttatgttctccacgtgtcaagaaatgcctcatctgtaaagaacaggttcaatccaggacaaaggtaagatatatttaatatagtattttgtcattttatgaagttgagactagaattaatgataaataagatttaatgacatcatgcgtctgtgtaattttgctcttccaaacaatgatttaaatataggaatatataatttctgcatttatcagatcagaatttcttattttattgcttgtttacagtcttgcttattaatgtactgatttgctaagttaattattgtttgagtttattgatacaccatttttactgtcaaatttttttagctcttaatgtgtttccttcattatatctaaagtatggtaaagtta

SEQ ID NO: 89010 - DNA, 1007 bp, Homo sapiens
agtcctggaaaagggcactttaaggtagagtttcttaaatgtgggtaaacagaaaaatccctcgtggattttagcaatttggctaatctagctagatttttattaatattagaaatctgtctttcagtcatttcttattttactactttatttgttcgttgtcttttttagtttcccctcaaaagtagtttttgggggaaaaaaatattgaagcctccagaggcttcctcagaggaaatggagttttttctattctatattttaggacagatagggagatgaaggtagaatagaaataagtgcctgttaagctagggtatataaagatgtgaaaatgaataaccaggaaagtagaggatgggaggaaagtgtgtgttaaatttctctgtgcctaggtgttttcttacagaggaaatacatttggatataattgaacttgttaagagttactagatttatctgtaaatggtcactgtgctgtaacctctttttctatagattgaagaatgtgtggtatgctctgacaagaaagcagctgttctttttcaaccctgtggccacatgtgtgcttgtgagagtaagtagcctatgcagagttcctcaatattattataaaaatagaaagtgaaacaaaaattatgtttttgagggtttttttgcttttgattttggataactcataaaaaagttgatgggcctcgagtaccttctatttctttctctgtactagaacgtcagctgtttccctccatgcgtctgagcattagggaagactgaatatgctgtgttctgccaccttggattttgatttcagttgtattagcacaaaagggtctctttccacacataatagaaatttattttgaaaaataaatgttgaaacatttagtctcgcctttgttcacatatgaaattagcacgtcttcatttggcttcaccttaatattgcctctcctgtgtactttcctcactgcagaagaaccaacagcaaccatttctggggctgt

SEQ ID NO: 89011 - DNA, 2231 bp, Homo sapiens
gcctagaatttctctgcctcctgcctctatcacagcggcgcgatcttggcttactgcaatctctgctgcccgcgttcaagtgattctcgcgcctcagcctcttgagtagctgggattacaggtgtgagccagggtgtctggctgtgttttatatattaatagtttttaatcttatgtagtacctttcatactatcctgatagtacaaccagtgtttctattttattttatagggatgacattttaactatttaaaaatgttaaaaaattgtttttaaaaaccaccaaaatattatttgactaaaacaactaaagaaaattaatgatatataacagtctgtcactttccaaatataaagtgtctaatttattactttgttatctcacattacagacaatgtgccctgtgtgtctagatcgtctgaagaatatgattttcctttgtggtcacggaacctgtcaactctgtggagaccgcatgagtgaatgtcctatctgtcgcaaggctattgaacgaaggattcttttgtattaactaagacacatggtgtattttgttagctaatgtatctagtcatgagatcttaataggcttttgatctagttggaagttctgatgagttaatttctaatatcatagtttctttactagagtataattgggctgtaaatgtaccagaacaaaaaaccctacaaaatggtgttggaaattgtgttttttgtttttgttttaaatttgaaacatcaaattcatgtaactcataggataatttacctttggcttctaagaggaaagtcctttaaggatatccttttttaaaaaattgcatttttctcttataatttgtaaatttgttggatctcaaaagacataattctttgtgatcagttatccttcatttcatcgtggttttacacagtgagttgataacaggttctctgagaagtcatgcatcaaataaaagaggcaggtcaaacaattatgtcacatggtaaattataaaatgacagtacaagttccagatagttaagggaataccgaagggatgattctttttttaagataacaggaagttacccacatgtttgtttctgaattcttagagtaaatggaagcatagaatgagggaataatgactttgcatttctcttgttttctagattcaaaaggaacattgtttaacttgaatcagattaccagtttcaaggtgactgatagacaagaaaaggaaaaataagcaataatagtgggcaactgaagagaaaaaaaaaacgagtatctattaactggccactaacagttgcctttcttacattaatttatacactattttgttcagccagtgtttttaaaaaaaatctatgaaaagtgtacttccggttttctgtgattacttatctgggcttgatctgaccagtgaaatgacattgccctatttggacctctgaggttctatttagctttgcagatgtacatagtatcccagtgatctgcaaaattaatgccttttccaagaaaaaatcttttcttctctgtatcagttaattctgacagtgttagtgattctgtcttcattataggccttatttccattatctctttctttatagtattttttgttataaagaaaacagtctttctgtgtatacctacggatgagggtattatttaaactgccaacaatatccaagacatggtcaataacctaattataaatactttagaaagagtgaccaggacatgtatagaaatgtctgcttacctgtagactttaaaaacaaacaaaatttttggagcatttaatcattttttttctccttttatctcctttgtaatcttattgtctcctgagtaaatatacacataaatgtttggggattcattgctgctagattatatcaggtgtttacatagtgtctactatatgctgttgataagctttttcctaaaaatagttatcctcttttgtagtttttttccctcctttaaatctggctagcttttcttacttcagtttttatagaacaccaactaaatttgaaagtatgaagtctctagccctcttacactgtttctggctgtttaatccttgctgcctttgcaagtcctggtgaaagcaatggggagctttgctggctggttttgtagtctcaacaattccatgtctgtgtttagctgagtaactgctatcatttagaacagtaaaatttttatagatttcaaatttgaaa

SEQ ID NO: 89012 - DNA, 4534 bp, Homo sapiens
tataaaaaggtagaacatctgactgatgatgttcacataaagagacagacagactatcatgttgcagacatgaaaacagcatgtcaggtttttcctttccttccatgccatgggctacccatctcttcccactagatcacctggtgaggagggagcacctggctgactcatgcagagtttggccaatcagagaattgtgtggtctccagctctactttccttaaacaaatcctttctgttttctgagctgcagtgctaaaacagatccctaaaaggtaatagcatcttccagactagtttaattatttcctttataagaatatgacataaatttttattatagaaataatgtcattataattttagtgctagtacttgtgggttttctgtatttgtatcaccttgaaatttgttccatgaatagaaaatacttctttattcatgttttcaatcacttagaattattttaaatttattttgggtttgtgagagataataagattaagaacttcatcatttcagtgactttcctccaactctctgaatctgctacctcttattatatgtcccttagcagtacttttccagttaggttcgttaccctgctcattagctaaacctctttatcttgtgcctcaaaagagcttttacttttcttagaaacatttataaaaaagaaaaaaactgacacgcattcattcaaaaaagtatttattgggctttagggattagatacacaacagtggaaaaatggcatcttagcacactcagaatttattgtgcagcagttgtgtattttaaggaatctgtagttaaaaggaagagatccaaaggtcctgataacatttcctaacgtttcagaagagttgtcattgagtagtgtttggatttcctctctgtatccctcaccctaccattttctcctttattcttctaagattgttagcgttgttactcaaaacatacacatacaacataccagatggtgctgttctaatggtatttgttcacgtaatttaacgttcttactgcttatactatatacatatttaattttgttgggagcaagaaggttttcaagaaaagataattttgtattagtgtaggaatatattagacaaatgtttagttggtcaaattatgcataagatatttgtaactttaaacattgcaaattgaccagctagctatggaagcataaaattaattgataattaatgttggaaatacatttctaaaatttatatttttatggtgttagcctgtaagagcattttagcatattgaaatgcatgctgcttaagatgtgtctggttcaaatatcaaaacttgctgggtcatttttacatagtagaaacatactgtctatgtgttgcccaattgctgtttgtccactctgaattctggaccctttttggactaagaattagttaaattcatgaactaagagaattagagatggggtagagtaggatcaggacagtggggttacaacagataggaaaggaaagtcagcatttgagtgtagagaaaaaaagaggatcatacagatgtcatcaaattataggctttaatacaggttgctttttttaatccaaaaggaaaagcacttatcctatcagaatgtctaccatgttttatagtaataatttgtgtaaaaaattgaatttttgaatagttttttgtattttttgtgatgaaaaactcataacataaaatttaccatattaactgtttctaaagaatacagttcagccatgtgaagtacatttacactgttgtgaagcagatctccagaactttttcatcttgcaaaactgaaactccatacccattaaacaactcccctttttgttttctcctcagtggaatagaattttgactccatataaatcaagaaacacctaaattctttagttgtttgtgtttgcaagatctaaggtcatggtaaacattaagttcttaaaatttttgggagggacagtgcacctctcctctgaattgttagcaattaaattgagtaggttttaaatgtctattcattggaagggtttgttatttcattttgagccagaggggagaggcacattttaaatatcagaattagattagctttgagtttgtacaattgggaacataatagattttcataaattatgtgtgccttgttggaagtgtcaactgtctttatgtctgcttgtaaaagtttcaaaatatgttttccctcaaaaaggcaacgttacttcatttgcttgaatattatgataggaatgcttactgatattacttgatagtcatatatagcctaggaaatttaacatatatataactatagcagtattaataatgatagttgtacttctttaaaacattaaatttgaggaaactttaatgctgtctcgtgtacattgctttactacagtgagggggaatatcctttagattgagcctcaatttactggttagtagtatgtgaaactctggtataaaaacgtaaactagacagtagagccgatgaattaaaattgtaaattgctacattggcattttctacctccttttctgtcagagtattactttttccagcatttattcttatttgtgagtaaagaggaaatgggaacctgaggttaaaattgacatttttgtttcattgagaatttaagcagtaggtacaggagaagtgacttgtcacattaatttggtgcctaaatctgtaactacaagttgtgatcgacatgtacaaaatgtctaagaaaggtcatatgctgaatattttacttttcctgtatagtctgcatgatttgtttcataaacccagcttatttcctccaaaaagcaaaatggtcctgtaatttttaaagtaaaataaacgtgccattttgtctgcaatctataatttcaggaagttattgaaagttctgactcagggctttttaacagttcaagcaattgtcagttatattttggaaactccatctgtgtaattctccagtgccttgaaagaattattaacttggcaacactattaaaactttataaaagatggtctttagtgcacgtgtatcattatatacacgttttaaagtcatattgcttagcttgttaataatgattctgcatgtgtgctgggtttgggtaattctttaaaggaagttttctagatttgcacttgatgtttgttttttaaaaactgattatttatggccgtgacactgttaccagaaaagtaattctaattaagttattatgcaaagtcatctataagtagcatctgggaagaggagatcgaggccacagtttgctattttagtatgaaaggaggatctgtttgggaaacatagattgtcttcccctcaaatgaggggaaaaaaaaaagaccctttgttcaaatggattctgttgtaaaaaattatttttaaaggaaatcacaaattgtatgtcattcttaatgctagtcttatagaataaatccataaaattgtttttatgttcagtatgtttatgtcattctaaatgcagcaaattcaatgatagcagttcaattgactcatagcagtgttttgtattttttctaattctttagctttcaatattggattaaagtcttgtttgtgaatatagtttccgtatggcaaatgatttcttgcttattagcttttgttaaagaatgcttagtaagagctaagcttttaaaagtaatgcaaacatttatcgttaataaaacctatggtgtaatatcatataatgcttttctttgatctttggagaattattcttttatagtagtatacatgaattttgatttttaaagcatttaaaaacaaatctcaatacattaaaaaacctgttattgttaaaaaggaaattaccatgcctttaagaaacaaggatgtacatcttcaattcagcataagtgtccacatctagaaggctctcattgcagttgtttacagttaaggtacctctatctaaagggccaaagaagcatttcatattttaacacctcacattctttcaggattaagacatatgaaaatagtctgaataggataaatttgataggaagtaacttaaccagtctggaagattcagctttttctataaaaagcttattcctcttcacaactcagatgtagatttcattttcaagaggtagatattttaaagcaatgatctatttgggttttagttttatgagtaaatcattaattgtatggtttgggggttattttattttccatgttaatataagcacttatttctgaagttattgagaggtcatctagctccagttcaaaagattatgtatatctgatgtttaagaggaaaaacatctgaaaaaatatcttttgtttatttgaaaaaagcatatatattccaactttaaaattgtgaatttattttgagtaacctctaattaactgtatttttttgtttctgttgctgtatagttagaaatttcatggcaatattttttactaaattgaaactataggttttaaaaataaagacattttagaaaatttgcttt

SEQ ID NO: 89013 - DNA, 1070 bp, Homo sapiens
tcatgcctgtaatcccagcactttgggaggctgaagtgggtggaatacctgagctcaggagttcgagaccagcctgggcaacatggcaaaactctgtctctacaaaaaatacaaaagttagccaggcatggtggcacacacctgtagtcccagctacttggggggctgaagtgggaggatcgcttgagcccgggaagtcaaggctgcagtgagccgagattacaccactgcacttaagcctgagtgacagagtgagaccctgtctcttaaaaacaacaacaaaaaacccaaaacatttaaagggtgcataggcatttataagataataatgagtatacagattaaaatagaacaccaagaataatttctcagataaattatttattgaagaataatcatttggcaaatagtttttcccttataataaaactcgataaattcatttttatcttattaaggacaaaaaaatgatagaccttatttgaaaatggaagaccagacctgtaacagatcatcggtgaggagatgacatgggaaggaggccatcaggcagtgctgcctttgcccataactcagatgcgatgcattcaggctgcaggtaccacttcatgctagggctctgcatttacagttagaggagctttctgaaaggcagatttccaagataatatattcattatttttcatatatttgaaagtattgtcttccttcccatctgtgttctttctttccacaaaacattaatattaagagtatgacactgacaggcagggaaatactgttataggtgaggttaccccaatagggaaaccagaaccagcaagcatgacaagagattttggaattatcaaaggaatttaaaacagcaacaattaatatgctatgagctctgatgaaaaaagtggacaattcagataattccagcactttaggaggcccaagtagggggattgcttgaggccaggagttcaagaccagcttaaacaacacagaaagaccctgtctctatgaaaaaaaaaagccatgaattgtggcatgtgcctctagtcctaactactcaggggctgag

SEQ ID NO: 89014 - DNA, 1062 bp, Homo sapiens
ttttttgcccaggagggcatgcagtggcatgattatggctcactgcagcctcaaactcctgggctcaagcgattctcctgccaccacctcctttcaaagtgctgggattacaggtgtgaaccaccgtgcccagccctaattcattctttacttttagtttagagtagtgtttcatttaaaaattgctgtacataaaatataatcacaaatgatttctcaaaattctgtatcttgcaattattgtaactggataagggtttagaacaagagaagacatgtctaagtctaataataatatagtgaatatttacgaagtgttatgaagcggcactttctaagtgtcttataaatgatagaaactgtgggtcatgctttacgtggcatttgaactctggcattctggtcccagagttcctggcccctaagcatcataacatactgcctgtctaccagagaaacaaaaatcagtgttttccatggtcctggcaaggatgattatcagttctataagctaatatggacattcaggaggtggatcaaggttttgtgaggcccagagcgtatataatttgggtgtcatctttaggaagataacagaaaatgacaaatacaaatgtatatgtgaaaataaatttttatttagaatgagaaaataaatcacaactgatcacaattagaaaaaagactacaaatgtctccaaatccagaaaaaatgcacatttttattactgagccccctaacgtatctaatgcttctttcccccatatctttagctttatactctttgattgtctttcaatgtgtctgcaattttctacaatcatttttagtagagaaaatagaaatgtaattcagctgttcctattagcgtggttgcttggtaattattattgatggttgggatgcataacacataggatttcacacatgactataacttgctgtttgtagtgcttctgcagttttatcccatacctatagagaaattctgaaaattgtattttgtgtgatcccctccaaaaagaaaaaaagcaaagtttgttcataattgtatgtgctgt

SEQ ID NO: 89015 - DNA, 1035 bp, Homo sapiens
agactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttttaaaaataaaaagggtattgttttgtcttctgtacagtgagttccttcccttttcaaagctttctttttatgctgtatgtgactatagatattcatataaaacaagtgcacgtgaagtttgcaaaatgctttaaggccttcctttcaaagcatagtccttttggagccgttttgtaccttttataccttggcttatttgaagttgacacatggggttagttactactctccatgtgcattggggacagtttttataagtgggaaggactcagtattattatatttgagatgataagcattttgtttgggaacaatgcttaaaaatattccagaaagttcagattttttttctttgtgaatgaaatatattctggcccacgaacagggcgatttcctttcagttttttccttttgcaac

SEQ ID NO: 89016 - DNA, 1050 bp, Homo sapiens
attagtctatagtggtaaattaatactgaccatgaatgataaaaacccctcaatatctgaatcctttctgtttaatataattgagataatttcttcctctaagagaaataagaaaatttgcctgaaaatttacctcatatagccaaataactgaaatcagaacttttctcaccattatcatctttccttattctttccttcccctcccaaattctaaaaatgattgattataggtaaataaggaaatggtaaatgaggatatctgggcttgtgtttcatcctgatttcaaagtacataaagataaatgcaaagttcatttatgttgcaatctgtcatttcaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtaaaatcttttcttaaatacttacagcagtattttgttgagactgtagtggctttgtatacctttgtatgacagtcctgtttattatttctatttcagcttttaggttccgggggtacatgtgcagatttggtacatggatagattgcatgttgctggggtttggtgtgcaaatgatttcatcacccaggtagtgagcatggtaccccataggtagtttttcaatccccaccctcttcccacccccctgaccctccaccctcatgtaggtcccagtacctgttgttcccctctttgtgtccatgtgtactaaatgtgtagctcccacttataaatgagaacatgcagtatttctgttgtctgctcagggtaatggcttcatctgcatccatgttgctgcaaagaaaataattttgttcttttttatggcttcattgtattccatgatgtatatatacttttttttaattcagtccactgttgaattttgtacatttaatg

SEQ ID NO: 89017 - DNA, 1101 bp, Homo sapiens
caaaaacttcagtaaaactatgtagatgtaacattattttggcttagaatagttatttttgtatgaacacatctcacaagtagaattatcattcttactggtatacttttaggataatggatatccaatagaattctgatattcctcccatgtgattggtctactgaatactgatagccaaagggaattttgaggagaaataatagtcagatgaggaaaggaacctatgagatcagactgatgttataaaatgtttgtaagaaaatgtcaacactttctaattttaataatgctgtataatgaagagagaacacaggacacagatccacaatctgttacatagaattccaaaacccaaaaggttatttttgaaatgttgttcacaacctaacctcactgcaatggcagaatgctgtttatagtctttatcccacttcatgtgagtattcatatgttttgctgtgaaaatatcaatgtgtttgattacaggatgatgcttcagactccactggagctgttatgtaattatgtatatatgttctgtattactgtattactttcattttttttaaaaaatatgaatttggaatcccgtctggttccaaggattttagataagtgattgttgacctacattaatttatgtgaagtgattatgtatgtacgtagcttatggtattttgaacacatcagccttgatctttatgagtaccaaagggatgagataccaagtgtgtagaagttaacacagaattagatagacgattgcctcaaaaaccaatgtgtataagttaggttgaaactatatcgtgtcatttgcttggtagaaatatgaattctaattagtttagaatttatttttagtgttctcaagcacatgcatttttcctgttgaaattcaaattttagaaaagaagtgaaggctaaagtttgaaattacaggaaagagtaatcatatagatgagcttaaggcatgtatgtttatttaggacatgcttagtcaaaagagtataggagatgatctgattgtgtcttttattctcttctgaaatataagatagttgtgattctcatgaaccaacttcttctgtagcttggtcg

SEQ ID NO: 89018 - DNA, 1049 bp, Homo sapiens
gcttgcctggactattatagccactaattgatttccttgcctcctgtccttctgtcccaatcttgcacaatactgttagattgtcacattatatccaagctctaaaaccttaatttctttcctcttgctttctacattatgtgcacattgagctcatggctctcgttcatgtaattccagctttcccttctccaacataagtacacagtactgcatgcctttcctcagactgtgggttctctcctgatcttgtctgcaatttgaaatacttttaatttcacctgaagtgctattgactatactttctacttcacttctcacatagtatttcccactgggtactgtaatcattcgtgtacttatctacttaggtttggaacattagatgcaagggattacatcccttagagcttcatgtttgtgttctactgtaactccatgccatgtagtaaatgttttaatactcattgaattgattttctttccattgtcattcttctctaggaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatggtaagagttggagttgtattttagttctctggttttgtaaaccagtgttcatctactagtttttatgttattcaatctagtgataagaagatagtcactattctggtatcccatggtacaactatgagtttaacttctatttgtaaagtgactgagaaggcgttttctgcccgtgttatgtatagatacgtgtcatctatatgacatgtaaatataccatattttataaatgtagtaaatagtttcttttttctttttattttaaaaatattcctatgtgtatatatccaagtgggatagaaggaaaaaggaaaggaacttaatgttaatttctacctcctgtgtaccaggtattatgctgagtgattt

SEQ ID NO: 89019 - DNA, 1487 bp, Homo sapiens
ggcgtgtgccaccacacccggctaatttttgtatttttagtagagatggggtttcaccatgttagccaggctggcctcgaacttctggcctcaagtgatctgcccaccttggcctcccaaagtgctgggattacaggcatgagccactgcgcctggcaaaagatgattttttgtataataaagttatttaaagtacttaggaaaaatttttaaaatatgaatattatggtgttgagaaatacttcctatgtcattttcctctgcttttccccttctcttttgtcatctaaatgaagagaagccaaaagctgtaccttgtcttaaattttggttaatcatttgcttctaagaggtagataagaccttactattaattctgtattaaagaattgttatcactctttatttagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaaggtttgtgttaaatgttcaaggattttgattaaaatgattgcttgtgatttcatttagagctaacaattatttctgttttagagtgctggttctcatgagccaataaaaatacaaaccaggtcagaccatggaggatgtgaacttgcatcagttcttcagttaaatccatgtagaactggtaaaat

SEQ ID NO: 89020 - DNA, 1101 bp, Homo sapiens
tagctactgtaaaaagtatttttgataagtacctgaaatttataatagtagagttcatgtttagcactttgtccccctttgcaactacctatgggaggcagaataggaaagtgtttaagagttctggttctggaataagaaagagcttgggccaggtcccagctcctctactttttagctttgtgaacttgaacaagtaatttaacttccttgggtctctattacctcatctgtcaaacaggtatagtagaaactacttcaaaggaatgtgagttatatgagatgatatatgtaaccatttggtaaatatttgctgtcattattataaatgaggaaactgatgctaaatagtgagatcaatcatcagcatcacacagctaataatcagaagaatcatgtaaacttacaaagcatcaaataagagaaatgtttactagatataagctgaaagaaatgcatgttgcacatacagtcttctaagtttatgatttgtttttaaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaatagttgtagtctgtgatttgttgcctttcagttcttttctttttacttcatcttcccttggtatttacattgagcagtgacttcatgttaatcattacagatttttcttcatcaattgctcttctctaggtcatatcagtgtctagtatttaagtctttttttaaaaaaacaaaaaagaaagactgtattttcatagtttttttaaactctccagcttttgttgaattggaatcaggtactacattgtcataaattc

SEQ ID NO: 89021 - DNA, 1053 bp, Homo sapiens
gcgaggagggcggcgcggccaagccgggcgccggcggcgcctgcggcgcgaggactcggttcagcttgctcgccgctgccgagcggggcggctgcatcgcgctcgccgcgccgggcacgccggctgcggggttagccgctgggtccggcccctgcctcccacagccctcgtcgctgccgcccttgattcctggcggccatgcgaccgtgtccggccccggggtggcgcgggggttcgcgagtcccctgggcgccggccgggcgtcgggggagcagtggcagccgccccggccggcgcctctcgccgcctgtgcccaactgcagctgctcgacgggtccggggccgccgggcaggaggagttggaggaggacgatgcctttatcagcgtgcaggtgccggcggccgcctttttgggctccgggacccccgggagtgggagcggcagtcggggacgcctcaactcgttcactcagggaatcctgcccatcgccttctccaggccgacttcgcagaactactgctccctggagcagccaggccagggcggcagcaccagcgccttcgagcagctgcagaggtcccggtgagtatccgggatgcgacgcgcacccaaccctgcgtcccgcccggcgctcccagcctccccgcggtctctgggctacgggacacgggttgctcccattttcccgcgccctgccggatcctgtgctccgggcccgaatcccaaaccacgagggcacccaaaagagggggcgtccccagggagtgcggggttacacgtgtttgcacgagcccagcattcgcagaggagcaccgcgcttgtgcagtgggtcgggaattgggagttgcaggagcccagtagaaagcggcgtccgagcctccccacacgagatcacaaacttcctgaaacccggtccagacccggaggcgcactcttccccgcgtggggcgagactcggccgggcgcagagtggagcagtgcaggccggcagctgagcggcgcgtgtgagcctgaacttgtagcagacacgcgtgaccctccggagaagttct

SEQ ID NO: 89022 - DNA, 1079 bp, Homo sapiens
tttatatattgggtttgttttgggtatataaaaattagaatgtcgggccgggtgtggtggtggctcacggctataatcccagcactttgggaggccgaggcaggtggatcacctgaggtcaggagttcaagaccagcctggccaacatggtgaaaccccatctctactaaaaatacaaaaaattagctgggtgtattgttgtgcccctgtaatcccagctactcgggaggctgaggcaggagaattgcttgaacccaggaggcggaggttgcagtgagccaagattgtgctattgcactccagcctgggcaacaagagtgaaactccatctcaaaaaaaaaaaaaaaaaaaaattagaatgtctcccaatctgcaatcttgaaaccctttcttcttggttactttcattggaacacttgtaaaaccaatcacaaataattgcttggacttccaaacttcacaacacacagggaggaaaattctgtgcacaagccttggcacaaggtgcacagtaaatgcctgtggaggcaatgattacaccacctctgttcactggactggattcttgacatctattgtatttagccctcacagccaccctgagtatagattctttcacaggtgaggagaacataggctcagagaggttgagtaatttctcccagctactgagaggcacatatgataatctaacttagttgggccaggataggaacctggatcattgatgtccaagctctgccactctaccatgtcactatgccttgcacacaataggcccatagataatttttgagctgttggctgtaaatgtttgtgtattatacaactgtcccgtcgtactggtataattcaacaccccatttgttatcctcccaaatttagcctcttcgtttgcatcccctagctttgctatttcaccatctctattctgttggggtgtccagggaacccaggatggtgggcctgggttcctccccgcctcacagacgggactccagcactgggaagccaacaggctgggtttgctgtcaggtgcagtgtcagaggtgggaaaccaagaagatgcctcttagctt

SEQ ID NO: 89023 - DNA, 1048 bp, Homo sapiens
ttccctggaatgcagagtggccaccctttgaggagggaggctttacccactatgatgatttgttcctgttgtcaggccaaggaacccagggctcaggagatgttaagtggcctgcccaaggccagttggcaattaatagcagagctcaggctcactattgctcagctgacttagagcttctgcctgcccctcccgctgcattgcccctctttggaggaaatccaggcttgtgctgtaattgtaatctatgtcttgactgaaaagaaaaatgtgagcccaccacagatcaagaatcagggtaagaaaggggagatggatgctgtttcctagctttttcaccacccgctttgtgacatcaggcaagtcgccagtctgtgtgtgtgtgccccagctgtgagccacctgacccctcaggatttcagaagtctgtaaagaactttgatctcagcagtaagcaaacacaagttattgctgagccatttttccagcaaccatgggttttggaggtcggagttgtagccccaggccaggcgggggcctgtggatggtgggcgcagtctgaggcttccctgctgcccttgttgcagtcacaaagcctgcaatgtgggcgagctcaggagaaatacataggaagcctgctcactgctggcaagtgcctggggaggccagtgagctcaagggtgagcttttgctctctgaatgggtggggaagccatcacatggctctgcgccacgtgctcagtagctttcccaggaagcgccgatgcctggactttttttctctcttcagaaagatagcggtgaggtggcagagagccaagggcaggttttctggagggtagaataggaggcagtgcagttgagcctgtgctgtgacctgatgtggcataagagaggtcaaagcaggactttgagactcctgggttctgggtcttagtttccttatggaactcagcggttgggacagatgagcctgccaccccttctgggtccaccattccacgtgtctcggtcctgtggcctgctgcagggtctgggggcatgttta

SEQ ID NO: 89024 - DNA, 1218 bp, Homo sapiens
gggtcaccattatccattttttccactttagaaaaatatctgtccccctcaagtttcagcctgtgtaccatttaaacaccaaacttttcacagattctggggctcagaccacttagtattacatacgggaatcatgaaatcattagctattaccctgttttaccaactgtgtaatgttgtatttttatgtttgtttgattttgaaaagcctctaagaacgtataattaattggagtttgctagtttgtcttttcctctttgttttagtagtttggatggctacgcactagatcatatttaatgaggttatcattcattgtggtttggggcttattactgcacatttggtcacagacaagagcttgtaaagcagaacgtgcaaataccaggggcttatgactttagaatattgtaatgatatgtgtgtgcaagagggacccaatcttgtccctggtttaaagcacagggtatatgtaaatctaagttaggttttacgataaacagaagaaaaaccattcaaccagatactagtaaaatattcaaaaatgccaaaaatgtttatgtgcctagcacgttgatttttattttaaagcactttactcattgaccaaattatttataaagcaaaatgtctacttcgatagttttaagaagggctgggtggcggggtagaggaacaaatgtaaggagctggaagatattcaaagtctaaagttttttgcttaaggacaaaaactggcatgttagggggacaaacggttgatgtgatgttgaatggtagttcttttttttttcttttggagatggagtcttgctctgtcgcccaggctggagtgcaatgccatgatcttggctcactgcaacctctgcctcccgggttcaagcgattggccaggcttgtctcgaactcctgacttcaagtgatcagcctgcctcagcctcccaaagtgctaggattacaggcgtgagctaccctgcccagcctgaatggtagttcttgatgaattattttatttattgagttgaataaagtttgtttttggagggtgagtagtgaagaaggaagatgagattacaaatgtctcaattgtaggattccatttatccatcacaaaacgattgatagtattataagttctgtttatttgtttgatgcttaacagcttaagaagtacttttttaaaaatcaagtaatttcagaaaggcaatgtggtagct

SEQ ID NO: 89025 - DNA, 1036 bp, Homo sapiens
tttcaccatgatagccagggtggtctcgatctcctgatctcatgatccacccgcctcagcctcccaaagtgctgggattacaggtgtgagccaccacgtctggcccgcttggcccccatttctaagcaggataccctctcccgtgtgagggctcctcagggtctgtgtggccatgatgtggagttgagttgggtgctacgtgggtgccttggcctcacctttcagccccgtttcccctctgcacatggcttctacctcctctccttgaccccatggttaaacagagttgggtctttgtccagggatcccatttggcattgggtcagcagggacttctatgtcgattctgcacacacatctgcatgccaggcaagtgtggccttgttcagagataaatggggcccagtgcccattccagaagaggacagcccagcacaaggcagctggactctggggcagccggacaggttaggggccaccattcctgcagtaggagcagtgattgtcctggagatgcccttgaaactgggccttcaggtcagctgtgacctcacggtgggtgcactgtggcaaagcacattggatgcttggtttaagacggtgagtttaatccagaggaaaacgggaagactttgaataggcacaggtgtgagcagagctggatttttcaaaagtggtgacaggttgaatggaggaaggaaactatagcagtgctctttttttgagatggagtcttgctctctctgcccaggctggagtgcagtggcgtgatctcagtttactgcaacctctgcctcccaggttcaagcaatcctcctgccttagcttcctgagtagctgggacttcaggtgtgtgccaccatgcccagataaattttttttgtatttttagtagagattgggttttgccatgttgtccaggctggtccccaactcctgatctcaggtgatccacctgcctcagcctcccaaagtgctgggattgcagaggtgagccactgcgcctggcctcatgctttttgtttttaaccccttt

SEQ ID NO: 89026 - DNA, 1046 bp, Homo sapiens
ttcctgaacaaaacaggttgttttaggatgggccagtgtttctggacacctgtactgttcaacacttgcactgtctaagaacatacgctgatattcatgtcatttacccatccagcccctgttggtgggaagctgctatgtgtgtacagaatgactaaaccagacttttttatttgaccctgtttgctacaaacgtaattgaataattggggcctggcagatcggaagcaataggaacaatatatttcaatccagtactctgtgagcagcagcatttcacagagccagaaataatttagcctgtagagcttattaagaagtgcaatgttcgttatgcgtaacttcagttctgttagagccaagaaaataaaagtcaaggctgaaatataaggaaatgaataagatacatggaggctggtgagatctggaataaaaaaaatatttacataggagttcagctttgattttatattgtcacaaattggtaccagatgcctgcatttcagacagactcctgagctgatcccagagtgtgagttgggaaacaaatcactttgccatttggaaggctgattgatattttaggagtttctttttgttttcaaagggaaaataatgcatattatagacctagcaaacagaacttttgtaaatggcaattaacagaagatgcccaagtgaggaagtctccagtttctttttataaccctggcaaaagtaatggaggtgacattttattagcattggcatctcccgcttacaatgggagctagttcagccttgttgagccgtgtccagagctggtagcttcatttccattttccttcaacctcagggagaaacacaagggtatttctgtctggggcggcaggacctcatgtggtctccacgtggcaggatcctagaatcacggggtggcagtacatattttcccctatggctttaagaaaatggcttttcattttgagtcttaggtttggtctcaacagtgcttgcttagcctccaggccatttttcttcctggtgtttgaatgactcataaaatg

SEQ ID NO: 89027 - DNA, 1030 bp, Homo sapiens
tctagtagagaaagggtttcgccatgttggccaggctgctctcgaactcctggcctcaagtaatccacccgccttggcctcccaaagttttgggattacaggcgtgagccactgcacccggcctggtcagggtcttagaatcttctaggctgggagtgggaggtggagcggttgttctgttactttcttacaaaaaaattgcagcccagagttcctatgagtatttgccctgttgtcttcatattaagctttgcttcgcctaagctgcttgcactgataatgtaagcttgctgaagtgctgttgttagaaaactcctgttttcttgagagagaaaggcacctttcctataaacaagtgttttgtgacatgttttaagtggaccttttaccctagatggtgttttctaccatataaactttttgtcagtgaacaagtgattctttcttctgtgtctgtgttgattctgcccgaggcgacgggacgagatacactgctaaatagattccagtcagatgatcccaaccgtgtgagcttataaaagacagctgttaaagtttaaaattaataattaacacacacgcacagacaaaagttgttgctcctagcaagattaaaattagtctgctgttgcagaagctctttatatcttcctcaaaagaattttattgttgtgtattttttcccatttcatctaaagataaaaatttaggtagagaaaatgataaattgattttctttctttttttttttttaaacttgttggcaagttacaccgttaaggtggtagggctcttgtctctccgaagaatcataagtaacacttgtctatggctactttgaaattacctaaataagataaaattatccaaataagataaaattatcccaagcaagaacttttttttttttttttgagatggagtttcactctgtcacccaggttggagtgcagtggcgcgatctccactcactgcaacctccgcctcccaggttcaagcgattctcctgcctcagcctcccgagtagctg

SEQ ID NO: 89028 - DNA, 1088 bp, Homo sapiens
aaaccttggctctccctggctcccccatgtactccacacctggtttggcctccaggtgtggacacactccacagtatccttaaaccatgggaccaggtgctgcattcccagccaccctccttgcccggctcagggaagccctttgcagagaacgcctggatttgattccttggagcctgacgcccattcagaacataggtaagttggccgcaaactccttggacttagatgcatagggcgcatttctgtctagggtgaagctggcccttttatttctagtggttttccctttccaatattcccttcccacccatatcctgtcctggctgggcccccacttttcttccccaccccctccatgagtatccaatgtgttctgtagcaagatcaaagcggtttatctcatcagccacacaaaaccttttcggatcctgatttttttttttcaaccagtacccagtacctgcttctcctggttctacccttctgcgtattccattgtgtgcccctacagcagcagggcagggcccctccctctgggacgaggccaagtatgaattagaatgcagcactgccactgagccagcgaccctgggctggccgcctgatgtcctgataccctaaggctgtccagggaccctgggctggccgcctgatgtcctgataccctaaggctgtccagggaccctgggcatgtaccttcatggcggccaggtgtgctgtgtctgctgctgtgttctgaccttccctctagaccctttgtcaaaagagtttgaacttgttcccagggggtatcactggatcttcaagtagggactgacatgagggaaagagtgtttttcaagattagcaggacagcagtgggcagggtagactgggagatctttggggatgaatttctggccagctattaaatcctagcagcagttcctgtcagctctaaatagccccatataccaagataacctcacaccttgatttttcaggatttggcaagtctgatgagagcccttgaaacaaaagtaaactcaggcaagccaagagccttttgtattctctgtaaacatttagagagtcgctttcttgac

SEQ ID NO: 89029 - DNA, 1028 bp, Homo sapiens
cagtaattatagctcccaggaaatataggattataacccccaggaaatgatggccatgaatagtttgatgactacacttcctagtaaattgctattctgctcctggtgtgacactacactgacttctgaaagccagacttttgcttttaccaaagaccaagtctctgacttatatgcattgtgttcattaagctcccattgtattctctgccttcttttggtcttgagaacctcatcagcacatgtagtccctaggttgtgtgggttccaattcccttccaggcgccttctgggagggttcagccttctgtactcagccagggcaccagataagtcaggttgcgggagtatgtggggctctacattctgcccagtggttttgatcagtggaagagggtcttcccaagaagagagtaggaaatcaattgattggaaagatagacccatttttcctcccttccctgtgcccatgccatttgcaatgtgatgaagccattcccccactgcttggacttgggctagcctcctgacttgctttggccaataaacacagtagaagtggtactgcccgttttggagtctagaccttaagaagtgttgtatattccacatgttctattggacttctgctttgatgaggactccatctttgatccaactttagacagactcctctgagccctcctcctcggagccccaaggccttgtccttggcctgctcaacctagtttagcaagaattctgccaggccagtttagcaaaaatcacccccagtcttgatgcctaacaagttcctcttgataaattgactccttcaccctgcctgttggctagaaatccctagttacctctgtggtatccagagttgagtttaatctctctctcctattgcagtagtcttgaataaagtttcccttgcctgtttaactctgtctggtgcagtttttctttggcagcttccaccatgagaacaagcccagactagcctgctgaagcttgagagaccatgtggagcagagctaagtcct

SEQ ID NO: 89030 - DNA, 1014 bp, Homo sapiens
cctgggcaacagagccaaactctgtctctaaaaataacaataaaagaaaaataaattgtttattttctttcctttgcccttctttctgttctcttcaataccggcaggggagtgttacagaaaatattggtgttaaccctggggagggagttcttgtagctttaacccagatccagactcctctttctgcccacatccagaccactgagcttgaaatagagaagggcccacccagtgcctctagccctgtgctgtccagtgtggatgcccctggccatctatggctttggagcactggagtgtggttgggccaaattcagatgggctgtaagtgtaagaacacactggtttcaaagacttaatattttttaaaaagaatgtaaaatatcacatcatttttctattgattacatgttgaaataatattttttatatattgggctaaataaaatgtactatcaacattactttctcctgtttccctttaccttttgtaacgtggctgctagaaaattttagtttatagatgtggctcccatgatatgtctgttggtcatggctgatttatattcattcattcattcatttatttttgagatggagtttcgctcttgtcacccaggctggagtgcaatggcgcgatctcggctcactgcaacctctacctcccaggttcaagcgattctcctgcctctgcctcccaagtagctgggattacaggcatgcaccaccaagcctggctacttttgtattttctttttagtagagatggggtttcacaacattggtcaggctggtcccgaactcctgacttcaagtgatccgcccacctcggcctcccaaagtgctgggattataggcgtgagccaccacgcctggccttattgctgatttagagcagttcatctacactgggcccagggaagtggcaaaagaagggggtgttggtggtggttgctggggttactgacccaataataatatttaagattatagttactggtgcctatttca

SEQ ID NO: 89031 - DNA, 1013 bp, Homo sapiens
tttatacctgtctttccaagtgccatttaagcaaatggaggttctgatgactgcaaagagccatgcagtttaaacccagtcctctttccagcagaactggccccaaaagctttggctgagaagttttagatcctttttcaaatagttctctagcaagcctgtatttgttttcgtttggttgtttgaaacacctttcagagtcctctttgttttttggtttgtttgttgttttgtttcgtttgcttgagataggggttcactgtgttacccaggctcgagtgcagtggtgcagtcacagctcactgcagcttcaacctcccaggctcaagcagtcctcccaccccagcctcccaagtgcctgggactacaggcacgtaccactccacccagctaattttttattctttgtagagatggggtctcactatgttgccccctgcctgttgttcttaaaatctcagatcttttcttacattgacaccagcaagaggcagaggataaggtgttttgtcagtatgctatcagtttccgtcagtttctattggttcttgggcctttttattcaagctttaaccaccatcttctatgcccaaattcacgtgctcagcgctgaatgaaggatgagcccacagacctgaacagtggagtggccccctcactgtagccccaagctctcattttctgcttagggagtctccaggtaagcccacactctccctttatttacccttggatcctgtttggtacctgatgaccttaatccttgctggacctcagtcagagccttgggatttgggtttttttcttttatttctataaagaaagaacgtgctttctattaggagaggcaaggttgtgtacaatggtgtattattactaatatgctgtggatataaagaaaaataagggccagtcacggtggctcaagcctgtaatcccagcactttaggaggctgaggtgggaggattgattgaacccaggagtttgagaccagtctgggcaacacagtgaa

SEQ ID NO: 89032 - DNA, 1005 bp, Homo sapiens
tacagaagttgggcacagagtcaaggacccggggggacatattgcaaaattagaaaatgctagaacctgtgatcctaagtgtttcaaagcagaatatatgagataatatatgtgaaaatggctggggggtggaaaagtgctctgcagacacagagcattatgtagagtcatacagacctagaccaagacttaatttgaacccagcttttgagtcttgtctgccactttctaggtgtatgaatcattttttctcatctgtaaacaatgcaataataatgtctatgttattgagaggattaaataatatgtagagagccctagattaatgagagccagcagttggcaggtcttccttgactccatcaatctgctgttttaattctctcatgaaattaaccagtgatttcctgggtctgaatttactgtttgtattcactagttctaggtagtgaatttagttgtggactgtctattctagacactactcagaattcagcatgcatgaggacaaggtctctcactgcatatttaatcagttattgtctcacagaagaagcaattgatgcatcattcacaatgtttttaaacctatataaagagtcattgattcagaacatttgctctgcatgtgaaaatatatgtttggtggtttccatggagaccaccctgctggctgttctgtgatcactcactagccttaattatacactggaattgccagggatccttcaaagctgtctccataacaacgcctccttgtgggtaacatgaccgccatccctgaccatgtctcccatataggagtttcccttaagagttgaaaagagtcagctggttaatttcagcctctttttgatgtatccttatgaagatctcttagctgcctaggaatttttctgagtttcaacttcctatctctcctgctatttttccaggtttcaggagcttgggtgaaagtaatagcaaggcctaatgtctttctttcttcagtgacatgttgacatt

SEQ ID NO: 89033 - DNA, 1044 bp, Homo sapiens
catgacctttttttagatataaggcagaaaagaagaaaagagtcttgaaaaagattcttttatcctgcatgctcccttgtgcagggttggctgcctggtagagaggagacagcctaaggtttggattgactggagttaacattctggctccattgtttaagagttgtgcaatcttagccatgtttcttaacttctctgagccttagtttaaatgggcacaatagaacctcacagagttgttactaagattgaaagagataaatacataaagattttagtattgggccctgcacaaggcatgctctcactaaatgggcattattattatcatactgttattaccatgataagacaatgtcagtaacagaatccctgggaatgctggagtgaattcaatgccaggggactgaaagcacaggactgctaaagacgccttccttgcatttcctggggcaatggggcagagggtcatgtgaggcctcatgggtcactgtttcaccattgctgttcccctcaggtgatctcttcagcgtcctggacttcccattcctgtacttctacagattccatggtagctgctgtgccaggtaatcgtaagctcactcatttgtatgctttctgtgctgtccgctgtgtcttcctctctgtgaagttcagggtcactgctagtgacctgagtgagtggcaggagagagtggtggtggatgcaggcaaggaagcagtcattatgtcaccagcaggctgtcacttagcacccttagatgctcagggccagcttgggccctgccaggacccctggcccatggaagtccctccgccaagacagtgattttcgcgcttgctctagagctaggattctcccacttttttcctcctccacaagcaaatctcacatagaactccaatatataaaactgatgaaatggatccagttcaagggaagatttgggttcagaatcccacccgctcagctttccccttggcctccttcttgctccttaaggcaacctccaaaataacctccaccaaacctgaggactctgg

SEQ ID NO: 89034 - DNA, 1047 bp, Homo sapiens
gagtttcgcttttgttgcccaggctggagtgcaatggcgtgatctcggctcaccacaacctctgcctcccaggttcaagtgattctcctgcctcagcctcccgactagctggggttacaggcatgcaccaccacgcctggctacttttgtatttttagtataaaaaatactagagatgaaatttctccatgttggtcaggctggtctcaaactcccgacctcagatgatccacccgcctcagcctcccaaagtgctgggattacaggcatgagccactgcgcacggccataaaatggcttattattaacattgaactcctgggggaaaagcttcatgatgttggatttggcaaggatttcttggatatgacaccaaaggcacaggcagcagaagaaaaatagagtaattggacttcatcaaaatgaaaaattttggtgctttaaaggatactatcaacaaagtaaaaaggcaacccccagaaagggaggaaatatttcctattcactcttcaattgcgggattcacttataggctatatagagaactcataaaacttaatagaacaaaagcaaacaacctgattgaaaaatgggcaaaggacttgaataggtatttctccacagatgatatttaaagactgataaatccatgaaaagaggctcaacatcattaatcattagaaaaatgcaaatcagaactataggagataccacttcacacctatgagaatggctgttaccaaaaaaccagagaataacaagtgttggtaaagatgtggagaagttggaacccttgagcaccacgggtgggaatgcacagtggtgcagctgctatggaaaacagtatggtgcttcttcaaaacatcaaaagtaggattattatatgattcagcagttccacttttggatgtatacccaaaagaactgaaagaagggagaggaagagatacttgtgcatccatattcatttggctattattcacaatagacaaaaggtagaagcaatctcagtgcccattgatggatgaatagataaaatgtgataaa

SEQ ID NO: 89035 - DNA, 2631 bp, Homo sapiens
aaattgaggaccccaaatgtcttttgtttacattgattatatcaattgatatttatcaatctgaagttaaaactgagaaatagaaaaattttaagtcatttaaaagtcatgctagtctgatggtagtgggttatcagaacttattaacattagtgtcactaaagttgatatacaacctccccgctgctaaatttggctggctttaaaaaaaaaagtcatatgttaacataaataacatttttatatctaaagaaaacttaaaaaaatagattagaacatgtgagaaaagtggaaaaagaaaacaaacaaaaaaatagagttgagatcttactgtgttgctcagctggtctggaacgtgtggcctcaagcagtcttcccaccatggcctcccaaagtgctagaattacaggtgtgaaccaccacacctggccaaaagaaaactatatttgaaaacaaaaattagtgaacagtattttatatttttgcaaatctctaacatctgacttattagaagatatctggattcttctatcttctttttttcattcaacctgttgtaaggttgaagtatttgaagaaaatccatcctcacagctaagtagattgtagcagatataagtgaaggtgggtaataagagcgtagtagaaatactgagaacaaactgggttaaatatctaaaaatgcatttatatcttaaatctactctttagaaaattttagaaaacacgagaataccaagcacacattccattggccatcagtgatgatgtcatcacatctgatgtagactctggaaaactccacactcttgggagaatgagagttaaaaagacaaataatgtaatattactattatgaaaattttgacttcatagaccctctgaatgggtgttggggatccttctcctagagtaccagggtgcaagttacaaaatgctgaactactattatggacaaagaattttaggggatattccaagaagagaggattggcaaactgtaagcaaaagtgaggaagtgtgtagctctgttgatagagagttgtaaaaaaaataaataaatagcggtactcctcaaaactgtcaaagttatcaaaaacaaggaaagtctgagaaactcaacagcctaagaggagcttaaggagacgtggcaactaaatgtaacgtggtattttgaatgggatcctggaacagaaaaaggatgttagagaaaaactaaggaaatcagagtagagtatggactttagttaataataattatgtatcaatattggttcgtgaattgtgacaaacgtataatactaatgcaaggtattaataggataaactaccgagtgtagtatttgggaactgtactgtcttggcagtttttttctagttttttaaaagtaagactattctaaaaccaaaaaaattttaaaaaatggattagtgttgttatgtagtcccagattatttttttcagagccacttgtcttgagttgaaaaattacttacttaaatattctgcttagattatgtcttctagctgtatggttagaaaggggaccttcctgtaggttatgtttctcttgactcgcttccagtagaggactgaatttttgttgctgtgtgcctctttcatgtttgctggttttcttttttttttttggagacagagtctcactctatcgcccaggctggagtgcagtggtgcaatcttggctcactgcaacctccacccctgggctcaagcaattcttgtgcttcagtctccagagtggctgagactacaagtgtgcatcaccacgcctggctagttgttttttttttttttgtattttagtggaaatggggtttcactgtgttgcccaggctggtgtcgaactcctgagctcaagcaatccgcctgcctcagcctcccaaagtgctagtattacaggcgagagccactgcccccggctgctgtttttaattttacttgattctttacccataattgtctgcaggaaacctttaaaaaaaatgatacaagcagcgaaggtcatatctttaggaagtggaaggaaagggagatgattccccactaatgtgcagccaggcaggtgggggagaatgcggtagtagtgaagaaccccaaggaacagagttcagtggtggcagttttgcaaaggagaggaaaacagggtgggtcttagggttatttagcaacaggaaagaaagaaccaggaggctggttaaaagcttgatggatgtcctttgaagtagaatcgctgactggaaaggattgtatggggtgtcccatcagattgtgacactatagggagtttgtgttgatgaatggaatagtaggaaatgactttggatagctaggacagagcaagattatggagggcgtttcccccatcttgttagattttttacaaaaagcggtttactgaagagtcacagatgacagaggattcccttatatacaacctatggtacctgttcataggaggagcctgcagtaaattttctgagcacttgggatagcaaaccactgtgcctatagggaaaacgcagcgggtcttcccccgaccccagaagctgtccgtctcacagcctggaaaaagtgtatggagggcttttaattgttggcttgaagagttt

SEQ ID NO: 89036 - DNA, 1053 bp, Homo sapiens
tgtgtgatttaagtaatctatgtaagttatgtatatttaaccaagtgacttaaatatagtgaatattcagatattgtctgttatgtaactgttagtcattgccaaatgtgagtgagaattctgagttagacagtcacctgccttttggaacctggactttgaaactgatcagatgaaacatttctaggctaaacagcattgtatcttctacctagaggatacagaaggaagtcaggagagtcatgaggccaaaaaattagctatgttctccagatgatagaaagcttcaagagtctagaccttaaaatccttaccaggagagttctccactcaattacagataagctctgagtgaatgaaagacacaccagactttcaggaagcctcttcttctctcccaagtctggccttacagaaggctggaagagttctgtgatagtgtattgtaggtatgtgctaggtaccaggtgtatttcctcaatctcagggtgagactagataaaacttgattctcattcactcaggcataaatatagttatcatttgtcgcctttaggtgctccacccaaacagcctgagctaagtaaattcctgaatgtcagtactgtggaacctgaacaaaggtcacttgcccagttgtctctgagtgtcatgcagcaggcctttagaccaactagagggcctatactggctgaacttgatcaaataattttgtggctaaaacagataacattttatgctatattctaaattagacactcagtagtagttaaggaatgagttttggactttatcctaaaagcaatgggaaacaataaaaaagattttgagtaaggagatggaacccatcacatctgcattttagaacaattactgtgttacagtgtgaagaatggaaactaccaagattgagagcagaaagattcgttaggatgctctgaaagtaacccagcgaatgggataccttggagtagaattatggaagagggatggaaagagttgggcaagttcaggagatgcttaggcatcttactaaatagtaaaggtcttaat

SEQ ID NO: 89037 - DNA, 1401 bp, Homo sapiens
tgcacctggcctcatactttcattcagaacaaatgaattctaggcctcagtttagctttctctcccagttctcttaatcctagttggtactcccacaggtgcatgccattggtcttaaggctagctgtgcaggagaaggtaaatggtttgatagagttctttcccattgttcaattttaacatggaaaaggcacctcctactctcataattggcaacctctgtttacttaagcacattacattagtttatattgccttattttgaatagtgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaaggtattataaccttattgtgacaacttcattgagtggtagaaaacactcataatgtgctcctaagtaaatcttcaactatttttgcttcttaagtttccatttcctttgaaaattatcgaaaagtgcatccttatgaagacagcgatagctctgaagatgaggttgactggcaggatactcgtgatgatccctacagaccaggtaccaaagtttttactttctgggggcagcagaatagaggtataggaagactaatcttttcaatgaactcttttagttttatatttttctttgaatctcatttggtaatttactcttagattcaaatgtcttttcagacaacgttgaatgcagcaatgtagtctttgctatttttatatacctggcttatttcaattgcctttagcaaaaccggttcccactcctaaaaagggctttattggaaaaggaaaagatatcaccaccaaacatgatgaagtagtatgtgggagaaagaacacagcaagaatggaaaatgtaagttacagaaagtatctatctctgaatttagagttttgtttgaatacctttcaaaaacaggattctaaatataataccttagatttctaaaaatgtctttctttctaaagatgtttttagataacaatatggcaatatcatggaaactgagacattaatgaaaatataaagtacctcagaataaaattccataacagtgttgaaaaactattttgactcacattgattctaaaattaataaatagttattatgaaattaacatttattcttcatcatatctctataaaatagcatccctacccaaaaaacagataacggtggcgattggggaatacaaatgggagggagaaatacttttcaccatatactcttttgtgcattttgaatttattatcttgtgcctgaactacctgtgtaaaatcagaagtaaagtgtaactttaaaaaatagcattctaggccgggca

SEQ ID NO: 89038 - DNA, 1050 bp, Homo sapiens
aagctgtagtgagccataatcatgtcactgcattccatcctggacaacagagtgagaccctgtctctctctctgtctctaaaaaaaaaaaagatattaggccaggcgtggtggctcacacctataatcccagcactttgggaggccaaggcgggcggatcatgaggtcaggagttcgagaccagcctggccaacatagtgaaaccccatctctagtaaaaatacaaaaattagccaggtgtggtggcgggcgcctgtaatcccagctactcgggaggctgaggcaggagaatcacttgaacctgggaggtggaggttgcagtgatcagagatggtgccattgtactctagcctgggtgacaagagcaagactccgtctcaaaaaaaaaaagttattagaagtggctcagaaaatattttgtgattagcagtcattttcacttacagtgctttatctcttgcaggaaaaagcagttgatcctaagacacgtttacttatgtataaaatggtcaactctggaatgttggagacaatcactggctgtattagtacaggaaaggagtctgttgtctttcatgcatatggagggaggtaaatgagcaaaatatgataccatgatatgaaaacttagtctcttctccccaagattaatgaatttacacagaatcaaagataatgctgcatggcaagcagagtaatttttaaagtgttattgtagaaagtctaggcagtataggaatgtataaaaaacacagtcatcctaataccaccacccagagataatcattaataattttgggtagacttctccagtttttttcaatgcgtatattattattattattattattattttttgagatggagtttcactcttgttccccaggctggagtgcagtggcgtgatcttggctcactgcaatctctgcctcccgggttcaagcaaggtctcctatcccagcctccagagtagctgggattacaggcacatgccaccacgcctggctaatttttgtatttttagtagagacagggtttcgccatgttggc

SEQ ID NO: 89039 - DNA, 1552 bp, Homo sapiens
gaaacaggatctttttgtagtaggacaatgacaaggcaaatcttataaattggactctatcctagagaccttccaagtaagggatctcttgtatggcatttttgctagggcctcacctactatgtggttaaactagtccaatgaaaggagcttatctcaaaatctagcctattctgtcataatgtcttttaagttattagagatttcttccctgaaaattgtgtcatctgttaaccaaatagttgagcagctgtcaagtaccaggtactcttccaggtactagggatacagcaatgaatggtacaaggaaggtctctggtctaatggaatatgcttcccccatcctcaacccctctccatgacaataataaacaaaaaatatcagatatatgctatgcagatagttaaaataggatgatgtcatagtgacaggctgactagctttattagtaggacagggaacgcttctccaatgaagtgacatgtgagtgacacatctaagatacatcaaagatcaggtggatgggcattctggactagagaacagctagtgctaatgccttaggacaggtacaaagttagtatctttgagggaagcgtaagaaacccagtctccctggagcataggatgtgaatgggagagagggggctggaggagtaagcaggggctggaccaggtaggattttgtaggccagggtaaggagtctgctctttgactgccctggaaccaaagctatgagttgattcttattttcaaaagattgctgtgtggaaaatgaattataggaggagaagagaagaagcagtaagatcagttaaaacgttgtagtagttgaagtgagaaatggtgaagggttggactagggagggcggtagtggaagtgaagagtaggagagcgttggtgtgtgttttgaaggtagagagaacagcacacgctgttggattggaagtgggtgtaggaggatagattctgggctagagcagctgatggtggtaccgtttgacgaggtgagagcctggggaagggtagggtgaggactcagcatgagttttgttttgggcatattaaatttgagatgcctgttagacttctaagtgatgtcatgtagttgttggataaatgggcctgaagttctagggaaagtcaggactgggatagaaatgtgggagttatcggccaggcgcggtggctcacgcctgtaatcccagcacttttggaggccaagatgggtggatcacctgaggtcaggagttcgagaccagcctggccaacatggtgaaaccccgtctctactaaaaatacaaaaattagccgggcgtggtggcatgcacgtgtaatcccagctactcaagaggctgaggcaggagaatagcttgaacccgggaggtggaggttgcagtgagccaggattgcaccactgtactccagcctgggtgacaaagtgagactctgtctcaaaaaaaaaaagaaatgtgggagttgtctatatagagatgatatttagagccatggggctaagtgaaattgcccaggaagagaaggaaggttt

SEQ ID NO: 89040 - DNA, 1378 bp, Homo sapiens
ctgtccctgtgcccttccattctgacagtatcgttcactcgatcttcatgaagcacgcatttgagagtgccatacacagaaaccctcgcgattccccaccacctctaggaatttgtccaggctcttcacagatgtgcctctgtcctgtcctttagctccaattttttttcattatctctctccagccaagtcttaactatagtgtttgttgttcctcagacatgtcctgtggtttcctgcctctgcttttgttcatgctgttcaaatcctacccattgtcctgtttctgtttcagatggcacttgtgccatgaagtcttgcctgacctttccaatgaagagggacctttcctattcatgtacttcttttattctccgttgccacttcttgcagacttgtggggcaggaaccatttgattcacctttatgtctgctaggagtgaaagagttattttttaaaaagctgttttatttgttgctttttattgaattttgctcctgaaccatattgggaagactgtagcctattttcaagtgcatatgtcttcattgtatttcaagcttgattccgtagtcattaagtgaagaacattatgtgatagatggttgaaaatcggttgacaatttatttgaaagtatattttatttaaaaaatcaaaccaaaacctaaggctttattaagatccaaaacctaaaggcttaaaaaaacaagacttgacactgagagaaggtagatctaatttagtgttacagaatctttattttgaaattgttgtacttgtgagctggcaacttgtactgacttgattttttttcttccacttagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatcatccgcatgtgggcagaaaaagaaatgcacaatctcgcaaggtaaagaaaatattgtgctagacgtaatcttgggtaaatacctttttgcattaggataaaaaaatccatgctttcttttacattcatttatagaaataatgaaaggccaggtgtataacctcgattcatacttttaggatgaaaaagccattttcttttttctttcctcaatgaagcttgagggaaatctgggcattttctgccttagacactttatcatatatctaaatgccatttttaaattgcttttatcacgaagtaaaacttccagcatccaattaggcttagcataaaaaaatggtttcttttttgtttcagaaaatgtttgttgcatttaatttgttaattttgtgg

SEQ ID NO: 89041 - DNA, 1049 bp, Homo sapiens
ctggaaacgttagactcccaagaccttgtctcaaaaagaaaaaaaaatgttttttcaataaattaattaattccaggtagaatcattttctagaaggtcttgctgtcctccagtctcttttctgtactcctgaaattcctgcctttcttaaaattcttcaacagttttccatagtggagcttgcctgtctttgtagcctcagcccacattgcccttcctcctactcacagatccagctatgttgattgatatacattccccaaatggactgtgctcttgaacacctccctgcattcccttgcactgtctttatctggctaattcctgttccctacctcttcttctaataagccatccttggtgctgtgtgctcctgtagctcctacccatacctctgccagtgcgtaattgtaattgtctcttgtctgtcatttccatcagtccctgagctctctatgggcagaggctgtgttttactgtctttgtattcccacatcaccagggtagaacatagtgccagctcattgcaggccctgattagatatttattgaataaatgacatattttctctccttctgatctgtatattctgaatcatttctttatgtatagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatgtaagttgtgcttttaaaagaattcacacactacctttaaaaaatatttcctctaaactttaaaaaaatttccttaaagaagccaggcatgttggctcacacttgtaatctagaactttgggaggctcaggcagtaggatcacttgagcccaggagtttgagaccagcctgggcaacatggtgaaaccctgtctctactaaaaatacaaaaaaattagctgggcgtgtgcctgtaatcccagctactcgggatgctgaggcaggggaattgcttga

SEQ ID NO: 89042 - DNA, 1084 bp, Homo sapiens
tatgtcttaaaaaacaaacaaaaaaacccaagttccttagatagtgctatttcaaggtgctataacaaagacaagttgaagtttgtgaaagaatgttaacactgaagagttgtttttctatcaatatgtgtgtgtcttaaatagttttagaaaacttacagacttaaccagggaagtcgtcattgttaggattagtgacacagtgcatgaagctatttttcaccaaacttcattaaataaaatttgctgttagtacatttagcaaagtgcctcattagtttgtgagctttcatgaatgttatagttttttggggcttttttttttttttttttttttcaaataagagacagggtctcactatgttgcccaggctggtctcgaactcctgggctcaagtgatcctcttgcctcagcatcccaaagtgctgggattactggtgtgagccaccacacccagccattgaatgttacagctttaacagtgaaggaaaggaagcaggtctggtctcatcataagagagtgatgatgaaaattgaaaacagtagggagtgcaggtgttaagttggaaggcatgttgggaatctcaaggaaactacatgctttgaaatagcaactgaattcaatctgagggccttccaggttgagacaatgctcctaatactgccattatccctctgtgttttaattgaacactggagaaacttaatgtgctactttatgcaatctccacatgaagctgtcatgtaatgcagccattgatctagatatggaaattttaatccaaattaatttttaaagatatagctagaaaggtgatccacctttctctgcctccaaaggtaaacattgaaaggaaaatcaagtatgtttttctggcctctttgggaggtggggtggctggggaagagattaaatagtgatgaaacttttctatttaattctattaaggctggaaaacaaatgcattaatgttgatttctactgtaagactttgaggggggctgggcgcagtgctcacgcctgtaatcccagcactctgggaggccgaggtgggcaggtcacgaggtcaggagattgagacc

SEQ ID NO: 89043 - DNA, 1065 bp, Homo sapiens
tagtgaaagtatttcctttacatattcaaagcaatgccaagtggttttatttatagcactcatttttatagctatagaaggtgcagtggtatgagctaaatccagaaggcaggatggatgtgtgagaggatgaaaagcaactagaacctgagtatagtccagcttggaagcaggaaaatcgatggttgagaaatgaggcaaggaatgtagtggctcaagagatcctccctccttggcctcccaaagtgttgggataacaaggataacaggagtgagccgccatgcctggctgagccagtaatttttactctcttaaaaactaggttattcctaatgattctgcctttgagttgaaattactgtgtgtgtgtgtgtgtgcgtgtgcacacgtgcatgcatccaagtctttttataaatgtgctgctccctgtttttagtttataagagaacattgctaatacttcttactgactttcttgtatttccttactagtttttccagaaaggaggagtcaaggaagcccttagtgaacgagaactcttcaatgctgtttcaggcttaaacatcacagcagataatgaagctgattttttagctgaggtatgtgataaacagctgtttttcaccttgctggtcatgcagaactgcatagaggagataactgaaacccagagctagttttatcctccctttcccccaaaacaaaattaatttgagatttttcttttcttaagatgtttttggttttttctttttttctttttttttttgagatggagtcttggtttgtcactcaggctggaatgcagtggcgtgatcttggctcactgcaacctctgcctcttgggttcaagcgattctcctgcctcagcctcctgagtagctgggattacaggtgtgtgccaccatgcttggctaatttttgtatttttggtagagacagggtttcgccatgttggccaggccggtcttgaactcctggcctcaagggatccacccaccttggcctcccaaagtgctgagattacaggcatgagccactgtgcccggcctgtttttttcta

SEQ ID NO: 89044 - DNA, 2577 bp, Homo sapiens
tgagccgagattgcaccactgcactccagcctggacgacagagtgagactccatctcaaaaaaagaaaaaaattactagcacaatctaaaatatggtttctgtgaaaagtaggattttgacaaatggattcaatgtattatttttgtagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacgtattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaaacccaatttggataccaaattaatcaactaatttgagctatctggccttactcttagtagtttttagtacgtgctggacaccacttttaaaaagcaatcactgtgctagaaaagtatattggctttgttaggattaaagttcattaacttcaatgtaatcatgcctcctattactgaagtcagattggaaccactaaagatccaaactttctgtctggtaatagaaagtaaaaatctagacatcatttacatttgagaaagctgtttttaacattattttaaaatgccaaatatgttctttctagaaaaatatttatttttgtttttgttggatagcttttaattacatttcagagaggtgtaattttgggtagatgctcattacatttttgaaaggtttatgattccaaaataaagatttatatgactggtgatactggctttacagaaatttcagagaactaatttttaaaatctttagcatttaaaactttttttgttttgttttctgacatattctgacaaagagcagcaaaccactgctgtgtggcattcttggagtgtgctgtgaatgtgctttttaagaaattaaaaagagatcattttaaaattggttctttgtgtggtatcttcctgttccttatattaacttatgtcctggtaccaagttgctgtttctgtataaagttaagcaatgctattttaagtagattattccccctcaacttctcattgttagatttcaatcgcaaatggcctacttcacattacaaataggttccccccctcacaccttgtagattagagagtagatttttttcccatagtagaaaaagaaagtgaaaaatactggtttgctaagtaaataaaaaatcaaatactggctgggcgtggtggctcacacctgtaatcccaatacgttgggatgctgaggcaggatgatcacttgagcctaggagtttgagatctgcctgagcagcatagcagacctcatctctacaaaacattaggtgagtgtggtggcatgcatctctggtcccagctacttgggaggctgaggcaggaggattct

SEQ ID NO: 89045 - DNA, 1026 bp, Homo sapiens
ttgtaaagggggaaaagactgtacttcaggcgtatcagcggcgccgatgcgcgaaccggtgttagaacttggagcctcgggaacccgacccggtgtcacggtggcatccttttcgctctctgctcttggtttttaaaattcacctgagcagccaaacatctgtaccttgatatgtgccgtgttactttagttgaacccagggtggtgtataacagaaataatcgcttgcgggttggcttctgagtttagatcctttcagagttcaggctgttaaccttgctgcttttccctctcaggtttttgctgttcgatctggtggagctactggcgtggtagttaaaggcccagatgataggaatcccatctcatttaggtaatggtatagacactttcagatcattttgtcatgtaaacagaatgatgtttttctaattcaaatggttttttataattttgtcatttggtctgccctaagaggcctgaagtctgtgtgcgcacatggaattcctgtctgtagggagggtcttcgtggcacttactagcacctcttgtcagagtggaatatctggagcagttgatttgggagccaaatacttcaaaagtggggcagccacttcctagcactggaaattaacaagtcagcgtgatgatgtgcccatttctggtttgttcacagaggagggcgttcatttctttagcccaggtctttccagagtggcaggtggaggagattcattgtttctcatgtaataatacaagaaaatcatggcttccactatacttaaggtgactgcatagtcccagttcgcactgttgaacaggtttaatgatcaacagcagggcctttcactttcagaagtgtctcgatttggatgataagctatctggccactgtaacactggtgcttacagaaggtgaaagtataatgtaggccctcaattcagtagtgacttaaaaaattttactgttggtctgtgttaatgagaaactgtccttttttgagagggagcctccctctgttcccc

SEQ ID NO: 89046 - DNA, 1008 bp, Homo sapiens
acaagtgagaatgttcatttcacttagtgggtttcttctgctttttattctcagagcgcactgtaaggatcttctgacagtttgctgttattgatttatttattaattgagactgaatctcgctctgtcactcacgctggagtgtgatggtgcaatcttgactcactgcaacctctgcctcctgggttcattcaagcaattcttgtgcctcagccttctgagtagctggaattacaggcatgtgccaccacgcctggctaatttttgtatttttagtagagatggggttttaccattttgtccaggctggtctcgaactcctgacctcaggtgatccgcccaccttagcctcccaaagtgctgggattagtttgccgttttttaaatgaagatcctgtttcttaaactctgcttcaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggtaagaggaagcctcccctgaaaaaaacacctttccccagttgtcccctgttcctgtagcatcctaatgtgtcaggcacgttagggacaggttcctctagccgtaacgtcaccgctctgaccactagagggcactctgtatacccgtcagctcctggagccattcattctatgctgggcagacaggctgtgagaggacatgggggacggtggaaaggatccaaagacgaagtctgtgtttatccttgttggttttacacagggaatgatgaaacattgaaggggtttaataagcttttcctaaaacattttccccctaaacaggctggcactatgtcgaagctgcccaaatttgagattgaattaccagctgcgcctaagtcaactaaacccagcctttccgaaagagacatcgcaatggctaccatgtatgtccgtgtcagagagaatt

SEQ ID NO: 89047 - DNA, 1050 bp, Homo sapiens
agatcgccaaagcctaggaggtggaggttgcagtgagctgtggttgcaccactgcattccagcctgggtgacagagggagaccctgtctctgaaaaatgaaaaaaaaaaatagtgattatattttcctgttattaaggaatatacattcattatacaaaacttggaaaacagagaagaaaatgaacttagcatatcactcaagtataactattacatgtgtttctttccaatcattttagactctatgcttaggtttggggttttcttttaaaatattatgatcaagctgtgtttagtgtgtgttctcttttccacttaactttataataggctttgagtaactgcatgtttctttgtaaacacttgttggcagcaaaatactccattaagtgaatatcttataatttacttaaccgtgatgccatttagaacaaaggaattttgaatggccagatgtgatttatgtctgtttgttccctaattagatacgggcagctgtatgttctcttcttgaggcatcattctcggacctccaacagcacaggagcggaggtggtcctctatcatctaccacggtagatttcatgctttgttttccctctctctctgattttaaaatgtgaactgcagcttgttgatctgttttttgctttctatcctacagagaaggtgcctgtaaaaagatgcacatattgaagttaaataggacgggaaagtttgccctgaacgtggtggacaacctggtagtcgtgcatcatcaggatacagaggtacaagctgtctgcgtttctaccaaagttaaggttgcttaaaagccttgtgaaaattggtggctgggcacggtggatcacgcctgtaatcccagcactttgggaggccaaggcggacagattgcttgagcccaggagttcgagaccagcctgagcagcatggcaaaaccccacctatataaaaaatacaaaaattagccgggcgtggtagtgcacgcctatagtcccagctacttgtggggctaaggctggaggatggcttgagcccaggaggtcggg

SEQ ID NO: 89048 - DNA, 1025 bp, Homo sapiens
aatggttttgaggccgtgtggaccaggacaactagaatgggtcctgtgggctgggcctctgatataaagaagctgcttacctcctctaccctcccagagggtggtgacgctaactctgtgacacgtgaggatgtttccagttgaaatgacagagatctgcttaggtcactttgagtgagctcatcaaaggaagcatgtcataaatgcaggaaatacttgtgagaggagataaaaatattaaaagagagttgtgatgttaatgacaaattccttctcaagtaagagctagcctgtagggaggaaatgcaaacacaggcttttaaactgatttaaacagcaagatgggatggaatgaaagcaactgggcaaaccatgattgattttggcctcagtcttgtctttttcccccccagacatcggtaatattcgatatcaagttacggggagagtttgacggctccgttaccttccaccaccccgtgcttcccgctcgatcgatccagccctatcagatccccatcacaggtaacacgggttctgtagaggagtctgtgctgccctttcaccatgtggctgtgttctcaccatgatctttgggagtcacgttaaaagtggagtgaggaataaacagagattcccagatctgtctgattttgccaggggccatttgttccagttttgttgttgttttgagacagtctcactgagtcacccaggctggtaggtagtgtcgtgatcttggctcactacagtctccacctcctgggttcaagtgattatcctgcctcagcctcccaagtagtggggattacaggtgtgtgccaccgtgcccagctaatttttatatttttttaaatttatttttttgacagagcctcactttgttgcccaggctggagtgcagtggcatgatctcggctcactgcaacctccacctgtctgtcacaaggttcaagcttgtgaggtattcaagcaattgaaccaagtattcaatcgcttaaatacttgtgagaggagataaggtt

SEQ ID NO: 89049 - DNA, 1028 bp, Homo sapiens
gcaggaggaccacttgagccaaggagttcgtggttatagtgggctatgatcaactactgcactcaagcctggacagcagagcaacaccctctcttaaagaaaaaaaaagataattaagctacaagccacatttatttgaaacattctccgtggatgatctgggtatttgattttgaatccttcaagtaaatttctcagttccttaacgtgcatatgtaaacgatcatgagtcatctttggttattaaaaataacccaaaccacagtgattgaagccttgacatgctttctttttcttggtgagattttcctggattgttagctccttcccccttcctccccgtacgtgctttcagtgagacggaacagttcatttcttccttgactacaattgaataaacatttcgtaatgacattaaaaagtattgacttttgtgtcataagtaccagcatttgcagcattttctgactgcatcgttgcacttatgttttctcaatttgtaggtcctgctgccgtgaccagccagtctcctgttccatgtaaactctgtatcctttactaaggtgtggcaccgtgcacaacagggcaagtggtcaccctcagagagtggtcctgaagtcctcctccgggcagctgtgaataacactccgagagccaccccgcaggcagcttccctgactgtccaggggcctcgcgtttagcgtggactcagtacatggtgggcaggggcgagtgctagcggaaactgggtttgctttttgttttcatcttttcctggtttagaatttcctataacatgtggattcttcatcttggattgtctttcaacctgacatcattatcagcgcaagccaaggtaggtcagcggggacagttgtcgtgttacaacatggtgcttgttgactttggatcccagttgtagccagggacgttttcaaggtgaatctcttagaaatgacccctcctttcaagcgtgggaatgggatttttttttttcactttatacgttttttactatatgtgcattt

SEQ ID NO: 89050 - DNA, 1854 bp, Homo sapiens
cactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaagttttggggttaccctatctgctttgagagacaaatacaaaagctaaatggaagagattctatctaacctgtccttatggtaactaaatgccgtcttacattgagctagaaatagacctagaagtttcattagacagccctgatccttccctatcctaaagatgatgtcttaggttgtataactatttggagatgagaatgatcaaccagggccaggtgcggtggctcaaacctgtaatcccagcactttgggaggctgaggcaggcggatcatgaggtcaggagtttgagaccagcctggacaatatagtaaaaccccatctctactaaaaatacaaaaatcagccgggtgtggtggcacgcacctgtagtcccaactactcaggaggctgaggcagaagaatcgcttgaacccagcggaggttgcagtgaaccgagatcacaccactgcactccagcctgggcaacggagcgagactctgtctcaaaaaaaaaatgagaatgatcaaccaatgtatacttcataaaactgaaaccttaataagccccagaccctttaaaacccttagccaccatttgccgtcttattcctggctttaagagatattccaagatctgctataagagatgggctgtgcctgatctgggtcctaaatgtgtcttgactcaaaacacacctcctcggtgagttccagagcataattcagattctgtcagtatactgaattcactctactacaaataatgggccaagggctaggtgggctgttatcaaattgtgttgtttacaaaaatgctaacccagggtcctcgcccaccagctgccagtgccctctgctactctttgaggctatggttaccccaagtcttttcattgcattctcacctggtgtgaaattggggctccctcgcaaacgctggtttcgctgttcaaaaaagcggaatattgtatagaaaagcatgttgtcttcagtctgctttgcagcatctaaaaattttcgtgcagaaatgttgtcatggccaccaatgccccggataaaccttaaggcagctaacacttggtgtttggaaaggagaacttctactatttcatcatttg

SEQ ID NO: 89051 - DNA, 1037 bp, Homo sapiens
ggccctggggggaagactggtggtgttaggaatcatgagtccagctggaggcatctcagccaggaacctcctggcaccctcttattctccatgatcctcgccttgcttagttactatcagagtgttcacactctctcctattcttttatctttctttcaggactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactagtcagtaccaccttgtcttgtacttcagaagcagcggaggaggctctcagccaggcagtcagctcaggcctgaaatgtctcactgaaaatagactttcttggaaaagttgtttttatgcaaaatgtatgttaaatctggctttaccttaaaaaacctttgaaaggactaatttaccacctaatactttgaaggcttttttcattaagtgctcatgtagtttttcttttgactgttagcagtataaaacgtagaaaaggaagttaggttttaagaaaaagtactgaaactaaagacttcctccctgtggagcaggtcagtaaccctgtctgtcctctctagtacccgaataggcttcgccccctcgtcctggatcgacgattatttcgactgggtgaagccacagtcgtcttgctgtcgagtggacaatatcactgaccagttctgcaatgcttcaggtaccttctcctttaccaaatctttcctgttttgctgaaaaattttcaaattatcatttaaaaatcatttgcatcgtgcctcagtttatacctatttgtatatcaaagctgggtctccctgtgtcatcattcctttcctcagtcattcattctgaaattgtcatgttgttcctggctcagacagccaccctcggggctgcaagctgaacaaggtccacatgttcggagtg

SEQ ID NO: 89052 - DNA, 1071 bp, Homo sapiens
tgtctgtccattactcttcccagactggccccctccttcaggagcccccttggtgggcaccccatgctctaggacaggacatcttttctttgaattattattattttttttttagagatgggatcttgctatgttgtccaggctggactcaaactcctgggttatagccatccttctgcctcagcttcctgagtacttgagattaggcgtgccaccatacccggcatacaggacttgccaaaccaccatcttgctctcattccctctcactgttctctctccctccctttttcctcccacagttgtaattgtgtgagacacccttttgtcctccctctttggtgaaatccccctcatcctcggagctctgggtctgtacagtctcttcctcttggctataattttgccttttagtgtttgctccctcctctgtgcctgcatagcgccatgcaccatgtgccattgatggcactgggctgtatttgcctgcctcttgcccagtgattctgagctcccaaaggtgagtgctgagctgtattactcaactgagaaacctcagggcccatgttgtccttagaatacagccagcctcatcaaatgttcactgtgtaaatgtttaggtccctgatgtcttgaggcccttctaactgggaggtgttttctaaactttttggcagggctcctgcctctctgaatgatacaagtttgctccatgacccttgtctgggtacgtttggtggaccagtgttcccgtggcttgtgttgggaggctatgatggtaagtaagagaagctttgacttttccttttagataaagtcatctcggttttgtcattagcatcaagtggtaattatgaagatttcataaattgggcagttttgttaatttcttacctcttgaatcccagaatagtatctcctttggctttgggtttgggtttcattccagatttaaaagaagtggattgggttagccatttttaggtcacacatgcctttgagaagctgtcgaaggctaagtacctttccccagaataatgcaattgcaaacctctgcattgttgttcagct

SEQ ID NO: 89053 - DNA, 1401 bp, Homo sapiens
gcatttggggcaagatccatcccattgctcctagaaaggcatgtaaaccttcccattgtccctgtcacacttgccttggagaactgtacctgtgcataaactgtaccggcttcttttttaatgaatgtataatcacatggtttttcctttaaacattgctcatgtctacaagaaagtctgcaatcttgaaaagcattaaaatggtcccaagacttgaatcttttctctacccagtgactgtctgttgctttttccagcttgttgctgaaggtgaacagcatagtcatttacctccaagatcatcttctctgttaggaaataaggggacatatataaatggctgtagtgcagagcaaggcaggaggttatgtgttactattgagaggagggtcagggagaccaggagtccccctccactctcccctctggcctgctggccaccactggagaacggtggaggggagatggttgtgtgtcctatgttgatagctgttctggtcatggtgttccccctacccctcgccgcctctgtggacgcctctaactagtttgctgttagagtgggcctgtggcctgaccagttttcttactgtattgcatcttaattctctccctcatcttaggaagtattttccccaaatactctttgtcttctgaccctcagggcaatgctgattaatcaagatctgagagaaatgtgacgtgtttctgggtttgcttatttttaaaatcttctttcaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacggtaagtggcaagagacaatcattggtagacaccattcttgggtctgacttagggtacatgggcaaaagcttgttttatgagcataacccagaggtgagcaaacaacaagaccttgccctgtgaagtttacatcatcttttttttttttttttgagacagggtctcgctctgtcgcccaggctggagtgcagtggcgcaatcttggctcactgtaacctccggctcccaagttcaagcgattctcatacctcagcctcctgagtagctaggactacaggtgtgtgccaccacgcccagctaatttttgtattttcagtagagatggggtttcgccatgttggccaggctggtctcaatctcctgacctcaggcgatccgcccacctcggcctcccaaagtgctgggattacaggcgtgagcttccatgcccagc

SEQ ID NO: 89054 - DNA, 1856 bp, Homo sapiens
tacacctcccatccccagctttatcttacatattccctgtccctgccctgcaaggagctctggttccttttattggagaatggtatgtagaaacgaagatctgggcactaggtatgctcattgctgctggaaagagtagcatgtttttgtttgtttgtttgtttttttgagatggagtcttgctctgtcaccaggctggaatgcagtggcgcgatctcagctcactgcaaccaccgcctccctggttcaagcagttctcctgcctcagcctcccaaggcacgtgccaccacacccagctaacctttttgtatttttagtagagacagggtttcaccatgttggccaggttggtctcgatctcttgacctcgtgatcccgcccaccttggcctcccaaagtgctgggtttacaggcgtgagccaccgcgcctagcccagtagtgtgtttttaaaggacctaaaagttttaaataaaatgagggccacaaggtgaaattatcctttattaattgttctcttaacatcttcttaaattttctcctgagactggtgagcagagggacccagagcaaggggacttaggggaaagaaggcagtaattagggaggaggaggccaggaggaggaagaaagcatttcatgggattacaggaatgtcccaaaaacaacctcactgtgatgaagtccactaatgctatttcttcacttctgtttttcagaaaacggtattttgtctccgagtacactcccatcgatagcaatatagctttttctgttaatgcaagtgacaaaggtaggcatatttgtccatgaataaaagggttcagatgatgctgtctgtcatgagagcattcgtttcctcagtggggttgcagcagtgggtgaggtggtgtgccagtgccgaggacacggctgcgaccaaggcagacatggtccttgcctttgtggccctaccatctagtcagggtggcacagcagaaccaagtaattaatcatagctggggaggcgcgaaagcagcaggacaagagtgggaatagcagggcagggttgaacctcacccttcagaggctcctgtgtcggcatctcctctgtggggtgggaatagcgctcattgagggcagccaacaaaggtggctttgctgagcagataggtagctgagggcaggggtctcatatgtgtccccaggtgggcttgattcctgccatgagatagcaactaatgctttccctgttccgactttcaggaacggcttggctcttaacctccaccttcccttcctctcccgttcttccaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggtaacctgctgtttgaagaaataagtcactctagatgaccttgtggtttgctggcttttacatgttgactactgctagatggggatttggggctgaatgtcatggtatatcttgaaaatcttagcgtataatggcaaagctgcctttaagttaggtttcaagaaagtgaatgatgttgaacttaatggaa

SEQ ID NO: 89055 - DNA, 1196 bp, Homo sapiens
ctctttacattggggtgttgatgtttgtggttttgttgttttgttcttcatgttactcatgatgtattgatattaattaacctaaatacatatggaaatattctttcattacttagagcttatatagttcctggtgcagatgtgcaaaaatagtgctttagtaattgctaagtcactatcttgcttttctctctactgtgattgagtatttcttacatggaactatagcttcctcttatcaacaaataagcaggaaatagaaattatgtaaataagcaatttccattacctacttcactgacttgacaaataggcatttggtctgctttaattaatatttttcaaaatgttaagtgcctgttgctgttacttaattttgcaggtagcattggaagtttctgtgattgtacttgagtgggcacttcttgttgaaatttaccattgagaccctggtaacactgaagtttgtgttgactttctgtaggtgttttcacagtcctgtgtttggtatggagagtgtggaattgcatatggggacaagaggtacaattgcgaatattctggcccaccaaaaccattgccaaaggatggatatgacttagtgcaggtaagttcattatcttaggcactgggaacacaaaatgctgatcacaagatcctctgtaattattccttaaatgttattgcagggtggaggtggagatgagactaacaggcttaagtcttatcccggactctcaaactctaacctgtggcatacagtgcagagaaagaacaccgtaactccaaaggcttaatttttcaggggctgactttatacctctcataaagtttcccaatagcaggttgctatttagagactgaccttggtacttcgtatgttgcccttgcagcatctgcaaaatatattagaagttagctggttttgattcctagatttcaggactcaaatggactctgttgctaagtggctttgacgtccttgtcccctggtcatttcagtgttttctctgtgttccactgagagcctgtgaattttggctgctaccaggattctgattcctgttctttttttaccatcctgtgatacacagggatattagaactggaaaaatcatgtgaaaagcctggttttagaggcttaaagtaatcaaaagtcaagtcgacatgataacagagttcctaggctcacttgt

SEQ ID NO: 89056 - DNA, 1036 bp, Homo sapiens
ctgaacagattggggtggagccatgaagccaaacagattgggagagagagtgtgtctgcttttagaattcgtaccgatgatagcagctcattagcttcagtctgagcgctagtagagttctatcatggaattatggactagttgtcctgtgtaagatctgaaatacatgttggggggatttttgctttttcttaatgttcaatatgtacagatgatgtaataacattactagactgccttgtttttaaaaccctgtagtcatctaaaaactatatgcagttttgagacatagcctttatttttcccggctgtaattttggtaagctttatcttgagggacttggaacatagagaagcctgggtagaaattaagcattaaaatggcttttcctcagaagactgggaatggttaatcttttgacctgtgagtgattaagaacaaccatctgaaattggaatgactgtgggaaatctttccccatctttcccactccttgactgatgctgtgatcagaaattttactaacataagtaatcaaggggaaaatgagatttttttaaatttgagccagtgggcagagggaaaaggactcgctgaataggcctttgtattcctccagtgtttgttatattacccagaacaaagaatcactctggtcatgaagacagtgtgctctctctttcctgggtaaccctccactcctaaaagggatgcagtattctaagcatggcagattacctacagcggaagcctggatcagtcatctctgatctcgggtgcccctttctgccctttgacctccagctctgtgaagggcatcagctctccagtcaaattgaactgcttgctagcaaaatcctgcccatcttccagggccccatttcacatgctacattatctacgacattcttgtcctgttcccctaactagaatgccttccctctgaagttctgaatctttatttaaactgctgcaacagcatttgctgcctcattaaaagaccttggtgtgggtcttgactcttctctgttccca

SEQ ID NO: 89057 - DNA, 1008 bp, Homo sapiens
agatcctgtctctacaaaaaattacaaacttagccggctgtggtggtgtgcgcctgtggtcccagcttctcaggaggctgaggtgggaggatcgcttgagcctggaacagtgccactgtactctagcctatgcaagacagcaagactctgtctcaaataataataataataagataaaatataaaaatttagaaatgatttaactgttttgtatagtcgattgagaaattaaattggcttaatgaatgtaggtccaaaaaatgattttgacaaattcattggtgttgacataatttgcataagatttttatatttataaacatggagtcaaatatgcaaaaaataatctttagagcaaaaagcaaactcaaagcatttgggtcaaaacatcctgattgttttatacatggtttggatgataaattcagtaaagatacaggcataatccttatatgcaaattagttgatgggtattttctatggtgatttcagacaaggaacctgcaggtcactctggaagatggttacattgaattgagcaccagcgatagcggcagcccaatttttaaatctccacagacgtatatggatggtttactgcattatgtatctgtaataagcgacaactctgggtgagtggaataatacttctgtcagagctgtgagtgagttttactctctttcgtttaatggaattttctggtgtctttttgcaaaatatttgtccttgataccaaaaatacttcactaataagtcttgtccttcttcctttttccatatcaatttcttcataaaaaaataaactgccacacatggtggctcatgtctgtaatcccaacaactaagaaggctgaggcaagagggttgcttgaggccaagagttcgagaccagtcttggaaacacagtgaaaccatgtctctacgaaaactaaaataaaataaaatgtaaataaataaaattttaaaaataaatcagttggatggataaattgtggtgtattcaaatg

SEQ ID NO: 89058 - DNA, 1095 bp, Homo sapiens
tttgtatttttagtagagatggggtttcactgtgttagccaggaaggtcttgatctcctgacctcgtgatccacctgccttggcctcccaaagtgctgggattacaggcatgagccaccgtgcccagcctgtgaatatttttacatagtttgtcctactacacttcttacttgtatcctgccttttccatttatcatcatgatacagtaactagtttattgtatgtgccgagcttcagactagacatttgggatacttttcttgtttactgattatatccacataaggcagtataattacatcacattttcacatgaggaaatgcaagttgagagtttgtctatcttgctaatagtcatagatttagtccaggatcaacttgagattttaacttggtagcgttttctagagcctgtgctttttccagcacaccagagtaagcattaccttagttatgactttttgttacaaaataatattttgctaggtgaatatgtttaatttggctaacagtctgtattcctcaatattctagttattcttgtttctcaatactgcatatcatactactatgaatgtttttgcatagaaattttttctatattcttcttaggatagattcttagaaacatttttaagtctcttgaaatgtagagaactttccaaaagatttgcaccaattttcattcccaccactcactgtaaatattatattgtatatttgaatgcatataggcaaagcaatatgcttttttcatgcttccacagaaaaaatacatttaaacgtattttatttttgcttcaaataatgacttttgtttcacttaatttaattgacttttgttactgaaatacttaactttccctaaatatcagctctgtagtacatagaatgttagcatgacattcatattctgccctgctcagaactttagtacagtttgcagtttcttaagaagatatacatttacattgatatatatttctttttttttctttttttgagatggagtctcactcggtcacacaggctggagtgcagtggcgcgatctccgcttactgcaacctctgcctcatggggtcaagcgattctc

SEQ ID NO: 89059 - DNA, 1054 bp, Homo sapiens
cggttcaagcaattctgcctcagtctcccaagtagctaggattacaaatcccagtgactctgttttgtttacctagtttaacatggccatttttttttttaaataatgagtttggagcaagggagtctgaagtaatttatttatttgcttgttttttaaattgaacatcttcaaaggccagagaaagagccctttgtcttatcccctcacttattttaacccaacttagtataatttgtgtctgtggtttccatatttaaatttattcttttttataaattttctttttccttttgacctatttatttgtgcatgatatttaaacttagattctaggtttataccctaagttttgtgaacgcaagagaaaacaacattttccttttgccaaaaataaataaataaagcttttattacaagggaacggtaaactcatggtgactagttaccatttctaattggtgcattaatgagtaaagtgtagaattcagagatttatgtcagccatctcttcagcgatccatctagaaggctcagaaaagctaaatgctcctgttactttattctcttctcccctgagggaagggtgtcttctgatttatatattgtgctaaagttgcagttttccaaatattaacattaaaatggggaaagtctctgattttacttcttcagagactgcatagtaagctttttggatagagtagtattggaagaacacatactggagttttgaaaaatggaaatggtgtaaggaaagttaatgtgctcaatgtttctctccctcttcctctagattagctctgctctggtatcatactgtagtccgcccgttttttgccttggatggcagtgataacaaggcaggcctggatgaagctaaggaaattctccttaaaaaagaagctgcttatccaaattcttccctctttatgtttttcaagggacggatacaacgactagaggtactgtaccttcctcatctttttaaaataaagcctccgatgatcaaatctctgattctcacttgaggactggtattaaaacgagccag

SEQ ID NO: 89060 - DNA, 1059 bp, Homo sapiens
tttcagctttaacaatctgctttgtatgtgacatgtaaggatttggttttctgtaaatacatactttcacacacataccttatatggtgtgactagtaatgtaactaatttttaatattatttacctctaaaaaagtgttcagatattcaaataaatgaaagtcgttttctataaagttaatgaacatattctaacaaagttcctatgcaagcattttgagaactgttttttttttgtttttttttgagacagagtcttgctctgtcacccaggctggagtacagtggtgcaatcttggctcactgcaacctccgcctcccgggttcaagtgattctcctgtctcagcctcccgagtagctgggattacaggtgtgcaccaccatgcctggctgatttttgtattattagtagagatggggtttcaccatgttggctaggctggtctcaagctcctgacctttattttgaaacagtctcctgagcttgagcccatacgttgtgaatatcctgcatgctgacattttaaagccttaggtttggtttttggaaatcgaaatctgggcctagcacaggactggccctcaatgtatgttggctgaatgaatagatgaagctactggtagaaaaatctattgctgtatgtcatttcttttttcagaaatgatgttggttatcaaggactatttacttttcttgtggcacctaaatgtgtttctgaagtcagttccaaagaagaagttgtaaaaatgtcttgataattgaaataagaagatgatctcctaagaaggggaccaaatcagctatttaaattccagtatgctggctaaacaatcagtttcatttcttgagagtcacatttttatttcaaagatgggattataaagaactgaattaaatttaattgaagtaaaaaagtaaatacattaaatgaactttatctgttatatttgtattggtgtatatttgtcacatacacatacatgcaaatagatgttaacatacacacagacataggtaaaaatcatgttggtgtcttcacctcatctgcagctcttgg

SEQ ID NO: 89061 - DNA, 1051 bp, Homo sapiens
aaattgaaccagaaggggaatcaacagctgaataaggtttgatgaagccaggtaagaaaatcaggtatttccattacaaattgcatttcaggtgacatctgtatttcaggtagccatctctgtcggctccctgcagattggtcagtctttattttcaatagactttttttaaatgccaaagccatttaaagactttgttgtatttgagattctactactatgagaggagtgattttaaagtgatgtccccaaagcctggcctcagagtttggtcatctagcacttttgcgttattcttttggacatattatgtagtcaacaacagtatagcctgttgtcaggtacaaaatatattcatgtgatctgaatatgctgattgcaaaactgtaattagagggtgttggtttgaaattttcctcttgtgaatctaaaaattaaactacagcaatgcatttacataggctatggcattttaaaaagtgaaaaaatggtggtgtgtttgactgctttcacactgagtcaggagagctctgtaaccaggtttggggtgctgggccatgcgtttgtgttctgcctgggagcttcctgcagctgaaggagcagtttcatagctagatggagaggggaaaggtcaggggagccgggaggtatcagcagcagaaaggacggcccggcacttgcggcacttgaacagcaatagatgcagttcacgtaattggcttcctttgatcagctccctcttcctggcaagtgccaaaatcaagctgctttcttggctgttgaactatcaccatgttttcctatgacatagacatgatgtgaccttcatctccatctaattatggcatttggtctgctcaccttcctgccttatggataattgcaggggcccttctctttttagggacagaagggacgtgcatgagccaaccccccattccttttgcaaaaactctttcaatcctgactcttaactgagccagagtgattcaaaaagtgttagcaaagcaggtgtttagaaaagatcacattttgtctggcagtgtgacag

SEQ ID NO: 89062 - DNA, 1251 bp, Homo sapiens
aatggactaggtattcaaaggtgactgagttcattagtttcatgtatcgggcatcaaatccttggcatgagtcattgtggtacagtgcacctgctgtgcatttattagtaactggtgtttaggaagttggagacagtaaccccaggaagttagagtataccccaacttattatctcaaattgtttttaaatatctaaatctccaggtcaagaaatcaaaatgcttaaaacgcgcgtgtgttaaggcctaaatattatggtaggaaagtgtacctaccagttttcagtttctgctttgcgacgtttgtgagcagtagtcacggttacctccccagcaataccgtaacttccaaagggagcacatttgtcaccagatcctgaactttttttagctacatcttctactgggaaagcaacagaaaggaaaacagggctttttggcctggggacatcttgtccacttggaggattagcattctggggacttagggtatgtttctggtatttctcatctgcaggaacagcaatgggcacttgcattgcaacatatctcaagacatctgactgtgaaacgacagcatgtccaggaagaggtttccatccctgtgcttcctgaacatttgagcctactaagataaaaggtggggcactggtcttcttggtgtcgcccatcacataagttggaaaagtgacttttggtggatgctgctgaaactgtggatccttaggattaggtaaatagagggttgcttggggaaaaggcccaggtgcaggtggcggtgatgggtgaccttgttgattcttatcagttagacaataaagggtccacatgttagaacatggtggtggttgtcctcgttcacttgttgccattgctataaaaaaaaattttgcaggaattaaagttttggtctctgtatcaggcactatgcatagtaatgtctttgtaagtctcttttacatataaaacagctgtagtgatatgtaccgtagagcatgctatagagagggctgcataatcgtgtttgacaggtgaaagagattctctacagttgaaaaaggagaacagtgttgtggtggcaagtggcagggacactacagttgtggctgaagaagcaatcttattctaagttgcagtttccagctacttcaactttagacgtggcttctataggctcctcgcagacgaaactggtcaacacaacctttagctttacccaaaagtcaattgaagagtgtgttaagccattaa

SEQ ID NO: 89063 - DNA, 1175 bp, Homo sapiens
gaagtggactgaatgtttatacagtgttgaccctgccacgtttgacgcttacaaaaaaaatgataagaaaaatacagaagagaagaagaacagcaaacaggtgaacatcctgtaaggtggtatcgaaggaataactggattcttcaatgtgtactaatccttttggaggtggcctgttctagggtcacagtttaactttcttcttccttgttgctaatgcatgtcacttttctctttttaatgatcagacatttgctttaacaagtactcggcatagccttgtataggatgtggacacctatcagttttttaactgtggagcagttatatgtggagctttgctttaattcacatagctttggaatgttggagttcatcttaatgaaacattttcttttcctcctgtttatgtgcattgaaagttgaaattgttgaagatttaaaatttcctccaaaagtctctctgacattttcatgcttatcatcagttttgttgccttgttccttatcgtgaaattaccgaagttaagatggtcgtagttaaaggagtcatccctgggctgctttcctcttactaaactttcttctttgtgggatagttaaatcccagtaggggaggcacatacgtggcttcttgtcgcgtggtcccaaacaggctccagtggttagcaaactcctgccccttccctcctggcataaatgctcgaggactgcacctctttggacaggaaatatttgaggacggattcctttccagtaaccaagacaatggttccgagcacaaactctgggttagaatcttagccccaccggtgatgagcagtacaagccgagatttctcatctctctgcctcactgcctccatttgtaacacgggcactataatagcacctacttgttaaatgagttaacaaacataatgggctcagaatagtatctgctcatagtaaagactgataaagtcatttctgccaaaagtacttcctcggactggcatcttgagcatcatctgcgagctcattagaaatgcaggcggcccagcttcacctcagacctaccgaagaccagtctctggggctctttagcgtttcttatgcatgtgaaagttcaggaagccctaagatccctcaaaagcagaaggtgtatttatgagtgactttctttgtagacggagt

SEQ ID NO: 89064 - DNA, 2446 bp, Homo sapiens
ggccgggcatggtggctcatgcctgtaatcccagcactttgggaggctgaggtgggttgatcacgaggtcaggagttcgaaaccaacctggccaacatgatgaaacccccgtctctactaaaaatacaaaaattagccaggtgtggtggtgcatgcctgtaatcccaattagtcgagaggctgagggaggagaagtgcttgaacctgggaggcaggggttgcagtgagccaagatcacgccactgctccagcctgagcgacagagcaagattttgtctcaacaacaacaacaaaagaattgtttactttgaaagggcaattatgtacatgtttaatgatagagttaattataatgttgcttttttttttctttttttttttttttaaatcttaagagatgaccttggatttagactcatctccgaacaggtcagccatcacccaccaatcagtgcatttcatgctgaaggattaaacaatgacttcatctttcatggctctatctatcccaaactgaaattctgggggaagagtgtagaagcagaacccaaaggaaccatcaccttggagctccttgagtgagttctgatcaagccattacactcttttcatgtagacctgcctgtaagtgtagacatgcacactcagctgaccttactgttcaaaagctggagaaaaagaaacagctttcatacagtgcaaactgtctacgtctatgtaaaagaatttgagaaacatggcagtagccattgctaattaatctgggtatgtgtaaatagtttaacttgatttttgactctggtgtttggatctattttaagatcgatggagttaattgcttcatgacagttcttatgaaacatgcttttttatatccttgtgccaatgttttgtttacagatctttcaaaatgaattcactctgagaaataatgaaatgacaattgtgtggcacatgttaggcgttagataaattgggagttctcttcttttgtaagattagctttaaatccacaattaattccagttaggagagaataagcatacgataccctatctctttaacactgattacaactagataccccggacagaagacaaagcaacaacccaaagactctgaaaagtagatagtagcaggcagactggggagagaaatcaaaacctgaacaccaatatggcagtgagtttactggttttatatatttctcccaaatctggctcagaatcagagcagcaaattgcagaactggggattagaggccgaccgaaaaagttctgagagtaattctttctttctaattaaaggacctagaaagatacccttgcaggaagtagagaataggggaaatcctgttttaattttgtctcacagccttgccccaaagcaagcactagggtctgtagctacactcctgctgcgatggtggctgtggcaatcacacacgtacctcagagtccttctctttggccagagaaactgagtaaaggaacccctggggttcaaagagtgtgagagaattcctgttacttgtttttctttcttttcttttacccctttgccccagaagaagacctagttgtgggagatacaagacagagcagagaggctcaaaccccagcttgccagccggaggggagagaaagcgccccctggtgtctaagagtgttggggaaaccacaaagaggagggagctcaagaaaggggtcccctgaagctgcattatgagttcctacgctcatccctacacacatgcattgaaatgacccagaagggtacacaagggcctcaggatctgaaatgctgtgtggcctgagagccaggtccctggatggctattgaggggtggatctgagcagcactacagaggctttgaaaattaaactgacactggaatgaaagctcacaggaggagagtcaggacttctggcctgaaactctgttaattgcctactaaaaaaaatttttatcagtattctccagaagaggttaagaggacagagtcttacaatattcaggtgtgcagaatacaatccaaaatcattcagcataccaagcaacaggaaaatctcaacaaactaaaatagaaaaagacattttagccaaaaaaaaaaaatagaagtatttttggaaattttagtactaaaaatatagtaatagaatataataactgggataggctcaatggcagaatgcaaatgtcaaaatatgtaaaggatgtgtatgttgaaaactacaagatactgttgaaagtaatcaagaattacctcagtaatgcagagacacactgtctcgatatatttggaagcctcaattatagttaagatgtcagttcacccctcactgatctataagcagtctgtatgagcacagtccaaatcaaaatcccaagatgatttttaatagatacagagaagttgattctaacttacgaattctaagtttg

SEQ ID NO: 89065 - DNA, 1038 bp, Homo sapiens
attaaaagtaactttggacttgagggttttttaaaagtccttgagagaatttgtagcactgttagagtgtgatgaaaaccatggttgggaataacactgtaggaagcaactgaaagtaattttcattctgaatatccaagtttccatgtcccactgctagagccatattaaaactccaaagtaatgaaactcctcaaaataattctgtaaattactgtcttcagcaaaatttcagttcctaaaagaatgcggagcgagctcggctatttttgacttgttctcatgctctgtcccacagtgtgtagctgcgtttgctgtatctgctgttgcttctcagtgggaacggactggaaaacctttcaacccactgctgggagagacttatgaattagtgcggtgaggcctttcacttgcatgctttatacagcgttgcagatgaagaggagaaatacatacatattggtcatcacgaataacaattatataggactggagcaagttaacaattttgatgtttgtttctaggatagctattattttagagactgtcaaaaatactgaaacatatataaaaggtaccattataagaaataattgcaaagatttttgtattcctgatcacatgggattaatcaccctccttttttccttatgtagatcatgagacatgatcgagttttgttttgttttttttttttactttaagttttagggtacatgtgcacaatgtgcaggttagttacatatctatacatgtgccatgttggtgtgctgcacccattaactcgtcatttaacctcaggtatatctcctaaaaataatcatttaaagtttattagctgggttgtggtggcacaggcctatagtcccagctacttgagaggctgaggcagcaggatctcttgagcccaggagctctgggctgtagtgcactatgctggccaggtgtctgcactaagtttggcatgaatatggtgacctcccaggagagggaggtcagaaatggacgcaggtcaaaactcctgtgctggtcagtgg

SEQ ID NO: 89066 - DNA, 1480 bp, Homo sapiens
gacagagtgagactccatctcaaaaaaaaaaagaaaaatagaagaaagagagcctgggacacttcaattaagacaagccttagcagtcacagtttttctgacttgtccccagtagtgaatctctgggtttaatgagctcttagagtgtatgtagttgagccttttatttctctatatacattcctgttttccctcatctccccagtgatgcagcagtaaatttaccatttcttttcatcaggctgagctgttacatgtctgttttctgcagtattttatggtaatgaatgagcttattttctttgattgcgctccagtttcagttctttgcaggttgcattatttttaattgaaaatctcagtgggaatatggatatttagggggaaaagtcagaggtaagtcaggtggcattcagcctgactacgcacctcaggactgttcacccgcccacgcaaccagccagcaggcctcatgaaagacctgattcccaagggaatggtcgatagaagtttgggaagattgtcagaatattccggtaaataccaagataagtgtgttacttaatgaattttgtaaaggtctcaccagaatattgcttgctggtggcacatggtaaacagaattgaacagttgcagttgaggtcagaaacttcctaattgttaaattatttttgagagtcgcttgtgatggaggcattctggcagacagaatttaaaatctattctgtaaaatatgcagtagcctgctagtaccctagaccataatttatactagattggtgtgctcagataagctcggtgttgtcatatcatttcatttcatttcattgtcatttcaaaagctgtgaaatttcttttggaaaattactcacaaaaatggtatgtgtggttaatccttagcccgttgttacaagacaaatgtagacatattgaagttttaacacatatatttgaacagacagcaattcatgacttgaacagccccagacctgaagctgttccacactccactgagaaggcagcacactccactgagaaggcaggaaggggagcttttacttttataaggtgttctttgagggagccagacaaagaaagtgcattcatttggggaaagtgtaacattcctagatagaggttagtttggcagtttctgattggtgaggcttaagttaacaggggagagggtttcagcggtttgcttatgaaggaactcaaggcactggagccatctccagtaattaatggccctgcagttaattattttaacaccactatgaagaattttgttctgtctccattgcctttgtctcccatttcctaattctgatgtaaggcagactgatgaagagtcatctgctcatgctcaccagcaggtagtgagctccctggagccaaggagaatgtttgggcagtctttgtatttcctccttcaaggcctagaaggatatactccatggtattaggtgctctggaaag

SEQ ID NO: 89067 - DNA, 1068 bp, Homo sapiens
tgtttcacatgtagattatgataataacatatgtagccttcccaggtaggtagatttggtttagcaaatcataccgtaaacagaatcacatgaccaatgttagacttgggataagttatctgtaatgcaggtggtgaatgaaatatctgtaatacacaaagagctcctacgtagtgagaagataatttagtggacagatgatgtcaccactgacaatgagtgtttttatcttagtatgtttgtactttataaaaataacaatttaaaaaattcttaaaaactgacatgtaggtaagaagttgaaccttcatttctgagaagccttaattgtcctaggcattttccttagtgcagatctagctgccagcagaaggagaattgtacagctgtgtagcttcgacttgcaagatttgccccaggttacgcagctgggtggtagcaagagtttgcactgtagctctggtttccattccacggttcttttatagcctccatgaaagagatgacacctccccgacctcctgccaagtataaggatgtctcagtaaatatatgcatgcacacacacaagacccagaagagctcatgtgtgtctcatgaaaatcaggaggcaaacctggaaagcatgaaacgcctggcagccaattccagatgaagcttaattttgcctacctttgtgttatcatcttgttctttttttcagagggcctctatgagcaaacagtgttgagtgtctagcctagcaatccacagagcagatgcaggaggtgggctcagtgtccagcgggtagataaaggagatctgtgcagttaggtaaatttgtgaggctcagcttccaaataacatacaatttctttcttttttttttttaatggactcttggtctgttgcccaggtgggagtgcagtggcacagcctcagctcactgcaacctctgcctcctgggttcaagtgattctcctgcctcagcctcccgagtagctgggactgcaggcatgtgccaccacgctcagctaatttttgtatttttagtagagacggggtttcaccatgttggccaggctggt

SEQ ID NO: 89068 - DNA, 1052 bp, Homo sapiens
tcaatctctacttcatgttgaaggttttctacctaccaggcactgggctgaatgttttatatcactgaccaatttccatatttaaaataaaattaaatttgaccacataatgcacacatatggggtgaatgtgtattgttgggacagaattttcattaacaatacctacccttgccagatgagtttgatttcattttttaaaatgctggttatattaccattaaattgagtctatagatcagaatgaatggggcctaaagttttaaaaacactctctgtatgcattgtttcatgggaactccaccacggccatatgaaacactagtattgtcattttctaagaaaaaccgaggtttggaataggttagttacatgttcaagttcacacagtcagtaagtggcagagttctgaaagccaggagtgacggctgtggagttaaagaatccattctactaattcaatatatgaccatggacaagttatttaataccagtgcttaataagattactttgaggattaaatgaggtgatacacattaagtgattaacacagtctaaactggagcaaactctcactaaatgctagccattagtattcatccacttcatcttagtagaactctttaaagctagcctggggatattttgatttcacagcatttgtgaaagtgttgcttttttaaaaacgcctgaactttttctgtcttccctgaaacatacaaatcaatgatcaagggtcttttgaaccgagatagaagctggaatgaagctaaataaaaatatagactattaagattcctggaattgcgagtaagagaagtgttggagagagagctcctctgtcttaggagaaagggaatagggccactgcacagaccctgtttgtgaaaggcatagagggcacgagaatcttagtctcaagtggccccagatgagcaaacaaggacataccccttaaagagacctagctatctttatgtagagttatggacttgagagagaagaaatatatatatatcatttagagaatgggaacatcatgtttaaaaaa

SEQ ID NO: 89069 - DNA, 2428 bp, Homo sapiens
ttttgagatggagtctcactccatcacccaggctggagtgcagtagcacaattttagctcactactcacgattttggcaacctccacctcccagattcaagtgattctcctgcctcagcctcccaagtagttgggattacaggcccccaccaccacgcctggctaatttttgtatttttagtagagacggggtttcaacatgttggccaggctggtcttgaactcctgacctcatgatccacctgcctcggcctcccaaagtgctaggattacaggcgtgagccactgcacctggccctggggtcttcagtaatttttaagagtttaattgatcttaagaccaaaagtttgagaaatgctaatctatagcaacaagttacattacattatagtttctttttgtttgtttcgtggttgcagtataatttttatatagtgaaagtaacagatcttacatataaatttggtgagttttgtcaggtgcatggacccatgtaactaacatcccattcaagatgtggaacatttccatcactccaggatgttctccctgactcctttcagtcgatcccccactctccgtagacagccactgctctgatttctgccactatggattagtcttatcttgaactgcattataaatgaatcacagtgcgtgtgctccttgaatgtggcgttagtcactcaacaccgtgtcttgacttccattcctattgtatatatcgttgctctttcctttttattggtgaatgctctgttagtttgaatatcccacagtttggcttatctgtactcctgttgatggaatttgttttttttccagtttggagttatgaacaaaaaagcttttataaatgttcttctagataccattctgcagacatgtttcattctcttcactatgtaggagtagaacttttgggtcatcggggagatgtgtgtttagctttgtaagatgttactgtactgtttcctgaatatgtaccattttgcactgcagtctgaaatacgtaagaattttagttgctccacatcctcaccaacatttgatgttttgtaggtatgacatggtaccttgttctgtggttttaatttatattttcttattgattttgaatgcttttgcatgttttccttagccattgtttttgtgacgtgtctgggagttttgcccattttaaatttgtttgtatgtctttgtattattgatttgtagtaattctttatgtattctggatactaatcctctatcaaatacacgtatcatgagtattttctcttagttggtagcttgccctttcatttctttaataatgaacagaagtctttaatttcttctttgtttgaacagagtctttaattttaatgaagtccactttgtaatttttctattatgttagtgctctcttgggggttctaagtaattgttgcctaccccaaactttcagccactgccctggtgctctctggtgtatcaccagtggtgtgttcttgaagttaacttggtcagtgtcttttgaagagaatgacagaagaatgaaaggtatttagagcacatcagaaattcagtgatgcaacattttaattcctcagagtaaacaatggccttttgttgttgatactatggaataattgtttctcattgtaaatgtgcgcgggacagtttactcattctagatccctaattaatagaaaatcatctggcataaagttgatctcagcaatgtgtgctaagtacctatattacaggttctatgccattcactgcaggttcaacagggcttggaatctaatggtaataagagtttaattaagtaagtaaatctgccacagcaactttacatgttcttaagaaattggtggtaggtgagtaacagtgtttgtaggaacttttagcctttcaaatggagagaatgtgttgcattctctgtggttccttatgccccaaccaggacaaagaaggagtagagagatgagtgttaaatttctaacaatggaatttggtacttttcaaatgacttgtaagtcagaatgtatttatccagtggtgagattgctaggcttttctgctcatcatttgttttcaaccattgtttaaagaatagacttgtgagctgtatcccagatgaactatgtaaagatttttttcaagcaagattatgcatcatttgtgaaaatgaagtgagactttttaattactacagtaatttactctctaacataattttaaaatctaattacttttgtgaattcaagtttattttatagtttagctctaatgacttcctaatttggaagactattttgctttgagtgtttagtaaacttcagcagagcaatagaaattaaagatacaagctgtgtcattaaattatatttaaattgggacttgtaggcagggcgcggtggttcatgcctgtaatcc

SEQ ID NO: 89070 - DNA, 1023 bp, Homo sapiens
ttgtctgagacttgtactgacctgcttctaagacgctacgctaattttagttggagaggtctaacagcaggttaaatacccagctgttgagtcaccctcgtctctgactaagttgtaagatatggtgctcatttatactaggcttcagaatggcattctggatatacagagagaactttgtgatgactgtatttgtctgaattcgaacctgaaactaggtacagggtacattataataacagtcatgcaggaagagttttaagtgattggcttctttaagaccagcctaaattctgcttctgttgaaatggggatgggcaaatttcaggaatttaattgtatcggtaaattttagacactttgtgttgatttctgtatattaaacttgccaagtatttcatatataactttgaagatcttgaatcttcatgtacattacaactaaagttttaattaatagtacacaactgagaaaaatagtatttttatgaccgtggaatacatcttatcacctttggagggcaaacattttcccttgtttgagggcatcattttcattgtgataaaatcaaattatatcaacttaaggtgagattctgtgagttgtgtgactaaaaaccagtatttactctcagatttaaatgttaagagaatatgaaaaatcatatcgaacttttaggcagtcaggtgaactactaaagatgagtatgttggttgaaatttttgaattctgtcttattaaaataaggttatatttgtttcagactatcttatttatttcaaatatttttaagcccacttagtggaagtgccagagttttaaagtttttgaaggccgggcgtggtgtctcacacccgtaatcccagctctttgggaggctgaggcgggtggatcacgaggtcaggagatcgagaccatcctggccaacattctactaaaattaaaaaaaaaaaaattagccaggtgtggtggtgtgcgcctttagtcctagctactcaggaggctgaggcaggggaatcgct

SEQ ID NO: 89071 - DNA, 1056 bp, Homo sapiens
gtcagagaaccctggagatattatgtgttatgtatcacagagcaggaaggaaccagaaactcaactcccttcctagaaattctatccctctgatggtaagcaatcaaaagcatctcagatcatttataaacagagttaaatcaggctgtggaagtagctaaagcaaagcacaaacaaattgttatatttattctgaaaaagtaggtgtggtttgaagggaagttagtctggaaagttcagagccatgaaaagcaacacagtcatatttgcagaagggcacttctgttattcagtccatctctgcttcgttttttgtcttctcttgttgtgaagtattttttgcacagttttccccaaacccttgttttggtgatcagaaatccttgtctgcagtgttccagataacatacagcctattaaaaacagccttgctccagagttacattcaacgatcaacaatttttatcaagagttcaaacctacattctagtagagaactccaggtctcaccaaacagcctactgctaccatcagcctcctaatccaactggaggtgttcaagttctgagacatgacctttctcgatagagagcccaagagatttctatgatagtcaagaagggcttctttcccctccccaaccaacaaaattaccagtaataagacagctttggatcctttttggaatgtggagagatgttagtagatgtgtgctcaccaccttgaagcctctctgctccttagagagctccacactgcaggagacctagttaatcctttagggatgacggtagttagctctgatctgtgcagcattcaccatgcattgcattaatctctctgttgttcagaccgtttcctttaggtcctaacgaccgtgatctactctcacttttcacttaatttcaatgactttacatccgtctgttccagcacctgttgtatgaaatctaagttattcttagagataaaggtgagcaaagaatagtgaccttgtccctaggttaaggtctgccttcctgtttcatctttccttccccaggactgtgctgaact

SEQ ID NO: 89072 - DNA, 1050 bp, Homo sapiens
caggtgtgagccactgcgcttggccagtttttcattttattgagaatacaaaggcgtgtctggtctctacaaagctggttgtaaagttacattgtcaaatgtaaacaagaggtgacgagaggctgtaagctctgttatttgtacctgggtcccttgatactactttccccattcagaggtctcgttattttctccttttgatccctggactttttcaatatcttaggtaaatatccaatttctatttcaagtttactttacaaacacttataatccccaggatgtcaacagaaagaagcagttaaatatttattaaaacgtatattcttgcttggcatctcgatctatttatccaaagatgtaccctcttcccccaaccctcccattcccaacacacgtgaacacaagattttgagtgcctaggaaatatctttcacagtaacagccttttaatggtctgccttaacctgtttcttctgcccacatcttctaataaatcatagattgggtatcttgacttctggtgacttaagggatttggtctctacaaatacactgaagtgtctgttttcctttggagctgtgccaatctaaattttgcctaaaggagaaaatcgcctcaggggacacggagttctttggccttatttgctttgcttggtagcttaggaggaattttcctttttcagaaaacaccatatataataataaaaaaattgcaaggtaaataaattaaggaagtgattgttttaaaaaccacatagatccttaacaggttggttggttggttggtttgccttgtgttttagaatcctcagaaaaatttggtttatacacagctcttttcaaaacacattgattgcataaaatgtgatatgttctcattgtctgggctatgacctgctgttgtatcatgttgatacagcacagtgttcagccaggatttgaaatttagcataaagtatccattttaccatagtaaatttcagatctgattgtgtgttttaggacattgtgtaatctttctcagcagaaaaaaaacctgcttta

SEQ ID NO: 89073 - DNA, 1037 bp, Homo sapiens
gtggctcatgcttgtaatactagtactttgggaggctgaggcgggtggatcacttgaggccaggagttcaagaccagcctggccaatgtggcgaaaccccgtttctactacaaacacaaaaattagctgagcgtggtggcacacgcctgtagtcccagctgcttaggaggctgaggttgcagtgagccaagatcatggcattatacaccagcctgggtgacaaagcgagactctgtctcaaaaaaaaaaaccaaaacaaaacaaaatctcacttcctaaagatacgggatagatgatctgggctcagacgtcattagatcagggaatagagttagcagcaagtcaccccacccagagatcctctggtgccctgggtagaaaaatactctgtctatcaggaaatatttggggtaattcctcatcatgtagtgaccaggagcacttaagctacacctttgattttcagagaacccaggagcagtgagcagtaaggaaaagagcaagagccctgcccagaatgagccagatttgtggtgagggctgggggctggagggaacagtggttccccaagacaatgggagcctgtgctctccttttatctcccggctccctgcctagagtacttgtcctggaaagtagagggttgcaataaaaagaatgagtagcatcactagaagcacaagcagctctgctgtgaagcccacctctttcacaagctggacacaagcctatctcaactctcccaagcgagaaaagagaactagggaccaaggagcaggcaatgagaagctttcagaggaatagtaaaggaagaagatgcttggtattctaaaaggcatgtaggtcagacgagggcaccactgtgctgtggtgtaggcggactgttggcagtcctgccacggcaggtgtctgtcatcagaggccagtggagattggacacctggaacagattggcaagttgaatggcagcagctgaagcagaggactaaaagccagcaggccactcattacgtgtgacatccatctctcccacaaa

SEQ ID NO: 89074 - DNA, 2453 bp, Homo sapiens
ttttaaaaattaaaatttttttggaagttatacttaagatgctttgtgagggaagaaagaggtggaaattttgggggcaaccactgaatatgatttcgtaaagaactgagtaatctttggagatgtcttttactatgtgagatctgtttacttgtaagcttatgtaagtgtacctctgtttgataaatccacttcagccttatattaggtgcaggttctgtgaaatccctgaggaggtagttaacagatggattgttgagggacaaagtaggctgcttaggtttcaaagcctgaggcatgaagggagggatccattgttacggaagcctcacacccaagttcaattcattaactatgaacctgctctgccacagattccgagtccgaaaggtccctgagtagattggaagcagtgacagcacgctcctttgaagaggaaggagagcatttgggcagtagaaaacacagaatgtccgaagaaaaagactgtggtggcggagatgctctctccaatggcatcaagaaacacaggtaggatcgcctctgacagttgtcactgctgcgtttttacgataaagtacatttggattcataaagaaatatatgtcttgtcttcatttttccccgtgtaggggatttatattgctatatcacctcaaagaaagcatttaacttaagcactttttcctctgtccatttaagagaatcatctataattgtaggaacagagcacatgggcttagcaatcatgttcttagaggggcacataaatcctttagttggtgatttagaaaggttattcagaactacctgttaaaactgatcctatgtgccctttctcatcatacatcttttatgactctgccttccattgctattttagtttctggccatttgatcttctagttggttttattaagaatgagtggcaatgttgccagtctgttgatgcaatttagttaaatttaaacaaagacttttattaagacccaggacttgctgaacatacccattttatactgtctaataacattagtatgtttttatccccttaatggcttggtcctagagattgtcccgaattaatgagacgtaatagatacccacagttctctgatttcagcccaagtttagagagacagtggtgtatatgcatgctagtgttcatatagtaaaatattttataaaatgatcagtgaaggatgtattctgttgtcattataaaaattactttttgggtaaggagttattaatggtaattgctggaaaataattttttgtttaatatttgtaggttgtgtaactctaattccatttctgtactatgattctggccacaatggttttgactactgttctagaaaaaaaaagtgtgcatcacttctctggcttatgtgtattttccctttgttaacaaaaaatgtctcagtttgtatttatttttaaaagattagtgagttttaggtaaccaactagataaaaacagttttcttctgttgggttagaggttgtcctccaaacatgcttataattgcaaattatgtgtccagcagtgagtgtctttcccgattccctctgtagttactatcagtttctttggagtgcagtacaaaattctatttaagacatgaaatacttaacagtaaacttggcagacctaccaatctctaaagagaagacagtctttaactatttaacacatacaccatgccagtctgatgagaacacaggtgaaatctttggaaagttcaaagaagcatgcagatattcagtattattaatatcagaaaaagcattgtgcttagatgctgtcctctgctgtagctacaggggatttctttattgcttgtcaggactcagtagttctttcgtatgtgtgctataatcatgacagtagttattttgcatttgacagaattatattataccatattcatacattctgtgttctaaagtcaaacccagaatggtacaaatgtgaaagttaagatgagattaaactttcaaaaacaaatgcagtcaggacaggtcactaaggaagaatacaaagaaatgcaagcaggtgacctaaccagaaaagtgtaactgataaatgagatgcaacttactaaacctataaatgtagtatgacgttcttcagttgttcaaagtgaaagaggaaaacttaggaaattgtcagcagtgtaatatgtgggaatacgtaattcctatttttaaaaagtagctttcacaggagttttttaaaacccttttttcataaagttcttctctaatcaaatagatagagcatatgccacagataatttaaaagtttaattttagaataggaaacaagagtattcagtgctatcacatccctcttgcctgcaccctacattgcataataaataatctatgattataatagtttttatattgatatcaagaataatttgtattcatagtagtttggg

SEQ ID NO: 89075 - DNA, 1341 bp, Homo sapiens
ttgttttctttgtagagttaatgcataatgtgaccttcctaaaaataatgttgagaaacaagacaaattgggaagctctggatttggtagcccaaaatagatccacgtaagatttccagtagcccacacactacggtttgtataactcctcatgttccattacatgtgcagatgttacaaattgtagaaaacagtagtagatttagttgcttggggatgagccggtacttttaagaaactctgtcacaagcaataccctaccatttggctaattttgaccttggacatcattcagagaggatctgtctagaatgtctccgactcttgttgcttgctgccaagaatctgtttcaagcttttgtcacttccttagtaaattattgcagcagtctcttggcagccccctctggactcatcccggttttcagtttatgattcactttaaatatgttaggttgtgtttactttctttgtgttcttcatatttactgtgctatttctgagtttatgcagttgtacctcaaggctaaataaaaatttggcactgatattttaagctgtaccttgggttgctttggacattttcagaacatgcctggtacgtgggaaaccgtaaacaataaaggtattaaattaagcatgtgtgcgtttcctggctgttttctgttaccttcagtaacaggaggaagggtgacttggacattatccacagttcttccccatcttgctgctttgtgtactatttgttctcaggctggtttccaaaggtcaggataaaaaagtgcttatcaggataacttacaagaattgttggcatgtttatattgtgaactttatggcctcttctttcagccttttaatagtaggaaaaattaacaaatcaactcttggaaagttctctcactcaattacaaaaaggagcatagcggtcaggatcttaattctagagtaaagttaaagtcaccataagccggcaatagccattcattggcttccatgctattttgatgagaaaggagactgtgttcaatctgaatgtgtttaaaataattctgagttctaacatggacagaactttaaagatcttaaagcaggtgcagtggcttacacctgtaatcctagcactttgaggccaaagtgggtggatcacttgaggtccggagttcaagaccagcctggccaacatggtgaaaccccatctctactaaaatacaaaaatgctgggcgtggtggtgggcgcctgtaatcccagctactagggaggctgaggcaggagagttgcttgaatccaggaggcggaggttgcagtgaactgagatcacgccactgcactccagactg

SEQ ID NO: 89076 - DNA, 1016 bp, Homo sapiens
ctcagtaatattttaatagtcgtctcctccgggaggaagagagaaaaagaaccatagtccctagatcaggattggcaaatacatttcatctcaagtgccagttcagattgttttgccgtatctgctgctttgtggattgctgtgttgagaacgatcctgaggctcagtccaaacgcctaggctcatcagcacatcctgccatggctataggaagtggagcaagggtcaggtgccaagcatattctccttgccttgaatagcacacctgagttttgttacacttgcatgaacacagtagcccttctgtggctactcctatttcctactaaaaatcttggaataatttggcacagtgtagaaactgcattaaaatgaagagtcagatgccctgtcaagtgctgacttgctgttgacctagccacccaattcattgaaatcatcaaagccatcatatgggaatgacttcatcttccctctgtagtctctacacaccagcctctgtccccatttcctccttcactctattacaagggaacaaatggtcccccctcattaaggccatctcttcctcatttgttctggtacctgtctccttgtgacttctcaaggagacttttgtttagttattgcttccttcacctacactttcaatattgtataactaaatactaacttgaaattcctgtattagtctgctattgctactgcaatagatcaccacaaacttagtggcttagtagacaatgcaaatatattctgttacagttggtggtcagaagttccaacatcaaggtgtccacagggctgtgtttcttctaaaggctctagaagagactgttgccttgccttttctagcttctagggacctgcctgcattccctggctcaaggccccatcctccatctggaagtctctctctgactgcccgtgactctggccttgctccttcccttttataaagacctatggcattacgttggacctactcagatgatccagtataatctccccatctc

SEQ ID NO: 89077 - DNA, 1304 bp, Homo sapiens
ctactaaaaataccaaaattagccaggtgtggtggtgcacaactgtaatcccagctactcaggaggcagaggcatgagaatagcttgaacccaagaggcggaggtttcagagtcgagatcgcaccactgcactccagcttaggcgacaaaatgaggctccatctcaaaaaaaaaaaaaaaaaagagaaaaatgaaaaatagaatgtttgtagtcattaccaggcaacctgtttcccttcatttgatataccaactattaccaactattttgggagtaaactgagggattatattttatgctttgatgtagtttgctttttaatatttagaatttttttaaaatttttgttccaagacttgctgaaactgttttttttaactgtgtacttaatgttgagagagaaatattctttatgtttaaaaagaattgtatgatttctgaattgactgatgttcttatgccaggatcctgatcatttgagctgaatttatttgctagttctgaatctattttcattagctaagctgttgccagaaaaggccccatgggaagaacaaaattagtttaataattttgctcattcatccatgcacatgtgacacgactgttttcatttctgatattgcagttgaactggatcaaaagcaattaattttcacatcctctgagtacgtctgtgtctcctgtcactctgaagtcttttctgtatatctgttttcttctaggtgaggaattttaaattggaacaagagcaagaaaaaaacaaaatcttgtcagaagcactggagacgctggccactgaacatcatgaattagagcagtctctggtgaaaggctctccacccgccagcatccttagcgaggacgagttctatgatgcgctgtcaggtaactctgggatccttccctctgcattgttggtgatttagagtccaccacctaaatgagcaatgtccccttgagtccaccaccttagagcagaggtcacctagagtttcctggaataaacagatagcgatgtattggtatagctccccagattttttgtgtgtcatgttattaaggctggtgtctgaaagtgtggaatgaaattcatcacagtctctgcctatactgaagatgtattctaggctaggttagagtgctgttaaaactgcccacatttgatttgtcctttactgggtgaccatttcctagtgccaggcattagcacatattgtaaggagagacagacagacagtttctgtcttcaaagaggtctttatataaagaatacaggtaacgaagcgcaagtgcttggtga

SEQ ID NO: 89078 - DNA, 1027 bp, Homo sapiens
gaaaggatcattttggacattgctcaattttgtagtccttgtttattttttattttttatgtttttgagacagaatctcgcctgttgctcaggctggagtgcgacggcgtgatctcagctcactgcaacctccacctcagggttcaagcgattcttctgcctcagccttctgcagttgagattacagtctcctgccactgcgcctggcttattttgtattttcagtagagatggggtttcgctgtgttggccaggctggtctcgaagtcaagtgatctgcccgcctcatgtagtccttgtttatataatagagaaatgaagtgtttaacccatctgatggaagtaggacagctttttatttatttttttaagttgactctagccttagtatgcttatttcctcttctggagatacaatttagattataggaatatttgcaagtatttttcagattttctaaaaattgtaattacatgagtaatttgtttttcaatttttcatgtctcttctgatcttgattgcttaccatttattgcgatttttatttcattatcacagctgtaataataataatctgcctgctgtattgataaacactaaagtgcctgaggactggaacttgggtttaaccttgtttctgctataaacttaacatttcagtaaaactgtatcttaagctatgtctaagaccttagagtgttgtacctgatgtgcagctggcaggaactcagggccacagaacagagaagagccttcatccttgggggctgtggggaggagcatgggagagggagtgtcaagaggtaaaagggttagatttggcagtgagtaatgcaggatttgtgagaggggccacagttcccaaaacctcaagatggaaagtgtgacctagaggaggttttggatgtcactccatccagtgcttttcttttctttctttcttttttttttttaaccccctaactgaatcttttttgtttgtttgtttgtttgttttaattatacttaaagttctgggatatatat

SEQ ID NO: 89079 - DNA, 2260 bp, Homo sapiens
tttacctaggaccccccagaggactttggccgcgggtgacgaagcttgccaacaaactcgagttctgaccactgagatgggtgattctctggctagggctggtccaaatgctcctgtgtgtgtgggtgctgggtgagcccagcctggctttgctcgccactatgacaggggagcaatgagttcaatgtaatgtcccccagttggtgtactctgcaagtgcagatactctccatgctgtacagctgttgccaggggataggggagggttggtgttggtgattcaagactgtctgttggaccctcctcaatacctttttcagagatatgaaatcaggtgctgtgattgctcacctgatttttggttcttgtgatggtgcttttctgtgtgcagatacttgttacaatttggtgttcctgtgaggggtacaaaggatgtaagcttctattccgccatcttgctctgccaacattgttttttaatttacatgatgatacataaaacccttttgaaattttaaatacattataccataatctgaaaaaatttggaaatgacacatggacgtgcatagtacttttaggaatataatcctctaagtgcgacttctggattgtaaactgtacatggtaatggaaattttaaatttctgtggaagttcctcatatgagagttataaccagcattaagtagttcaactttgcagttgaagagcaaactgttgtgagacttgcatcaaattattttaaatgccagagccattaacaaagcattggagtaaatgtgtattgaatccactattggtagcataccgtgggagtgaacacgacttttgtttcagaagacgcgttcatcttatctgctttgtaaaagacatgtaaaaactaaaacgtatttgttaaattgtcatttgtgtatagtgctagtcttccattgattttatgggaagttatttttaaatcattctgacaaaaataagtgtcaaatattctgggtttatattgattcttccaagtatcattatcaccttgcttataaaatgccctatttatttaccaagtctttcttctgttcccccaagtatttaggggctctgtcctagatttggggttatctccaaattctaccctgatttaaatgtctgaaggtacagtttggaagtaatcgatctaacagattgttagcagaaagtgatgttgaacaagcttcattgaggccattctatttttagcatggtcagtacgtcaaaaaccagacaagttcttatcttctttcccatggaggagcttgagtgaagagatatgcagaggtcattctgagtggcatttccttttctttgcttgaaccaggttgaagaagatggcaatgcctgtaagaaaggggcatttttagtggtgccacaggccaatcacagtcagctataaccaatgggaaaatgtgttgggctgatcaagttagtgctcatgaggctttgtagggccttgagactcgtttcatttctaatctcaggatgaacttatgtataatgtcaagagactagaggcttcttacttcatcacctgttggaatcaattaggttgaggacatctttgtctgtttcttattctctgtattccttatatgctctgagatagcagaagcaattagaagaaaacttggttacacgtactcatctatctgaatctgtgcaccatactcactgcatttctcctgcaactaaggatggactgtctgagcctttagcaaaggccagctgtatactagtggattagatctcctccctttttgacaaagtcaagaacattattccagcaattctcccctctcacttctgcaaacataatcccatctcagttgaaccttttctatccatgtaaaagcaacccgggttgtcttccataatgaaaacttcattgaccccacaaccccttccagcaactgccctacctttctcctccttttttgagcagaaattatttttttaaaagaattttattctttttttagtttttaaaataacctctgtaaccagcgtcctcttgtaggctaggcgtgatgtggctctgcctgtaatcccagcactttgggaggccaaggtgggtggattgtttgagtcccgggagttcaagaccagccggggcaacatggcaaaaccctgtccctattaaaaaaaattacaaaaaaaattagccagccatggtgatgtgctcctgtagtcccagctccttgggaggctgaggtgggaggatcacttgagcccag

SEQ ID NO: 89080 - DNA, 1084 bp, Homo sapiens
attgaagtcagagcagtggttgcctgggtagggggtggagagaagggggacagtgaccgtgaaaggggcacatgggggagagtgaccgtgaaaggggcacatgagaacttgggggagagaggtaatggaaatgtcctgtatcttgatggtggtgctagttacatggcggcgtatatatttgtaaaagcttactgaatcatacacttaacataaaggtattgtatatgattcaaataaagtttatttaaacaattcattgctatggtgttacttctgttacatataactgtttctagttattttcatcagcaaaactatcaattgcagagcccctgaataacttctgaaaacaagatttgtttagattatgattaaacttccctacttttaaaaatgattatttacctctggtggcgtatctcaaaaaaaaaaactatttattttgaggatatgtaaaatatacaaatctgtggctagtgattatgtaagagcaagctatttttaggtcgaagctttgcaaccatgatgagacaggagtgtgcttaaattctcagattgggctcccataccagacatctgagaaagtcatatgttctgcagtatttaagaggaccttgcaaacattgttttgcatctgatgcattgccaatctgatgcaaaatttgatgatgcaattatcagttcctaagtaggcgtattttaaaatatttcgctaattatagaattatgagatatatatggaagatatacaggagtatacagaaagctattttagagcttatagagaagaatatgaaaaccaggtcccagcaaccaccagcaggattttggtgtgtcttagcttatacacatgagtgtgcaaacacaaatacaatgcatcttgctgtttaatatcttacatcattttcagtaatatcagagtgagtatttttctttgaaaaacacctattctttgaaaaaattttttattttttgagacaaagtcttgctctgtcgcccaggctggagtgcagtggcatgatcttggctcactgcagaggtctcagctcactgcagccttaacttccctgggtcagatgatcgt

SEQ ID NO: 89081 - DNA, 1389 bp, Homo sapiens
gcaggaagagcccctggggaaaaagcccgtggactgatgtgtttctcagttgaatattggtattaggtcaagaagggctggagtgggaggagtaagacagtgaaagacattattgtcctaaataaccttccaagttagtgatttttcgcatggctgtgctccggctgacattgagatgaacttaccatccgctcttcagaggccgctgaaattccaagaatacgagaagtgcatgagcggattaaggagagaaagggaaattctatttgtgttggggaatggggaggtggcttttaactttaatgttttgattaaggatttttgattactcacaggctttctttgtagcctaaaccagcggggaatcacgtttcctagcattcagagcatgtggctagttgttttgtgctttctgttgtgctggatttttctgggtttggagagagggtggtaaggagaggaagatgccagagaagagcttagtacagcttttctgagttattaaggctattaaaagtttcttaattttaattaggttcaaagactgaattaaggcattgcttagcaggaatctttttcgagagagaaaaatgcttgaaatgtgtgttggtggaatagtgtgtaggcaggaaaacggggtggggtggggggtgtctaaatacaaacttgctttccattttgaggacacaccgaagttaatctcctctccaaatcaaattttttagtccctaagctgatgtctttggcaaggtaactcaatttctgtttagtggatatttaatctgagcataactaccagggagctatttcagcctctgtcccagtgctacttttgccagactggagttttaaaggaacttgtatcagcctgaatatagttgctggactctagtctcccctctttaaaaaccctttaaaggttaaatttaggagattgtattgacagtgaaagtgacccgtataatttctttgcccccagttgtgagccctgcataatgggggggaagtaaaagagcctgttaggttttccatattaaagcaaaggtcttactgatactcagggtggtttataaatagtttgagcatgtttaaatattgtgcataactgagaaaataattatgcaacatcataatctaagctccatgtacaatttttgacatttatcatttacattctttataaaaaggttggctaaacttactacttctggcattcaaatatatgactgtttatcagctttctgagaattataagaaatattttaattcctctaaaaatagaaatttagaattgttattcagtccacattattcaacatatattcctaaaattttcagtttattttatatatagtccagagatatagctacaaattaattttggaagca

SEQ ID NO: 89082 - DNA, 1112 bp, Homo sapiens
tcattctctaattttcagggcctagggagagattctgtagcagggactcctctttccatacatgatttttccaagtacagtaacagttattattctgagtgaaaaaagtaaaagaaatgaactgacttttcaaagatgccatgaggctgggcgtggtggctcacgcctgtaatcccagcactttgggaggccagggcaggtggatcacttgatgccaggagttggagaccagcatgaccaacatagcaaaacccccgtctctactaaaaatacaaaaaattagctgggtttggtggtgcaggcctgtaatcccagctactcaggaagctggggcacgagaatcacttgaacccaggaggtggaggttgcagtgagctgagattgtgccactacactccagcctgggcgacagagcaagactctgtctccaaataaataaattaattaattaatacaataaaataacaatgaaaacaaagatgccatgaaacctcactgacattcattcccaattttcccagcatggcctggaatggtctttaacacattctaggtctgtagtgcaattacagctaccaccaacttcaatgggacttaaagtacctaggatcttgtgaaagaaatatttaattttgttcatttttactctgaactcactaaagtatgaggacagagttaaacactttagtaaggtgaaaggtttgaaacatgttgaaacaaaaagatttctttccctccatcagagtgttacagttaaccataaatttcattaacctgaacatcccacttaagtgtggtatttgggtggtgggttttcctgtcctctgaacctttgcccttcaagcctggctggaataattttacctaagtaggtttcacggtagtaggattaataccgttgttttccttgttgctcagtgtcccaactagggtataaacaataaatatgtgaagactgcctttcagtcttggttttggaaccgtaaacgcgaacgcttcagcgtgagccggagtaagtgacaggcaggactggagagaagattcctttgctttccagagtttcccaaggggcgggttggttaaaaaaaaaaaaaaagaaaaaagaaaaaaaa

SEQ ID NO: 89083 - DNA, 1119 bp, Homo sapiens
cctcctcattttgtgtactatcgagcttccttgatgttagtcataccaatttttccaaggtaagaactgcccatttaaagtcagtagaagctcacttatcaagtgttttatacatatttcatgttaaatctcctgactgctgaaaagctgtgacccaactgtatgactggaatgtcatacaggcacggtggctcatgcctgtaatcccagcactttgggaggctgaggtggtggatcacctgaggttaggagtttgagaccaatctgtccaacatggtgaaacctcgtctctactaaaaatacaaaaaattagccaggcgtggtggcaggcacttgtaatcccagctactcgggaggctgaggcaggagaatcgcttgaacccaggaggcagagattgcagtaagcgagattgcacccttgccctccagcctgagcaacggagtgagactccgtctcaagaaaaaaaaaaaaaaagagagtgggactaattttgtggtataatggaaagattcagaccctacattggaaccgtctgaagggttggaattctgtactgcttctttggactggacactggtatctttgaagagagatcatgtgttcatgtggacttacagctctacaaagtcatgatctcttccattcatttcatttcctttgctgtcgggcagtcctgtagtcattttgtgaccctgatatcttttgttccctaatgttcttcacagctcttttgggcctgcacccgtctctggccttctgtctctgtagtcccctcagatctccttccactctgagcagaattcctttgttaaacatgaggtagtcactgtatatggctccactccctaccactcttcactccagtttttatctgcatctgctcttatactttcctctagccttttgctggaggcatctgtctccttccattctgcttctctggggaccttgcttcaaaaaatagctcctgtctttggaattctctacccccttatttatagcttttgtctatctccctgcatccttttccaattccatttttgaaaatgtgatactttctgtttctacttcttaattttcagcaagtccaccgaaactgttcttgccagtatttcctt

SEQ ID NO: 89084 - DNA, 1064 bp, Homo sapiens
agacaatgctacttcctcccaaaacaaaataaatccactgttacacacataaaagctccaagatactatcagaaaagagaggctacaaatgttaattagttaagatcttacaataactgttaacttttattcagggcttactatgtgtctggtactatgctaagtattttgcttacattatcttatttaatcctcatgataaatttaagaggctaaaagaggtcaattagcctaaactttaggctaacactcttgcacatctaaataacctaaagaattaggttattttttaagcagatagtttaaaaattagaataggttgattgcttcagaaattaaacatgaaccaacataacacgttacttccaatctaatgttcagccttaaaaccatatatctctggaacaagaaagctatcgatacatccatcaggtaccacataagagacatgagtgaaatgcggttttacaaggtactaaatatttcatgaatcctatgacatcatattttattaatttcaaagatattctgaatgcaatcatcctgttcagatttatttagaacactaaatcatctgttatttaaataaacttacacatgaaatttgcaaaccaccaaaaatagaagtgctgaggagggatattttcaaacagtattaaaaaatcaaccatttgaaatgtttaatgaacaattatgttttcctgtgatagttaatataattctattaaaagacttttggtaagtttgttttaaatgatttttatttccatatttgtcttattctccaaataaattaatatgtagaattggtgctacatatagcaaacacagcatttaaaaatgtgtatatgctcgccatggaggctcgtgcctgtaatcccagcactttgggaggccgagtcgggcagatggcttgcatctaggagttcaggaccaacctgggcaacatacaaaggcccatttctttaaaaaaaaaaaaaaaaaaaaaatcaaaaattagctgggcatcatggtgcatgccagtagtcccagctacttgtgaggctgaggtgggaggatcactt

SEQ ID NO: 89085 - DNA, 1057 bp, Homo sapiens
cttaagattccttaaaatccgactcactgtatttatttttttctttatagaaatgcttccatcatttcttcagaaagttgaagttgtctcagaagcttctagagaaacttgtgtagctttgactgattgccttaatctcttcaccaaacaagaaggggtaggtagttcagaattgaatttgtaaaataattgtttggatgttgcatgcgtggttgtccatgaagtcattgctttcaaattgttcaaaggtaggaaaaaattagtattaacaaaggaaagcttcatttgtcacaaaaatttagaacttatttattattgattaagcaggatgaaataacttgtgttcatatcttttgaatttgttgatgtagccatatttaataagtatacttaaaattgatctactcaggattgttatgacacttcaataagagagatgtgaaaatattctagaaacagaaggtctttacattaaaaatacttttatttagaaaatagagtactatcatacttatctatgtaaactaagcccaatggattaaatattttttgtgttctttcccctcactctcttacccttcaacagtttgccatttgcttttctaaatatgagtaagggctgagcatggtggatcatgcctgtaattccagcattttgggaggctgaggcgggcagatcacctgaagtcaggagttcgaaaccagcctgtccaacatgctgaaaccccgtctctaccaaaaaatacaaaaattaggccaggcgtggtggctcacgcctataatcccagcgctttgggaggctaaggtgggcaatcacttgaggtcaggagttcgagaccagtctggccaacatgatgaaaccccatctctactaaaaatacaaaaattagccaggcgtggtggcgcacacctgcaatccagctacttgggaggctgaggcaagagaatcacttgagcctgggaggcagaggttgcagtaagccgatattgcaccactgcactccagcctgggtgatggagtagactctgtctcaaaaaaaaatcagccagagaatca

SEQ ID NO: 89086 - DNA, 1540 bp, Homo sapiens
ttctcttcctatgtccccctaccattatgctaaaataggccatagccatctttcccattgattaccacaacttcttggctggacacactgcctccacaatttttttttttttttttgagacagtcttgctctgtcacccaggctggagtgcaatggccgatctcggctcactgcaacctccgccttccaggtttaagtgattctcctgccccagcttcccaagtagctgggattacaggcgtgtgccaccatgcccagctaatttttgtatttttagtagagacagggtttcaccatgttggccaggctagtctcgaacttctgacctcaggtgatctgcctgccttggcctcccaaagtgctgggattacaggcgtgagccactgcacccagtcctgcctccactcttatattccttcatttacctccatggaatattccacagaatagttagatgcttctgaaacaccaattggaatggtcacagccttaacagaagcattcagtgccttagggtataatctaaactctaagttgactgactttatgacctgtgtgtctactcacttcagctgcttcctctcttaactattccttccttccttctacactctgtgcagcaacagtgaccttttctcatgcatttgggtcttagcgtatgttgtttccaaggtatgaaatcgctttttctcatcttttacatgtagtttccagaaactcctccttgacttctctaagactatgttcttatgtgttttcagatcaccctgcactttgtctaccatagcactagccactctttaatgtaatgcttcctgtttccatttctctctctgggcaggcccagcctcctcaggtgttagaagggacagaaagagcaagcaaaggtacaggccacaacagttgcccctattcaggcctgtcgtacagggcactggagagtgagcttctgtctttggtccaagctttctttcaggcagcaaggttgaagaatccaataggtgagacagtgtggctatgagactacgtgatttattgctcacttttacttctgccaaagtctattttattttattttattttattttattttattttattttatttttgagacagagtctctctctgttgcccaggctggagtgcagtggcacgatctcggctcactacaacctctgcctcctggttcaagcgattctcctgcctcagcctcccgggtagctgggattacaggcaagtaccacctcgcccagctaatttttgtatttttagtagagacagggtttcaccatgttggccaggttggtctggaactcctgatctcaggtgatctgcctgccttggcctcccaaagtgctgggattgcaggtgtgagccaccatgcctggcctacttctgccaaagtctagaagacaggcaagcatcataccctgaagctctctcaagcactcagaatggataaactctcttatgtcatccagttctgcaccttattctttgtggcacagacctttccaagactcctctcttgaccttggcc

SEQ ID NO: 89087 - DNA, 1033 bp, Homo sapiens
tgcctcccaggttcaagtgattctcctgcctcagcctcctgagtagctgggattacaggtgcacctgccaccatgcctggctaattttttaaattttattttaatttattttaattttttattttttagtagagacagggtttcaccacattggccaggctggtctcgaactcctgacctcaggtgatccacctgcctcagtctcccaaagtgctggaattacaggcaatctctcgtttttttttttccctgtcccccaagtccccttttgttactgcaaagatttttcactttgtttttggtattctgcagttttattctgtctctgggtttggattttgttgttctatagcttgcttgaaactctgttctttaattcaaggactcatttattatctttctttaagttagaaaagttcttagctattatctcttccaattttacttcatcattctttatattctctcctgccagaactcttaatagacatatgttgagccttctcgttctatcctcctacctcatttcttattccatttctttctgttgcattctgagtacttttcttagttctattttctagctttagtttctttctcaatttagtcagtttttctgcttaatcttttgactttctactttctaatcttagtgactgtattttataattctagaaattttagttggtggttttaaaaatttgttatttttccccatagtgacatgttcttttatattacatgcatttctaattttatctctaataacttcagacatatgaatttaaagcatttttttcagaatgtttttatacctcaagttgttgcacagctaagtcttttgtttcttctgctgaatgtccatcacaatggattgtaactttatggacagctcatcttcagtagagcttgtgggtttttttgtttgttgtgttttattttgtttttgtttttcctgcttcttgggtttggaggtgtccatatagagtagttttgtgtgtgtcgctgttgaggctgtaaaggtttctctgct

SEQ ID NO: 89088 - DNA, 1675 bp, Homo sapiens
ctgctaataaagacataccccagactgggtaatttataaaggaaagaggtttaattgattcacagttccacatggctggagaggcctcacaatcttggtggaaggtgaaggaggagcaaaggcatgtcttacatggcagcaggcaagagagcttttgcaggggaactcccctttataaaaccatcagatcctatgcggcttgttcactatcatgagaacagcacaggaaaagcccacccccatgattcaattacctcccaccgggttcctcccacaaaacatggggattattggagctataattcaaggtgagatttgggtgaggacacagccaaatcatatcagttcctgacataatatcaatggcatagaagtcaaaaatgagaaaccatgttggactctgcaaaatattaataagaattaactttcataaattgatttttagtttttcaaaatataactagtagcgactaagcaaatgggagaccatattatgttttattatattaataacctcttctttttagtatcttttagtatcagttaaaaagcactaagttgtttagaacagaagacatactttgtacacaacttaaaacagtatgtgtagattggatcttctccagctgacctgttatgtaccctttaaaacaagtaaatcgtcgatcaaggaaacttattaataactgttagatggaaatatgattcaagggaagataaatgtgattcatgtatttgaagatgatgctatagaaggtgtttcctgcctttaattataacttaggaaaactatcctgtttattacagattcatagtctgcaattgaagccattgcttacttttatgcctctagcttactttcatcataggaaggataaaacagtatcattgacttgcacataagcagagtattaaatatgtatagagcaagaatgatgattttctattcatcatgagtgatgcatttggttgcagtgcatgttttggtgcctctagataaactttttccctgcccctcaacctgtattcacaggctgtgtctggaaaaattatcaggcatatatggtgttttaaattgcatagtgtaggtattctccccctgctctccaccaagtgaatggtacgtaggtgttgttagagccctcaaaacaaaggagagtaatacaaattttgaagagaatattgcctgtcactaatgtgataacatgaataattctactgtggttgagttgaactttgtaagcactaaaaaatttataaggtgaaataggagaaaagagtatttacctatgccaccttgacatactgatctatagtaagtttgattttgggggtgcaaaatgttttgtgatgggctagctgagattaggagtacaaagtagggaagtttcataaggctaaatatattactctacctaaaagaatgtgattcgattgtttataaggtcaagattctcagaataaatattttctattttgataaccaagcaaatttacaataataattttcttgcttattcttcccacctctttaaagggaaatgatatataaaactgccttcaaaatgacatttttaatgtaataaatggatttgactgatctttcattttggatttctaaatctgcactaagatgggatgtaactttcatcaagaaattctatatttatgtttt

SEQ ID NO: 89089 - DNA, 1030 bp, Homo sapiens
gccttatccctagaggaatatcagcataggtaattgaaatgaaataggtgttttgaggggtcatcaattttctggctgtaccttttatttccatcttgtgtctaaaagaatgggaattgagttcggaagaattagaactatggaatgatgatgagtttcagtctgaataattacgtcaggatatatgaatttgcctactaaatttaatttttgtctttataaattaaatgagttggcggcaagatttgaatgtttctagttcaactttaatgaagttaaattccccaatacctatggagttttatcaacttagggacctttacattaaaatataaaaggtattttgactctttcaatccctaatcttaatttatgatggaacattaaagaatttgaactctcccatgtttgttgaagacattccccagaattgatgacaactcctttaccatactacctctggtttaaagcctaatgtgtatgtgagaaccataaacaaaattttcagatcagtgaactttgcaaaggtaacatctactacagcatttaagtaacattaaaactgggaaaatatggaagatttaaatacatatggccaaaattacattaaacaagtaaaaaaataaaacgatgctaaatattttaactttcagttggtattccctaattgaaaagaaatccttccctatttacctatcgtcaataagaggtaaatgataaaacctggaaggattgacaaagcatactaatatctttcctaggattatgataattttaaaagtttttaaatggaagttacaggtaaaataaaagcatactaacttacataccattaaaaatatttcttctttttttttttcttttcttttttttttttttttgagacggagtcttgctctgtcgcccaggctggagttcagtggcgcgatctcggctcactgcaagttccacctccagggttcacgccattcccctgcctcagcctgccgagtagctgggactacaggcgcctgccaccgcacctggctaa

SEQ ID NO: 89090 - DNA, 1061 bp, Homo sapiens
caccgtgactggcaagccacttttatactactggatttcaagaggcttccactggttgtagccattacttttctgtgtgttgatggtcccttttaggtgtttttttggtgttgatgagtcacttttaggtgactaagtttttatgaaaaggagtggggggaaaatacatttttttcttactagatcaaagaattacagtattatttttgttatgaacatcaaaccatggaagacttagaagaaaattaatatttgaattatcacatggtacatatataaaatttttccagtcctaacagtttctacattttggagaatcctgttttctagaattaaccttgaagagcacataatttcttttgcatttgcaagcaatcccttaatctatttatgtatctgtatgcttatattgtataagataaatttaggataattttcttttttagacattcattcatgactttgaggaaattgtctttgaagcccacaactggtatattttctgtaaataatccctgaacagttttgtcagaaccataaactgtaatcatcattgatcttatcagtatggcatttctgctgttcctgtcaccctgtagtggtatgttttcattactgcacttagtacctaagttcatgtttgatcatttttttttactgttcagtgctactgtctaaagactcaaatatgactgtcctcacttaattactttttatcagtcaagcatttgaatctagatgtgtcagcttgggaaatctttgttatttttcccttagagttcaagattttttggctggagattattctgggtagtgttagagcatggagtcctttcatggtataggaaacagtaagtattatgatctttacacttatcaaatttcactgtataaattttgaaatacgaatttttttcacttgtctcttttccttttgtcttgataatttcatttttattttgaaggcctgatgcagttcataatatttatcgccagggatgcaaacacctgactcaagcagtatgcacggtaggatgaaacatggatcatttgctcctcta

SEQ ID NO: 89091 - DNA, 1036 bp, Homo sapiens
aaacataataaataggaccctataaaggaataagtttttctagttttgatcagcagtagtttctgggaggaatgctacacttctggaaggtactatgcaaagaagggacagtattttggaatacttataccacattagactgaaaggtttgcctgttccccgccaccttagaagacctactttccagcttccattcctgcacagtctcattaaacatgaaactctaaatttgttctgaattcatgactgaagcactgccatttgctttaaagttatttcagctcatttgaaagggcctctttggtttctaagtatagcacctaaagcagtttttaaattttgtgaaatggaggctatataaagaagcttctaaagcaataagttgggaacaacaaattcagtagaaccttgacatttacacatttaacatttatggttttaactcttctgaaggactggcagactgatttgtaattctgctgtcacaagtatgaattgcaagcctggtaggggcatgtaaatcattgtgaaatcttagtgtctgaggtgtgtgagatggtgctggcacagtgcagagtgtctcttgtcagaggagtgtgagacccggacacaggcctgagatctatctcagggcatctgagaataagcatgggtgtggcagggttggctggtttagtgagcaagaaaccactaacagcctggatgccaaggagcttggctattcttcgggctctgctgatacaccctcctgtgaattatgagaggaaagtctatctttgatatataattctgcattgcatttttttaattgttagctcaacaggcccaatcctcctgatgttaactgttcggatcagttaggaaatacacccttgcattgtgcagcttaccgggcccataaacaatgtgccttaaagcttctaagaagtggagcagaccctaatctgaagaacaaaaatggtaagcatattggtgaaaaccatcgttggccattttgaaattataaaatgaagtcaatgccatataaaattgtttt

SEQ ID NO: 89092 - DNA, 1051 bp, Homo sapiens
agttttgaagtcaagatgtatctttaactttgttcttcttttaaatattattttggctttttggggtcccttgaaattccatgtgaattttaggatgggattttctgtttctgtaaaaatgtcgttagtatttgatagggattgcattgaatctgtagatagctttgggtagtattctcctcttaacaatattaagtctttccatccatgatcgctggatgttttcccatttatttatgtcattttacatttctttcagcagtgttttgtgctgagtcttttgtgtataagccttttgtcttcatggttaagtttattcctaagcattttattctttttgatgctactataaatagaattgtttttcttggtttccctttttggattgttcattgttgtctttgcccatttttaattgggttgtctttttattattgaggtgtaaatgttctttatatattctggatacaagtcaagagacttgtatttgtaaatttttttttctcattctgtgggttactctactttctttaattaatatgaactatttaggtaaagcatgaaaacatgagccccaaaatgttacctttaagatgatagaaaatgttaagatattttataagaattcactttattaaaatattaggatattttaaaaaaccattttcctgtttttttaatgtggtagtacattttatataataatactcaaatatgaaaaatgtgtaaacaccatgtactgtactgggaaatgtagctataaaacaattgtggcatgtaagtaaaatcatgttacgaaaactcaaattttgcctagggaaattgattagtaagaaatatgccaaaatgtttatagtggtcataaaatgatgagggtaataagtatatgtattttttgcctgtttatgttttttagattttatttaagcattttttgctatgaaaacattctaaaagaatgtaggaaatggacgtcatggcccaaaggaaagatgaaattcctaggacagcataacgtgtagcaacacaggatatcacttcatattttaca

SEQ ID NO: 89093 - DNA, 1094 bp, Homo sapiens
gggaggccaaggcgggaggattgcttgaggccaggagtccaaggtcagcctgggaaacatagcaagaccctgtctctacaaaaaatgaaaaaaaaaaaaaatagctaggcacagtggcatgtgcctgtagtagtcccagcactttgggaggctgaggttggaagatctcttgagccaggagcttgaggctgcagtgactatgatcatgccactacactccagcctgggcaacagagtgaaaccctgtctctacctaaaataaataaaaataaaaagtagaaatgactcgaatattcattagttatttaatagataaacatgtggtatagtcatgcaatggagtattattcagaaatcaagagaatgaagtactgatacacaccaaaacataaatgaaccttgagaacatgctaactgaaagaagccagacacaaaaagccacatattgtttgatttatttatagaaatgtccagagtaggcaaatccatagagactgaaagtagattagtggttactaggggattatgaggaggggaaataggcagtgattgttaacagatatggggtttctttttgtagtgatgaaatgttctgaaattagatagtgatgatgtacaactctatgaatatactcaaagccacagaattgtgcacttttagcagggtgaagtttatggtatgtgaattacacctcaataaagctgttatttaaaaaaaataatctgggcatgaggatttttctctaagcatttcatctgagatgacttgtgtgatggtgacagcaatataatggctcaataagggaatgactgactgctgagcggaaagtggagctggggcgatttgggagcgtgattcacggctgtgttaactttgttctttgccctcacccgtgtgctgctggtccaaacatactctgtgcagccattaaaaaataaaagtatcatgctcaaagtgaatactttactcctctgactttttagtagttagttgtcaaattggccaaagtgctgtcttagccaggaatattttcagtaaaacatctttattcaggaaaaagtattcaaaaacaaatagcattgctctaggggca

SEQ ID NO: 89094 - DNA, 1110 bp, Homo sapiens
tttctttaatggatatccagcaccacaaaatggttagttttgacaattttgtccagctttatgctcattttttcaggataacagttgtcttatcctttcatagctaaaagttgctttaccccatattaatgtttttttgattatttaaatgatatgcaaaattaactatgacatagagtgtatttcttgtatattctagttgttgaccatagtccaacatgatacctaaaggttatttcgtaagcacgtgattggaagctttatgtgaatttatcatgagttaaagaacaaatttattattatattgtttcacacttttcattattctaatgactagatttaactaacttttaatacgttaccatgagtcaattctgtatgtgctaagcatgtttgaattagtacattttataccactcttgtctatttgttcataaattgatacttgtgaaccagatatggagtcttaactcaagctgagaaaaaagaaccttttataataaacaataaaggttgtggttaatttctatgcttgactttgtggggtttcaaatatgagctgcagatggctcgatttgcctgactacgtgaactacttgctgtttttttttatggtcttgctcattcttttctatatacctaagaaaattctattgtcatctatttctacatggcccagatctacccattcaaagtgctactcaaatgtaatatccataaattctttcctaacatcttgcagctggaaggaaactatactcttccaggattcctgggcacagtacagcactttcattcgtcttctaccttgtattagtgttatttttgtctatgtctttttttttttttttttttttttgagatggagtctcccattgtcacccaggctggagtgcagtggcacgatctcacttcactgcaatctccgcctctcgggttcaagtgattctcctgcctcagcctcctgagtagctggaattacaggcatgtgccaccatagtgtgtatttttagtagagacagggtttcaccatgttggttggccaggctggtctcaaactcctgacctcaagtgctctcaatcccaaagtgctggggttataggagggag

SEQ ID NO: 89095 - DNA, 1054 bp, Homo sapiens
ccattcctggcctgaagttttcaacatagagatcttgcagtccttttcttaaatgtattaaccagcctggctttaatctgtggaatctggactgagtctggccagctaatatatctgctgagttaaaaaaaaaaaattaaaaaaaaattgtttgtttgttttagagacaagtctcactatattgcctaggctggacttgaactcctgagctcaagtgatcttcctacctcagcctcttgagtagctgggactgtaggcatgcacaactgtgcctggctttcagcatagtattttaggattcatgcctgcatctgtgtagcctagtggtgagcctgtatttgagcagcagtgggctccattactcaatccccttaggcttctgtgctctgccctggatctatgtgtaggctggagagtgctttcagagtccaggcatttctcgcttcttcctctgctctgacttttgcaaggccccctctcctttctcctgcaaatgtgtggagtttcccagcagcctggggtacctgggaagctcacctactcctactccagttcttttgttttcagggttgtctcattaagttttaggctgttttgccatttgcctgtgtggtaggcagaatcatggccctccaaagacatccacatcctaatcccccaaaacttgtaaatatgttagattacacagcaaggggaagttaaagttgcagatggagttgagattgctcatcagctaaccttaaggtaggaaaattattttggattatctcggtgggcccattgtaatcacaggtgtccttagaagtgtaagagaggctggacacagtggctcacgcctgtaatctcagcactttgggaggccaaggtggaaggatcacttgagcacgggagtttgagaccagcctgggcaacatagggagaatcccatctctaaaaaaaaaaaattgcctggtgtggtggtgtgcatctgtagtcccaactgctcgggaggctgaggttggaggatcacttgagccggggaggtcgaggctgaagtgagccatgatttcaccac

SEQ ID NO: 89096 - DNA, 1110 bp, Homo sapiens
cctttactgactcttgatgtggtacaggtgtacagagagttgctgtgagctgccttcagctcctccataccctcctgatacaggttttcaaagagagttgcttgtcgtgaactatgtcaataaaacccctcttgacctgatgatggcaagatgattaaagactcggagccctagagtcaagaagctgctagagatcatctagctcgaatgtaacccccgtcctgtctccctctatccctttagaggtgaagacatcgagtcagaaggtggcaccagatctgcaccttgtgagttctcgtcctttacacccattacacttcttggtcacatatcttgcctctcacttatcagcaatgcattgcaaaggagattattgaggtagcttgttatggagaagttaatttcgttgtaaaattacctaaatatgacctaaaaataccttatatttttccatttttaggaagaagtaagtctaacttgggctggacacctctacatctggcatgctattttggacacagacaagtggtccaggatctgttgaaggtctatttatgactttaatttttaatgactacagtaaatattattgttatggaaattttaagatgaaagtcttagaaaagccacctgagccataatgacttatttaaagcaatagttcatcattcaagacacttaattgttctttattaaataaatacatgaattaggttagcctgattaattaaaattgtatgtttaatcattagatttttttattactagcttttaaaaataataaaagtaggcatattaatgaagattttattttcagttctgagtgtgacagttgaaaaaataaccaaagcacaccctaaataattaaaaaataatgtcaatacacaaataaaaattaaaaagaaaaaacaatgtcacaatctcttagcactgtatttaaagagaattgagagctcatatttcttaattctatgatgaataacttctcacattctgatagttctgaaatttgcttgcatcttacaattcatctgtacatttaaataatggcatcttttttcctcaaaacttattaaattgataaaggaggaaatgtggtatttcattcag

SEQ ID NO: 89097 - DNA, 1079 bp, Homo sapiens
aaagtcatactttgactttatctctaattttgttttttccttttatgtctaatttttaatgtaataactatttgcataatactatgtatttgacagaatgctttcacatacataatcttacaacaaacagcttatgcggttggttgtattctgcagatgaggaaactaaggccttaagaagttaagagacttgcccaagtgtctcctgtactgcttcaataataataggaagggcaaggggtctcaggctcaagttctcaccctgcaacggatttattcagttgttgtgtctgtcttatcagctgcaaaatgaggattctttcccctttctgtattagcaggtgatatctaaaagctaattatgttcttaaataatagcaatgttattattttcttaatttagaaatgaacacagaagcggagcaacagcttctccatcacgccagaaatggcaatgctgaagaagtaagacaactattagagaccatggcgaggaatgaagtgattgctgacattaattgcaaaggtaaactttgaatggattttgtagctttctcttatgagtctgcactactcttagcatttatttaatgctaacctttcttatctatcatgtaattaatctctatctctcatgctaggaagaaccccacagattggaggaaatgtctctcctagccccctctgagtcagagaaagtgacataagaattttaaattcttaaaattgttatggatcccaaatattacaagccacaagggtggctctagcccacaggatacatcctattgagaggtgacagcgtgctggcagtcctcacagacctcgctcgctttcgggcctcctctgcctgggctcccactttggcggcacttgaggagcccttcagcccatcgctgcactgtgggagcccctttctgtgctggccaaggctggagccggctccctcggcttgcagggaggtgtggaaggagaggcgctagcgggaaccagggctgcgcgcggcgtttgcgggccggctggagttccgtgtgggcgtgggcgtgggcttggtgggccccgcactgggagcagccggc

SEQ ID NO: 89098 - DNA, 1062 bp, Homo sapiens
gaaatagttttaatgctattactaggaagataaactaggtcgctcactttacttttatttatcagcctgcaagtaggaaattactgtatagtgaaagcagtctttaactgtacaatttcgtatcatgtgacaatggaaagtaaccacatgtttttactttgtgtttaaagtttttctttaaagaggtatttctgtgatgcataaatggtcagtattattatacatgagtttaattgagtttgaaagataattttcaaatgtgaaataattgaaatgggaaaattttaatgcatttttctaaaatttagggaattttgtcattaaaaggtaacaatcagcctccttgctaggatttttattactaaacttgatttgttaaatttgtagggttctctgctcttcatacctgctctgttttgaaacagtagtaaatagttttcagaatctgtcaaattgaagttcaaatcaggggtgcatctaggaattagtgcttaattgttaaagcagctaaaattatagcaccaaagttattttaaacaacttcattaagcaaagctatgaagcttatttaatttttactaattttaagaaacattaaaatttccaaccgaatatgggtaagataaatacctggtgatatggttggttttttattatgtccgtatggtatccaagttggtgtgggtatggaatggatatgaataagagaaggtaatgtaaatttatcaaatataaagtaaataataatttggtataaacattttatgatttcaatgctttataaaccattagatgacacataattgtggccaattctccatcatttctcctgtgggagatgaatgctttttattagggcacaaaaacttattgaggaagttagagaaaaagtttcactgaattaaaaattaagtgattaaaattttgtcttataacttaaaacgatacaggttagtgcttcccaaaataggctttataatttgctcctgttttccttaaattgccatgttttaggtattcttttcagttaataaataaagctttttaaaatgaggcactcaa

SEQ ID NO: 89099 - DNA, 1038 bp, Homo sapiens
gaatggggcctttgacctgtattaggtgctgacaggtgactgagatatagatagcggtggttagtaggtatctggaaaagagatgtatttcagaagagtcagaagagcgaagaacaacatgagaccctgaagagatggctgttgaaaggaaaggaggtatccacaaggttgttggttacagattaaaatgggagagatgagaacaggaaagggggtagtaatggtgtattaggctctttctgggctcaaggaatagaaaaacactcaggttacatcagataaagagtaagaatttattgcaacaatacagagacataaaagcagagacatcacgctgctgcagaaggttgttgaagatttaactgcagcccaccattctggacctctcagcagggggcgccatcctttgctccctaccctagtgtttccgcactctggggtctcaatcattctctctctgctcttgcttctgccgctcctggtcatcttttctgtattctcctttaggctgtcccatggcttctgcttactctctgctctcacttccctctgtgagcctttctgcatctaccttgactaaggactgtcctttgcatgcgtcacggttaaacctacccaagagagaaatctagatggttcaatgctactcagtatagagatttcctgttgggcaaagcacatataccaggcctttggtaagcctaatagaaaggtgccatttaggaggccctgctcttgctccttcagctgagccaagaattgtaggttgcataatgaagtcctcaaaaaggggcaataggcagggcagactttccaaggcttcctagaaggggtcatgtgactgtcaggcacactgcttgagcagacaattagggatagaaaagcggaatatattcttttttgtttgtttgtttgtttgttttttgaggcagggtctctgtctcccaggctgaagtgcagtgatgtgatctcagttcactgcagcctccacctgccaggttcaagtgatcctcccacctcagcctcctcagtagctgg

SEQ ID NO: 89100 - DNA, 1042 bp, Homo sapiens
gttttgtttctaaaatattttgaggacatatttccctaagaaaaatatttcagaaccagataatattgtaagttaatattgttaaaagataaacacattaaaattgtcacgagtttgagaatgaagctattcatgaatcacgcagcaccagagctcaaacagttcaacactccactaaattggtgggagggagaaatttttctaaggtgtttgcagaagcaagataaagaaaatatttgatggcttaaactagaaagtccctagttagatgtcacttagtggtttctgattggttaagcttaagtttacactgagttctatttctgtttgcttactcagaaacacaaggcaatggaactgtcttagcctcatggcctcccaattaattattttaacaaaaccatatggacagaatttgcctgtgttacagtgtatcctagagcagtttgttctagtcttcttggagaggaagataccaaaatgaagttaaatatgcaagaaatgtgttaggggaaatgcctgtagaaaattgggaaggaacttgaagaggctcagagaaccatcacaccgatactaatctgatcctgagtgaatgttgagaaacaagtagaggaaagggccttcgctgtggctcacgcctgtaatcccagtactttgggaggctgaggcaggaggatcgcttgagcccaggagtttgagaccagcctgggcaacatagtgagacctccactctaaaacaaatcaaaaaattagcctggtgtggtagcgtgtgcctgtagtcccagctacttgggggtgctgaggtgggagaattaattaagccctggaaattgaggccacagcgagctatgattcccaccactgcactccagcccaggcgacagagatcctgtctctaagaaataaaaaataaaaagaagaagaagtagaggaaggttgtgcggcagtttttctaaggaaagttcagcaaggcgtggagcccaagcaccccatcagaggagtcctgtctcccaaaagtaggcccacctgagtaactgccata

SEQ ID NO: 89101 - DNA, 1030 bp, Homo sapiens
aaacagacaaacaaacacacaaaaactctccctaggaatgtaaagacgagtctgggactgtggactgaggtttgagtcccttcccgggacgcggtggtaaatgactccctaaagtctcctggccattccgatggcgccaaggccgcaatgggcaagcaaaagccccccgccccggcgcattcctaggagacagagccgtgagggcctctggctgcaactcgcgagggtcggctttccctgggtctccgccctacgggagacagtgaaggcgggagcaaggccccaaccgagaaccccaccccaaacccgggggccaggagccctttacacccttcggcccgccacccggaagcagatgccggcggcgcggcgtggcagggttgtggttccgggtcgggccgcgccgcagccagctctcggctcgcagccgcagcgccccgcccccgcgctccggacctggcaggcggcggctgcagggcaggtccaggggccacatggctgagggggacgcagggagcgaccagaggcaggtgaggccccggcggggtgctgtctctccaggctcggctccggctcgcctcgccatgccagtcctcctcagccgaggggccctccgcctggggccgccccgggttccgccagcactggccacgccatttgctccaccgcgttccattttcccggcgcttcccgtcggccgagcgctcttaggccggcggctcctcggcggccgcggtctcggcctgtctcggacggtgtcctcgtcaaccattaacacgcgactaagcagctctgggccgaaggcaaaaaccggggtttcgatccccaccctgccgccgccgagtcatcttggacaaatcacttaagaattcgggtttccccctttgcaaaatggcaatagcccagaccctgcaggtcccgagagcccaccgaatctcactccttctggtccttggcatcgagctttccctgtgccttgttcacgtgggcgatcataagtcttttcctacagggctgtgagtacaaaatg

SEQ ID NO: 89102 - DNA, 1978 bp, Homo sapiens
agcaaccacccacccatctagtccttgtgtaccccctccccacctccccccaacacaaaatttaatacgaaggaaccagtgagacacccagcaggagtacacagataatgtggggcagagctattgggggtgggagtcaggggtggagattacctgttaaaaaagagaaggtggaacagagaagataggtttatcttttcacgtgtgaatggtcactacaaagtatgggagtgcatatatattatattttgactcaatagtggccaaaagcacagtaatgcagtagcaaggctggctccagtcattgcagtagcgcctagcaaccacccagagagcagaacatggtgacctgctcttaagaaactcttggcctggtgaggctcatctaggaatttttgatctactctggtaatgttgaatttgaataccttataaagtagtaagaataggattttaagatgtgtacatttgttgacttttaaaaaatcaatttctttcagaatgaggaaattgaagcaatggcagccatttatggcgaggagtggtgtgtcattgatgactgtgccaaaatattttgtattagaattagcgacgatatagatgaccccaaatggacactttgcttgcaggtactttttcccccttccttgcagccatctttcagttacagtatgaactatattgttgacttctgtattctaatgattgtgttgttttctaaattatctttgttcttggcttttctcaatgattaaacacatgggcagttacatctcagatcactttcaaatcatacattaattgatagttccagtctttctaatccaatgcttttaatcatttaaaagtgttaatgtacccttgagagactgtagttttgcttcccttcattattctcttcatctggtaggagagggtccaaacctggaaagatggctaacatttaaaaggaaagagaggttagtaatgtagatgactcgtagaggagacagtcatttctttattaattgagaatcaatgatcaatgatcagttgtagttaggataaaataaatgaaaaggtcagctatggcttttcttagtgcttaatctttgatgactgcttgtatgtactttcaacataaaggatgcaaaacagtttttgccagtgtttgtttttataatactgatttgaaaagaagtatgtatggttctctattatatgttagctatttcatatagttaatggtgtttcctaggatttttgtagtatttcttctgaaaagtacccagaaaatattataatgccacttcatccacttggggtcagggtataatgtccatatttcagttttccttttcctttcatctctgtcctccttgccttttttgtccagttgctagctttataaatatggttacttttgaaccttgatgaagtgtaaacagatgtttttgaacctgcattgtaggtgatgctgccgaatgaatacccaggtacagctccacctatctaccagttgaagtaagctgtatttctacgtttatattgctataaaaagattctattctgaaagatgtttatactgtactttgcgtttacataaaatacctttcttattaacatgtatatagaaattaaaaataccttttgggtttggtatagagcatttaaataaaaattaaattctataaaacaataaaatatgccacttagtataaaagagaatcacaaggttcgtagaggtgaagtaggtacagaattgtctttagagatgaggaaggaaaccttcctctttagcctagtaatctagcaaccttggcccttagagttactcctaacctagatctcctgacctagccacagttccttgatgtacctgtaagactgcctgccttccaggagttacttatgatgcttctggtgtttctccctgcccctttccccgttgatgttgacgaaccatcttcttagcagcccgagcttaatctttatgagc

SEQ ID NO: 89103 - DNA, 2266 bp, Homo sapiens
aaatgtctatgtactttgaatggtaatttcccttgtattaggccataagactcagaatctattgatgggctatattcttcattcattccttcattcaataaatattacatggcaggcactgtactagatcctgggtgcaggtatggctagcatgaacagaagtgccctttttcatggcagttagaatttatggtgtggcagagatattacttataatattgtaaaaatgaatataacaatagctgtggtaagttctatgaaaggaagatatgcaaaactaattgagtttgaaacaagacctgacatagtctcggaggtgagggatggcttgtttgacttaaaagtggagttaattaggggatgataattccagtgagaggccacagcacagggcttggtgttggggagcttggcacattacaggaaacagtaatggtgatatgcagtggtaagagacaggatgagatggagggaatatggtaggaaaaggacctggagaggtagacaagacagatcctgcagagttttgtaggttatgttgaagattctgtctttatactaagaatagctggaagcagagaagggttttaagtagtagggtgccatgataagattttcttttttttgagacaggttcttgctctcttgcccaggctggagtgcagtggcacagtagtgactcactgcagtcttgacatcccaggctcaagtaatttctcccacctcagtctcccgggtagctgggactatagatacgtgccaccgtgcccagctaattttaatttttttaattaaaattttttttaaaatttttttgagatggaagctcactctgttgcccaggctggagtgcagtggcatgatcttggctcactgcaacccctgcccctcaggttcaagcagttctccagcctcagcctcctgagtagatgggactacaggcgcccgccaccacgcacagccaatgtttgtatttttagtagaggcggagtttcaccatgttggccaggctggtctcgaactcctgaccttaaatgatccacccaccttggcctcccaaagtgctgggattacaggtgtgagctaccatgctctgccttcagctaatttttttaaaaattatttttttgtactgatggagccttggtttgttgtccaggctggtctcaaactcctggcctcaagcagttctcctgccttggcctcccaaggtgcagagatacaggtttaagccactgtgcctggccatgataatattttcatttaaaaaagatcattctattttctgtttgaagtagtgtttggaaggtagcaagagtagatgtgggacatcagttagggggctaatgcagttgtctagagaggaaatatctatgatttagattaattttaatgaaataatttagtaaaacaaataatgttctggaatatcagttttactgtaatccaggatctagtaaggactgtattatatgttctaggtggccactccatttggtacagtgacagtccctctttgtgtccctgggatccaggccaggtttcttttcctcccaaaatacttaattagaaaatggtgagttgttgtggaatccattctgcttattcctgcctagagcaagtatggtcttccttgggtccccatttagtgattccgtcatccttggcggaagtataagtatttcattaattaaatgttttctgatatctctccctaacattactggccactccaacttttgtgcccccaacaaacttctttctataatcctctcatatttgccaatttatctgcccccccgatcccccagtagaataagatcagtatactgtggatttgttcaccattaacaccagaattgttcatctagtggccatttttcagctcttacctaacttttggtggtattgaccacttcctcctccttgaaaatctttccacactgcttccatcatgttaatcacattcatcagttagcgttttttcttacccatgtacaatgtcatacacttagaagtggctcttcacctgcctatcccctatcccaaaagtcctccttttactaaaagataccttcccacaggacgcaactttccttttctctttaactagttcacttgagctatttgaaacttacgaagtgtcagagattacaatatagtttgttctaatggtggaatatggggtcttgtttatttaatgcgctcgaataaccttggtccagtggtattattttcacacatgtagtctaaatagaaatacaca

SEQ ID NO: 89104 - DNA, 1183 bp, Homo sapiens
gaggcaaccaaacatcatttggaaccaaaatgaatcaatttaggcaatagaatgttttgtcagaaacaagatatgaatataaaattgttgaattgtcttttaggtcttgtaaattgactccctgaaggagtttcccatatgctttacattctttcttgttgagataagtatactaaatgataagtgtaccaaataaggggtttgaaattcttaaaaaactttaaaaaagcaagcagtgatcagacatcgatactgaaagattgtatccacttacagaaactaagtcacatttatatttctttaatccatctagtttggaaatgtttattcccctctttggttacagctcttctgcttattttaaagtaagccatgttaattttggagtcaactggaatttttaacgttgctataacctgtattaactactcagacacaaatgttgataaaccccaggtttttataaattattttaaaaaagaaatggttagattgtttataatgtcttggattgcaaatgtctgtatcttcttgaatttgagaagatgatttttgaaataacaattttttttttcccctgaattttgtttagtcagaatatcggtgaaagtattctttacctgtgggtggagaaaataagagatgttcttatacaaaaatctcagatgacagaaccaggtaggattgaaaaatactatcaatactcttttaacttataataactacatttttatgtagatactctagttgaaatttaatgtgaaaatctgtattctggtttatggtttgtatattataaaatacaagtttctctgaaaagtttaattgctcatgtaattatagttatttatttctataaggtttagcctctttgattttgtattacagtattcctcctcatctgagatttggctttccatggtttcagttacctgtggtcacctgttgtctgaaaatattaaatggaaatttccagaaataattcataagttttaaattgtgtgccattctgaaaatgttatgaaaccttgggctgtcccattctgtctagggtcttgtctaggattctacattgctttccattgttgtttctctttactctcctttagtctgtaaacagttgttcagtgtttccttgacttataaccttgacacttatgaagactactgatagttattttgt

SEQ ID NO: 89105 - DNA, 1037 bp, Homo sapiens
ggaattctattatgaggaagggatgtctcttcccatttatgtatttatttatctgtttattatttatatcagtatggactcatgtatattatttcagtccatgggttaaaatgccatcctatcatatttttttgttgctcaaattgttctagctttgacctttaagagccccttcaggttaactcctgtgttctttttataagccccatctctttttgagcatttcccagtttgtggatccacatgaggttccaggttcatcttgtagtttccttgctccaactcaggaatcaaccagttctcctacgggctgagtgctggttcctttcgttgaagagtggtatttagaacccaagacccagtgatttttttttaaaaagcatcgtttcttacctgcgtcataaagtaattgtgtctcatattcacataggcccagatgtaaagaagaaaactgaagaggaagatgttgaatgtgaagatgatctcattttagcatgtcagccggaaagttcgcttaaagcattggattttgatatcagtgaaactcggacaggtataatgttactaactaatttcttttgaggagagtgggttggtagtattatgtattgttctttgagatgatagagaaatttactaattttctccagttttaggaaggagttattaatttgcagataagattaattttttcctgcctgttggcaattttggtgtttgccaagtcttatcagaatggcaaggaaaaaatggaaatttactcttttccccctactttctagagttttgatttagtgatggaagaaattgaaactaagaaaggctattaacgtttttagttaacatcatgtttttatatttctgtattgaaatccttagctgtttcctgatgtttcaggattaaattttagtctgtgctcacaaatacaaatatattaactgaaagtgcagccctggaaattaaagctagtaaaatgcctttaagaggttttttttgagagacaaggtctcgctgtgttgcccaagttgaccttgaa

SEQ ID NO: 89106 - DNA, 1030 bp, Homo sapiens
catctttccttttgatgcaggagaactgccacttataagacctggctcatgtgacctcctctatgaaccttacttgactcccagagaaagatgtggttttataacatttggaacataccactattgtacacctgctacattggatgtatacatttggtaaatttcagagctagtttttagaagttttatatgatacatttaaaattccctacatggggaacaaactttccctttgacatagtagtaccgaaatatttgttgataattagtgctcaaaaataccaggtctgtcatttttataccaattatgagtaccagtctctgcccctaaaatgagaaggaaactttggaaatgactttttcagagtatagtagactctttaagtgactatttattttaatacagcatgcttcaaggtatttttctagcatttatttacagagcaaatataaaaagcatacttatttatattattgctgtttttaaggtgaaaatggttctttccaaattgtatgagaataagaaaatagctagtgccacccacaacatctatgcctacaggtgagtaatcatcacaagctttagtatactcagtttgttaaaaatagagggaaatgatgcatgattttagaaaataataactattgtgtattttttccattgtaatagtaatagacatggaatatttggaaactgcagaaaagataaaaaagaattgaagggaaaaatctggcattttctgccatcaaatgtaactgacaatattttgttttttgtttcatttttttctctgcaaagtttaatttttcccaatgctttatttacccttgtatcctgtttttttcttaattaaacaaaagcactttttcatattgttataactgcttgataaatactgtttaatggctgtaaaatatttgagatgccatactacaattaaccatttccttttagtttttcatgtttttcaccattataaagagtggtccagggaacatctttgtatactttttaggttatttcctcagg

SEQ ID NO: 89107 - DNA, 6597 bp, Homo sapiens
gttggttttgttgccttcatcttttttttatatgctttttgtttcactacatcttaaggctctttgaagacagatgcatgccacttacttcctttataatatgtcttagtacctgttgcttttatacagtatattctcaataaatgtttttcaatgattgctcttgttacttcaaggttaaatgaagtaaggggaatgtcacatggataaattcaccttcccataatagcaacatttctgatataaaggagatgcctttgattcctagctttcccaagtatataaaaaggcaaacatactggatagtaaaccgtcagtgaaaatatatctaatataatacatatttcaggaaggatttaaaaaaatgaatatgctgattttggaagtaatcaaaatgatcacaaatgttgaggaataagttttattataatattttagtttcaaagtgtaatactcttacatgtatttgcagaatatattgtgaggataaacagaccttcttacaggattgtgaggatgatggggaaacagcagctggtgggcgtcttcttcatctcatggaggtaggtgtaagttaaactatcaatcctgttctgtacaagccataaaatttctcaacaaaacagagctccatttagtaatagctaagtcagttgaactatgtaacataagatatatttgatttaattagtagttgatgttaaaatattgattgaatgaaaattttaaccagtggatgtgggacagaaagcaaataattaataagaagtgctatgctttcaagacatagacaatagaagattgtcttcaactttgggaaaacactttgtttttttgacaatttccttctctttattttttctattctttctttatggaactccggttagttggatattggaacttctggatagatccagaattttttttttttaaattgagttgtccatctcattgtctttatattctgagacattttcttgactgttgtccaaaatttctgttgaatttgaaattttgtttagcagccatatatttaatttttaagagttctttcttgttttctgtttttcctttttaagaatatcctgttctgttttatggctccaatatcttctaaaatttctctgattatattaattagagtttcttttttaagatgttctcacccctaaaaaaatttttcctggtccatttttgtttgtttatcttgtcctttctctttcatgctgctggattttcttcatctgtctggtgatcatttattgttcattaattttaggattggattatttttttcctaaggtagttacctggttttttctgctcttgtatgtgaaggtttattttctaacaaggcctttcccttgaatagtaactgtgtttgtgggtcaggcctgtaaactggtgggcttcacattaagggcagcatttgacaaatgtcaaactgatgaagacggccaggtatggtggctcacacctgtaaccctagcactttgggaagctgaggcggggagatcacttgagcccaggagttcgaaaccagcctgggcaacatggtgaaaccctgtctctactaaaaaaacacaaaaattagctgggcatggtggtgcatgcacctgtaggtcccagctacttgggaggctggggtgggaggatcacttgagcccaggaggcagaggttgcagtgagccaagattgtgccactgcactgtagcctgggtgacagagtgagactgatctagatctcaactgatgaaaccttactaatagcaccagggatattgatgcctcgtgcagcccctgtagctttgttcagaagcagggttttttttgttgttatttggcctagtggtaaaatgctgcctaaacttagctgttctggttgaagtcaccaggtgctagaatcctacttgcatggtctccccttcactctgtccagttgccccaaatctgggagtttgaggacattgtgaaacacagtgatggttttccagattcccttctgttcttccatttcactccctgaattgttagtaatctcactcagtgcctactcactcatatggctctaccattaaagtcactgggaaattttatgtgcaattttatacatgggttatttcattctccttttttaaaactcatatttatacatgtctgtctatgtatctaattatgcttccaaaaaataacagattttgaatgtgaagaatgtcatggtggtagtatcacgctggtatggagggattctgctaggaccagatcgctttaaacatatcaacaactgtgccagaaacatactagtggaaaagaactacacaaattcacctgtaagtggctcttcgtactacatctagagaatttctcatcactgcctgggaattttttaaaaagacagaaaattaagaatgaatcagaatgtgagtggtgaattggtaaaacctttggactcagaacctggagacctagactctaaacagtgtgtctggccagtcacgtgactttggaccgatcacttaatcccttcgcaccttgatttcataggacagaccacttcatcccttcgcaccttgatttcataggttcatagaattttataattagaaaaaccttttaagaccaactaggttccatccctaaaattgagccccagagtggttgtagctgatatcacatcagactagatgttctttaaacatctagaaaattctgaaattctctgttagtgtcaaaacatctcccccttcactggcatacctttagatgctttcttcctttatactttgagtttattttgttttatattttaggtatgttcatatctgccttatttaaattttactgccttgggaaagtggggcaatagatgaaataattttgaaattattcaaacataaatccactagataaataaggtttccttgattattcttgattgtttaaaaaatattagcctataagtgaaagtaccctttaaaacacagaaatgacacatataaaagtgattataccctcactgtaacatatatacatacatacatatatgtatgaatatatgtggaatatatatgtgtaaatatattctaagtgattagattgaagatttcatctttatgtaaatggagagatgctgcactgatttgtgtctttttcaggaggagtcatctaaggctttgggaaagaacaaaaaagtaagaaaagacaagaagaggaatgaacattaatacctgaaactataggaaaggttaatttgcctataattatatatacattccatagtcatcaaggaatatattgtgcagagagagtatccttgactgcttaagtcagccagttcagcatggataccaacattagcttttcttcttggttatatcatctgccaaaaatagagaacttatgatctattcatgtgtgtttcaggcttatttgggagaactaatttgaacttaatcaccacttcatctaattttagcaaggtaacagttgcccagggcagtacctgaattaactgtccatttcagtacatgtcaagtgcctttgttaggtggagaagaaatgtctctagaggaatataaatacctgatttcttgtcatcgagattcttgtactgttaaatgaatattgccttttactgctctttatggcttattggaataggagctcatttaagattgatcttggagagtttcttcttgtgattttagttcataagtatgtcacctttcattttatagtgttcatcattgagtaatggattaagtgaaaatccaggagtatccatctgcagttatgtgctgaggtgataattcatccaacatatttgttagcataaatattatgcttcagtttctgttgcaaattggtgattgtgaaattacagaaagtgattttctagtctgctttttttgtttaattcttgtaatgtaagcaataaatatggagtgtcagtagtctccttccaccccagaaatgtgttggtgtaacattctcgtttcttttaacaacctggaagtacctttcttgtgatcttcactgaggaattagaactatgatagaagttaggctgtggcaaatgggacattcgtagagtgggatagaggtggcagaatgaacctggtgtagggcaggagtatgttgtgtagttacatcaatttgatgcatgctttccatctgcactccagacggctttctcagttccaagattttgcagagagaaggagcaaaccttttcattggaaaaacagaaacaaccctcccccccattttttcccctctattcatcaaacctttatgtatctttcatcttccagttacctctaggcatttagatagtgaaatttacctttgagatataacaataagtgattaactgttcactttcagatgtaatggcaaacaattgttaaaagttattaactgatcacagatttgcctggacttcccttcccagggagggaacagaagttaggaggcaactttgggatggtgctagagcatggaaagcacagagaattggacaaacaggtctttttctcttttctctgatgttttacctttaaaagatccaacatccttaccgttggtatttttagtaaggttatagtaaatagctttacaccaggatggattctgaaatataaattctaaattatatttgttataactatattttatgttgtatgttatcaggagccatcagagaatgacctttttgtgtttggaacacttggttccatgaaaagtatgctttgtgttttaactgttaaaataatttaaaaattaattattttacataattaaagaagttaaaaactattaacattaaataatttcacaatttcaacatgtcaaacctatgaagggagataggaaacaatgagaaacttacttttgctcctttatacagaattattaactatattttactaactaaaaaactctagtattctttacctaaagtcaattggctggtaagagggagagatgcaaaattctccagctctgaacttggagctacttcacactctactcttaatggaaacttgaactaatgatagatagtatttttttcctctatttaaaatttttgtcttgattaggagatttttcagttctccatataataattttctacaatcagatctatgctgtggcatattttgctttatttaaaaatttttttttagagatgagttcttgctctgtcacctaggctggagtgcagtggcatgatcatggctcactgcagccttgaccttccagcctgccaagtagctgggattacagacaggcatgtgctattacacctggctaatttttaaagttttttttgtaaagatagggtctttctatgttgcccaggctcgtcttgagctcctggcctcaatcgatcttcctgccaaggttttggaattacaggtgtgagccaccatgcctggcctgctttgacatattttatagtgtgttaattacaaatagtcttcatatgccagaatataagagcaagtgttatctactttttagatgggaattgcagaagctgcatcaaaagtatgctttgaggtatatatagtgaaacagagcctttctgaagagaattatatcaaactaattacaaccaagaaataatagtatgaagcggatgctgtttggaggacaggaaaatttatcgggaaaattacataatccctctgattccactatccagagatagccattattattaatatttggtatgtacatccttatattatttttttcttatgcatgattttgtatatatggttatttttctttccataaaaatggtattaaactgtatatactgttttgtagcctacatatttcatatagaagtatattgttaacattttccatgtcaataaatattcttctatggcttaaatgtcttatgactgcattgtattctgtcttctcagtattatactaactagtcctccacttatttccaatttttaagtttttttcaacttttcactgttataaacaactgtgaaaacctacatcatttgcagatttttgtatgtatctttgattatttctttaggaaaagctcctagatatcgaatttcttggtcaaggtttgtacattctaatagcttttgattagttgagtcagattgtcatccaggaaagtgttatcagtgattgctccattaatattgtgttggaatatttaataccagccaaagatgggaaaaaataggcagtttgcttgataactcccaagatcctttttaaaaaagtaaactttttggccaggcacagtgtctcacgtctgtaatcccagcattttgggtggctgaggcaggcggatcacttgaggtcaggaggttgagaccagcctgaccaacatggtcaaacctgtctctactaaaaatacaaaaaaaattagctgggtgtggtggcgggcacctgtaatcccagctactcaggggggctgaggcaggaatatcacttgaacccgggaggcagagattgcagtgagcccacatcgtgcctttgcactccagcctggcgacaagagtgaaactccatctcaaaaaaaaaaaaaacaaccttcttgccttg

SEQ ID NO: 89108 - DNA, 1113 bp, Homo sapiens
aaatattatgtggagggtgaatttatacctccaggatactatcggatccatgcatactctttgaggtacttgtagtagacacataatatcaactaattgaaatcacttttatatatactgtgctcataaatggtgtccaggaaattttggttgaatgttttaacataatgccataataacacttccataagcaatataaaactacttgaagtagaactagttgttactgtgagcatagcttggatttatatagctcaaaacatttgcacatatatctttctaacacctatggtttaaaatcaggagctttggaagctgtatcaacactgttagaggagtgtatttgacatagatgttaatttgtttggaacaaaatatctctgcttatttgatgtaacttaaatagatagaatttttactagcattttaactgtcagcacagttaagtcatttatttgtttctccaattgaaaataagataaagtttgcacaacacaagaacagcaatacgacaaaaatggagaaggaaatctgagtaagagttaaggacaagaaaagggggaaatgttcagtacaaatagaagaagcaaaaaataaaggatggctctgaaattagcttatatttacactgtaaattcataaaggcactctcaattcttcaacttttatcatttcaccaaatgatctgcttatgaaaagcagtcaattgccatgactttattcatgtgttacttagtttctgaagcaggacccagtggccagtaagctaaggagaaaaaatgaagcaggactgcagctgttgttaaaactaaaaggtatacaaaattagggtagttactttagttcttccccacctcctcctcatcctgtatctcttcacagatccttctacttgttgatgggtacagaaaggggaacagaagaaaaacttacccagttacaaataaaagatgactagagatttttgctctcctcgctcttgcagttgaaaataatagaaatttagagaaaagagcattctgtcggcttcttgttttcataagaaagctgagatccataaatgttccatcacttaacgcaggctccaagcagcactggggccaggacacagat

SEQ ID NO: 89109 - DNA, 1009 bp, Homo sapiens
gcacactgaaaagggacataacagaagctggtacttgtataaataatagattggttgctatatttatagcaccaagctattatattgactaaggaatagtagtcttaaataattgtatcttttaggcatttctgatgttaagcattaaaatatcatgtcttcccaatctctccttgagccctaatttatgacaagtgaaaagacttttttttttaattcgaatgctctgaaaaccaatccttcactgactatgaccgaaatttgtcactcacaaaacacagttatcttacagttttgcagcaggtagacctccctttgctagtacaggttcagggtatctggaaataaactgaacattttgctgaagggctttttaatttctcataaggatttatccattgacctagcctgtttccagaatatttatacttaaaagaaagcaggaagggaggaatggagggaaagaagaaggagagaaggaaaagaacagaacagaaactttaatttttttaaaactcaatgcatagaaatcagtgaacataaaatagatgacagatgtgaatacatagtgaccaaaaactttgaactttatcccatttccagaccacaagaatatccatcctctggtgagcctcgtatctatactcaatcaggataactaagaatggcataaataagtcctgtgcaaataattatgtcacgtccatttatgcttcacattcatacatgccctactaattgaatcaagtgtttaatcccaggattcattatctatttccctatctaagtcttttttcccatttatatttagcacccagctgtccccttctccaaatggtcaactgctgtctcataaaagccttcagattggcctccggaacccctagctttgtgcagcaattttctcagtaggggccagctggatcttggtgtgtccctgctgctggcttggaattgttaaagaaagcaagctgcatggagatgggggtagaactcagcccttcctagc

SEQ ID NO: 89110 - DNA, 1041 bp, Homo sapiens
aaaaagtgtattttatcaccttttagcttctagctcatctgatttgagttatttacaggtagattatttgagttacttataggtgattttattaaatttcagggtattgaaggctaataaaatttcttcccccaaagcacttgggatgaggttggtacctcaacttatattaagaatttgttgattgagtgattaaacttctgaagttcacttttgcctattttgcctcttttccttcacccctacctgatggttccttagaaccatcccatcagagctaggtgaatgactcaggtattcacctattttgagatgtctctgagaaaaatctttttgtccacatttcatgtcagttggccaacttgtataaaccttggtaattaattaatggagaaacagcaatagcaattttagaactggtgtagagattagcagcttcgggccacagcatgtttctaatttaataatggctttaatagttgtagaaaggaagccttttaagaaaaagttcatgttgaatttgggacttttttccccaaatagcttgaaccagaatgaaatcaacaattctttccatccaggataccctcattttactaatggaattgactattagggaagagtaggttcagatttggaagatggtaaaccatctgaatggacacagaacacagaacttgacacttcctcgttgcttctttaatcttgtcattgtttctgtgacttctccttttgccctattcctgatttcttagaaccattgacattagaactggaaatactcaggattgtatgagggagataaagtatctgtgcttgttttgttgtgttcttgatattacgactggtgaacctttgtcgcttcctttagaactgtgcaaaggcatgttggagaggagaaggaggagaagaggaatgggttataggacaaaagaaaaaaaaagcaatcatgctaaagcctttgaagtgttagacgatccatctgcctgttagagtctgaggctgaatccctttttaaaatgcatcaaatgtttgagtgtg

SEQ ID NO: 89111 - DNA, 1035 bp, Homo sapiens
tatgtgtctttatctcttctttaaaaataatgatttgcaatctttttaatgtgcaggcataatgatctagaaccagaaatatatcctatggcaaaatgataacaagaatcttgtttaaaaaaatccagttaacttcagcccacacattgaggcaaattctatttatctagtgaatttcaaatttactcagctactttggaattttgaatatcgtgatagcaattcattctgtttatgcttcccacttgagctacagtcaaagggtagagaatgaagtatatagcaacaggtttgatttgtagaaaaatctgtaccctgtgtcttttatttcattaaaaagagtagaaaaacttgaatgtgatggaacagcagagattgtgttgagaaagtgagttttaaagatttttttcaaatctgtatttataaaggaaaactttaaaaaatggatagcacttttgtgttatatgtggactaacctacctttaagactttttgacaggagagactagaagcggttggtggtttctggaaataatggctgtaggctgtaactgatgatttaagccaattaaacacacagagtggttctttttggtgttgtttggcagaaaacgatgaaatggtgttgcctgataaggaagagcccagcgtatgtgtgatttcttatgcacatgtgctagaatcagtgcaactcataaattcaaattacttttaaaagctggtcatgatacatttgctcattaaccatatggaaaatggcactcaggaattttctacagtgtgttttcaaagaaagaatccaattgcaggcagacattccttagtacagtgtttatgcagctgtacttgtgattaaattacaccaactcaggcccacatgtagccacagaacttattactttgagtacaaagcaccttgtaggagtatgagaactctcattgtgatgttttttggcctcttggccactgtatcaagcaagcatcaaaagtcatgcatgtgctctgaggtctctggagaaggagctgtgggacaga

SEQ ID NO: 89112 - DNA, 1034 bp, Homo sapiens
ccagtcattgtaggacccagtgatacagtttgtgtactgagtctcctgctaaactgagatgatgggtaaactactgcagctgggagaaatactaacctgccttcccagtttactcacacttagtgtcgatcaggtcacactgacatagacacagagtggtgtatatgtcaaggaaggtactgtacgtgcctggaagatatctcaggtaattggcttgatacttccagcaggagtcaaaagtgtaaggaatgtgttcttactgtatttgtagctcacgcagtttagtgactttggcacgttctgactatctcttttgtggagataattgtatagatatttaactgtcttctccccttcttcccctatatttaaaatcaaggttttgcagttgtctattgtggactgctttttgttgggaagtctgtgcctctcctggtatgtgtttgggaccgggtgcacactacaccttttcagttccacagggataggaccagatggaagaatttgattatctagcagtagaggaccaactgttcagttggatacagaaccgggagaaaagggttgaagagatctaaaatggctgtcgtatgtggagccaacagtttccgaagggaaccaggcaggcactgaggtgtagtaatgcagaatctcttccaagtaccagctggggctttcaggagccgctatccccacagcagacactcagcaggctccaagcagcttgactttaccatatgtggaactttttattctccacctcgctccctagagggacgggccacagggacaccagaggcaggtgaattgctcttaatgcagagcactaaatcactgggttaacatgagaagcctggagagaggaaatggatctgcagaagactgactcggagtctcttaaccttggagctattctgagcaccaaaaaagataccgcataatgtttcattaggctttcaccttgtgcataccctcttttatgcgagtgaccttttcatccttgtacatattttctaaatgcttttaaaagccat

SEQ ID NO: 89113 - DNA, 1096 bp, Homo sapiens
gcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgaggtaactcgccttttttaatgtttgctatttaacctcctcaagaaacggtccctgctttatgtttacactctccacagctttatttattgtcatgggccaaaagatgcttagattgaaatgcagtgggtttctttttcccccatagccattagctagcaattacttgcttcttgataagcagcattttggcttgaatggtgcaaaataggactaattccagtctccctaggatattgtcttctctatgactgaagagaccagcgctcatgccaacactactgagatctggaatctcagcatagcttcaccgtgagttgaaatccccagctatgacttgtgtgtatggcagagagataatgactcaaaagtaagatgctatgagccaccatgctggcttagagtaaattaaaaagaatatatatatttggggataacaaattgggtaggggtggctttttaatgccatgttgtcaacactcactgtttttctttgtcttctgggtagagaggaaaatacttcctcacaacaggatttttaaaaatcccctacatttattaagcaccacatgcccattattctgtttaaagacactatccctgagtttgaggcctactctctgggtttcaaaatcaatgtgtgcgtttttttttttctccttagtttcagagtagttttctgctttctttgccgtgacgagtacaaaaaacaagttcatttataatgaaatcatttcataagtcatcatttcttagtagctgagcagaggatggctcattttaatatttctttatgctttatcacctggttt

SEQ ID NO: 89114 - DNA, 1030 bp, Homo sapiens
tatgtaaggcaagtggggggaaacctgaaattttgttggtctcaagtcttaccctattgtttgagcctcaaaaaaaaatttactgaatcaacttaccatgttgctaaataatgcaatgattgtattgctcgtgttttaaggagaagagaggtataaaccgcattcttggcctcagaattccatagaaaaacacttgtgccaaggttacctgcctgtaaagacccaagattatatcccatgtttgataatttaatgtttggaacatagtaagcacagatttatggtctattaacatttaggtatcaccagctatttatcttttattttcttgctagctgcgtatacaactgtgaaagcttaaggcactgtagattgccattgggtcagtccttaaaattaatattcctgagattgcattaaaggaaagaaaatattaaaatatgtttatgctatattcatagaagcttacacatggaaacagaaatacatgcaacacatataaatctttttgtttacatatgcagcttttcttccagccatgataaggtgccctagaaacattcactagtctttgtaacaccccagagggtaagtagcaagaattcttatcttcatattgcaggtgaaatacctaggtaggggcagattaaatgacttagccaggtcactctctaagtcagttatgaagctagaaataaaactccaggatcttgacttttggttcctacacaagtatcagacccatcagtatttgtgcttcttctcctcacttgaaaagtaaccattgatgtaaatcctgtccctgttaaggaaatcttgctgtgtggcactagcacacatgatactgagtccccgatgggcagttaagagggtactctgctgttgcagtgaacaagctcaggtagcaaaaggatattgttaagccagtttcttgcagaccaggccctatgaagaacattatcagaagtttccataacttcagagaaagtattttcatctactttcttacattagtttctcttgaataatt

SEQ ID NO: 89115 - DNA, 1230 bp, Homo sapiens
acagtgcaatttcttttctagccagcaagtgacttgaaagtattgaaagataaacaacctgagcaagggccttggattcttgccatatgctaggatctcaattaagggatgaaattgcaagacactcttcatttttatcaccagcgaggctgggttctgtgggtcagtaaagcaggcaagagtggcggctgttcgaggcatgggcacagctagtggagggtcataactacctgcattagcattaatgggacttagcagcacagatcgcttcaaatggaagaacagacccaaaagggaaaagtgggtagagagtgggggttaactttacttgaatctcctctttgttggaaatacttgtctctttttctttgtcatgtgctgaggcatttactaatgagtaagtaacacaaaaaatcacagatgaaagaaattggattctcggtagaggactgagattttaagtgctattcaaaatacaagttgcagaatattggaattaccacatttttgggtacatgaatagtgattctctccatctgagcactaatttgcattgcctgtgctgtcatattttgctgtggcaccattttctctaagtattgcattattgacttaaaaggtgtcattttccaaatgatggaggtaaggaagtacattttccttatttcgtaatttgcacacagattgaagaagacttaccattgtcacaaaatttggatatgatggatcttgtattttaactggattgtgggtgtagggaaatctaccagtacattaattttaatggaagattgtggcatccttgaaaaatattttgaaagttaagtcatgttaattttcttccttatttctttcctcctgtttcttaaggcctcatcatctttgactccttactcttctgtgccatcaatgataactgttaattcaagataattgtggctttagtaatgtttctatttagtatggtgcttttcacccataaaaatatagtgcagatgttaacttacctgatccagagctgaaactaaataacttagtgaaatgctaattttcttttaggtgtgttcctcacagaaagataaggtaaatgacatgaaatacacacacccattcttccactgagcctttggcactcaggtttctgtcagtacaatcatttatgcatattttacttaatagttgagggtccgagtttctctttgatgtcactccgctactgatctttaactt

SEQ ID NO: 89116 - DNA, 1346 bp, Homo sapiens
atggaggcaatttcaagcctgggccttgcactgtacacttaatttattttctgacctttttgtgatttggggagattctgtatagccatgcgtgcatgtgcgcgcgcaggcgcgtacgtgtgtgtgtgtgtgtgtgtgtgtgtgtgtgtgagagagagagagagagaagtgcaactacaaaatctgtctgtagttctgtaggtggtggatagaggtacgtgtgagggggtggttgtcttttgccaagtgatactatactttgttggaaagtgtctgttttctgcctgtcctcgggtaatgtataaaacatggtgcttcaggtagagatgaagggtaaactgatgtccccctaaatggccagcctgtgtatgcacctaacacttcactgagcaatctgtcaacatgtcagcaacacatgttttataaaaagcctccagtgggagcaaaggctcctgccagggcttaggaaatgctttgaattcagcagatttctattgctggagtcccccgaggttccttttacaatgcctacatttcagaaatttgaacttgggacccttagggggttctctccgaatgcctgaaaatgtagagttatattgttgcgtgtccccaagcggtctttactaatacctgaattcggagaagctggaaattacagagctccccaggggaagctttatccacaccaggaagaagagaataactctgcagggagattgcttaatgcattgctgaaataaaagaatttgagagagatgggttgaagtgttttttttttttttcccttttctggccactccttcagcttagctaagtccttaaagacaaagtcagggtaaggaagcagctgggctctttttaatgaaattttagatgtggcttttgaaatagtcagatgcctgatgcctccctgtgtgtgtgtgtgtgtgtgtgtgcgcgcgcgcacgcacatgagtgtttgtgtagtctctctcactagaaacctcttttgtttacatgcaaaaagttgttttcatttttaggtgcatcatcagtttcatcttgtttccttccaggcttagctgtttctttttttatactcccaatgtacctgtctcagttacttggaaatatttcttcatctctttctctttttttatggtgcttttcttttattacatctgcctgtcatgctttgtactctccccttttcataacttgtggtgttgctactttcctttcgaactctcactgctttattgaagacttctttatgcctatgactctgcctctctttttaattttcctccggccctcagcgctctcgtctcaactcagattttggaaatacttgggtatttttt

SEQ ID NO: 89117 - DNA, 1061 bp, Homo sapiens
gtgaatgtactaatctattaataactcaatcaaaaagtctaagaatgggagggaaatatttctgtactaggatttctaaggatttatgaagattgttataataaaaagggaagtatttgaaactcatctcagtcttctagcagaaataaagactaaatatatgaatgccttaaaaacagagtttttatctgataactggtagagaaactgtttatttctttctatttgcactttccctaaaggacctatggtttgtgtctattctgtgaccatagtataacagagtacgtatttgtcttcttgaggatagccatcattcattcattttctctgccagtaatatgaactttcatagtattacgatattgttagtttcttaagtcatactgcatttagtggtattcgcattcattttctatattttcttgtgataaattctgttatagtcaaaaaatttcaaagcaccctggcaatgatttattttaatatctgcgtgagactaaatacacaaataagaaaggatttaatatgaatttttcatggatttgctgtaacttgaatattgtgaattgattttgtgcaagctgtcacagaccttctgattagcacatacttactagaacatctctgttagcaaaactggattacaaagtgtaaatgccaggtatttgtgcttattctgtttagcattctcatgagtttctttacgtatatctagtgtgttacatatgttttgaaagagtacctaccttagagaatgtggctcttgttttatggcccattttaattcagtatatatatatatgtgtgtgtgtgtgtgtgtataaagggacatgtatatgtgtctatatatatgtgtgtgtgtgtatgtgtgtgtatgggaaaaatgtataaagaaatggttgctacttacaaggctttacaatttatggggtgaccacacatacacacttaacaaatacagaaaaacataagacttttttcattcattcattcaatacatatttattgagtaccagctatgtaccaggcactatttatttcttatactgaagatacag

SEQ ID NO: 89118 - DNA, 1050 bp, Homo sapiens
aaggtatttagaaaccaagatatggatactatgtatgctcaatgctataggtgtaccattacttatggacttcagtagacagaagtaggaaatgtacatgcatacttactataatatataatacactcataatatggctcataaaattcacacatatacaagtatatgcacatatgtgtatttttctctatccaataaaaaccatatgttcatattgatacctcccattcaattcagtacctcaggtacatcctagtctttttccttggtgtatttctgctgccttctgtaacagagagaaacctggcttccattatccttattaatatgtttactcatttgcctgagcctagaatatacagtaagtagtttcaaaattgcttgctgataccaccatgataggcaaactgagtttaatatttgtttataattgttaatgctgtaatttttagtgccacatttacatacagtgaaattcataaattataagtatataatttggtgaattttggcaaaataaatacacctatgtgacacgcccttcttaagatataatttctttcatcccagaaagttccctcatgcttctttctgatcaataatgctccactagaagtaaccagtttttgagctgttttaaccatagattcattttacctattctagaacttcttgtaaatgaaattgtacggcgtgcaccctttttttgtgtgtccagcttcttttgttcagcataatgtctatgagatccattcatattgttgtgtatataagtagtgtgttttttattgctgtgtagtattccattatatgaacatatcattatttgttttacattctcttgttagtggatactttatttttagtttttgagtattatgaataaagttcataatagtcaaccttctatatggatctttttgtggacatatgttttatttctctcgttaggaatagaattgctgggtcattgggtgaagggcatgagatatgatatgtttaatctctattagaaacttccaaaccctttttcaaaaactcccaccagca

SEQ ID NO: 89119 - DNA, 1056 bp, Homo sapiens
atattactttatgcatatttggagattatctggaaataatcatttgaaaatatgtttacatatagcattatacgataaaatatatactactctagtatatatgtatatatacatatgtatagatttgtatatgtatatgctacattatatacataaatactatacaaatatataatatgtggtcacattatcctgacaagtcgagattgagacaatataagtgggaacacatttccacgaacaactattaatttacagttactatgataatggcgtacacgttcacttttagttctatctgggtagctctgtaaattgtgtattgattatgctaatggcactcgtgtctttattacttgtctgcagatacatgcagattgaatgcacatttggtgaggtggtcattctgtaggaaaaagtacatttttaaaacctggcttttggagagattgtattaaaactaaagaaaaacattagactcatatggacacctaaggaattattttgtgtcctaggaaatgaaaagtgcagttaaaaaatttaaaacaaatgatgctcttatattatctttgtttcagattccttaaggaaagtgttacagaaatggaactaaatcaataatgatctatttttatagtttatttttggttgtgtggcttttcttgttttgtttatcaggatgaaggaaccttcgacatttagggttgtatgtattttaaaatttattagaccaactaggggaagacacaatgaattcctttttttcaattatacataaattttcttgtagtttataatagctcataaggtataaatcacagcctctttttttttttttttgctgtgatctttcattatacaaatttgtgccttatgttataggatttttctttttttaaaatttctcttttcctgagtcatcatgttaccaaggcagttgttttgaaaatgctttcttatcttcctaagtgggatcatttcttacaaatgtagacttttccacttagaaaagaaaaaaatctgttttcatttgttttcaaattatttttcttttta

SEQ ID NO: 89120 - DNA, 1047 bp, Homo sapiens
aaagaaaatttagacagaattctctgcaataatcaaaagataggagagttaaatactgagggaaaataagtctaaatgttacacccagctaaactattaggttggtgcaaaagtaatcgcagtttttgccactgaaagtaatggtaaaaagcacaataacttttgcaccaacctatataattctgaagtgagggcaaaatgaacattttcaggcttgcaaagatcaagagaattcatcatccatggaagatgtactggagcaaaagaaaataatacagtagaaaggtgtaggatgtaaacaagaatagagactatataaaatttgtcaaaacataattatgggtaggaaacattacttttttgggtgtgagaaaaggtacagttaagtgtgataggttggttccattaatggcctcattttttagccctccaagtccatgccccctttttatataaaagtcagacagattttaaaatatgtttctctcaggagtgggacttactttcctgccacttgattctgcttggccatgtaacttgctttgaccaagggtatgttgttgactcataaggaagtttgtaaaagtgcttgtggagttctgcttccactcttgtacctctgcccttgccatggaaacctgcccaggctaacctgctggaggaatgtgagagacacatggggcaaagccgaactggcacaaccaacaccagctaacccctaaccaaaatcagtagagccacctagccaaccagcctgctgactgtagaagcataagcaagtctagcacagatcagctggactatgcaaactcttaagctaaataaatgtttattgttatacaagctgctgatttgtttgtgtgtgtggttctttgttaatgcagcattactgtggcaataaatagctgatacaatactaagatacaatgacaagataggaagcatgaccaatgaatagattataggtcatgataaagggttgcatgcatgcaactaaagggttaacatgctaaagggttttcatggtcaggagaataggaaaactga

SEQ ID NO: 89121 - DNA, 1051 bp, Homo sapiens
tatcactttaatcgattctttgaatttttttctctaatgctttcttgctgcttccttagttttctgactttgactctatggcatgtgtactttgattctagtttctctgccatcttttctttgaggataaaaaaacatgcaccaaaagtattttgattttactttaatagtagctcttattcagcttaggtcaaatgtaaagagttttatgtctacagaagctgtaactatattagctatggaatgatatttagaaatgatatttatcaggacttctggtatcagtggaccaaaatactgcatatagctatcaaggattttaccttcttttctatcaatatggctatactagggaattctgtctgttattgccttgaaaattaagagcaaggaagtgtagtttggctttctcttcagcactaatattctatccaaagaaatcctatttcctgttcattaatttcagtattccattctttcccaagatcttgcttcacagcaagctttcatacttcaagctctacaagttagtgttcagtcctcattcccacataaacacaaccattttgaaaacatgaactgatattaattacccccttggcaccaaaaagtcaggatttcctgatgcggcacgctaatgtaaaatgcattagtgcaaacggtggctccaaagggtaatactctctaaataaacacagcattttttttttttattcacaactctggggctagtctgaaagttattcatcctccacacccccccaaaaagcattttgatttttaataagttataactgggatttttataagaagaaattgaattccaagctggaaatcagtgtcacttaactctttttggttctgtgaaataaaattctacctgaatgttcgggtgattaagtggctttgaaccataattttcaacaatctattggaagataataacagttcatgtttagtcagtatcactaaaaatgtgtatcttacatttttacttaataaattctttatttcaaatagtcattcaaggtcagaaagtgtgtgtgttttg

SEQ ID NO: 89122 - DNA, 1080 bp, Homo sapiens
tgtacagactatatattctacaactgaaatttgcattttatcgaagtaataatatcatactatcccataaaattccagaaacaaagtattaccaagaaaagagtggggtcactattaaacatttcaaaatatgctaagtgtgttagttctgttatttgggaatatgttattattctgtagcattattcaggtggcacattgtttttggttttctcttaaaattttttaatggaatttttaaacatacacccaagtgtagagcagagtatggtgcgatgggcccccatgtaatgttaacccaatttatatacttagcaactcatggcgaaacttctgattgttcatacactaacccccaaatagaaacaaacgctatattatttaatcacttaaatattccagtaaacatatctaaaagtacttgaagattcttcttgctcctaaattctgtgttttcaatgttaacattgaattagaaaccatctgagaatttgtacgtataagtcattgccttttctttcattttaaaaagtcattcatgttaaataaaagattaatagacatacattatacaaagagttaacatttttcataatttcatccattaaaagtcacaattattaaaaatttggtacttttcttccagtttaactttacacaataagccaacctatgttgttttttaaaacaaaaacggaattatactacatactattctgcaactttcttttctttttaacttagaaatatcttgaatgctccttgttcccttgttgcctcttaattttttactgttgtagaaacaaagcttttataagctatattgcagagttgtttttttggggttttttgtgtgctgttggggtatttctttacagtaaatttttaatatcttaggtgtaaggctatggatgttgaaaaaagtatcaccataaaaggtatatcactggcaacaccagtttcattagtcttactaatttttgcaattctcatcaattttttaaaatgttatctctgaattttatttgaattgcatttatttgtaagttgagcatcaatttaagtacctattacactttt

SEQ ID NO: 89123 - DNA, 2727 bp, Homo sapiens
tgcaattgaatataatatcagaagaaattacagggtgatactgtatacctaacgatataaaaaaattttgtttattgtaggtacggctgcttttttgtggtatgacagtgttagaaatgattcgtttgtaatcttctttgcctgttatggtcaaactattatctaattatatttttaaatttatcttttagggacagtatggaaattaccagcagtgaaaaagtacttacattccagtagccagtatctattagcagccatattgtcacctcagcactgtggacacctccctgtgaagagatccttccattccatctagtttttggaaaaaccttgtggataagtggctgtttcatcagtaagcagcctttgtggtttagttataaaaggctttagtagctcaaaaatactcttgatttcacatttctactctagatggcaacattggacagaaaatgcaatgacataaccaatttgtaatgattttggaactgtgtttcaaatggactgttacagactgaaaggtgtgaacagctttgtatgtttatgaagggtaagggaatttaatacttttccacagatttttttgtaaggggaagagggaaatgtacactttttacagcagcaatattttgtatattatgtttatttcatgtggtgaatatgcaaggcggtacactacgcactggacagcatcagaaatcctctgttaatgtggactggaacatggtagatgcttgattgttttggtctcaaaatggtgtgctataaagataaaggtgaggggaagacaaagcacaccatatgtccactgttctgttctcatagaggaaattcaaatcccttttatctattagataatcaagggcactgtgatacagttttgagtaaaaagacattttttaaaagccttccagttttgtggattaaacctttttataaagatcatttataatactgttttaaaatgtgaggcaataagaattactttgtgttggatctgaggaggctttggtaaaacagtttcatctaaatgaaagtggtaatcctcttctaaaatagcaataactgaaaatgaaagtgttaattttaccttgtttgagttatcagggaacttagtaagtaatatcaaagcattttataaatgatatcaaagaagagtcaacattgatccagtcattttattttgtaatattgagggataattggttattaaactgaatagttcaggagactttacaaacctttgtttcaactttcttatctggaaataatatcatttataaagggacacttttatgtttttcccttttttatgttggttgatataacacaaagagatatttaggaaaatgcttattgatgaggtttattctatctgtttttaaagcaccgaggttgcattctagataaccttgtttattagcatggcatattttaatcattatttgagactgtcctgtgcctgattattttagctaaattcagggagattgcgtggggcaggaaagcatgcattgaaaaatttctaaccacggttatttaagcataatctgaaaacatctagcccaaaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaaggaggaatttcagtgggtctctgtgtgtgtatgagagagagagtgtgtgtttgtgtgtttcaaggtcagaacaggtttttttgtttttgttttttgttctttgtttttttttttgagatggagtcttgctcttgtcgcccaggctggagtgcagtggcgcaatctcagctcactgcaacctccgcctcccaggttcaagcagttctcctgcctcagcctcctgagtagctgggatgacaggcacccgccaccacacccagctaatttttgtacttttagtagagacgaggtttcgccatgttggccaggctggtctcgaactcctgacctcaggtgatccacccgcctcggccttccaaagtgctgggattacaggcgtgagccaccgtgcctggccagaataggttttttctttcaacttgatcagtagaaaatggacatcaagtttgaacagataaatcatggacagccttattgtgattgaaatgcttgtaggttctgtgccaattttccaccactgtgtactttgttgctatttaaaactgtatcaactctaacggaagaataaattatttgtgattttaattttctcatttgtttctttaaattagatctctttgactctcttgtcttgtctggagactatgctgtgggtttttatataagttagtccagtataagcagactatatttgtattctaggactttatcaaaattctcttgccatgcccaagttaattagaattaaccgttcagtaatcagcatgttgtgtaggctgtttgttacagaattctttctccgaaaatgaagtccataaggctataatcaagatgactgaattagataaatgagttgaggagacaaaattgtactgaacccaacctggtgtagtacgttatctcatttgaaataagctcaactgacattaagaaataatttgtcttgccaacccatcttctgttgtcttattctccttttaatggaaactaaaa

SEQ ID NO: 89124 - DNA, 1394 bp, Homo sapiens
gtaggtcataatgattacggttatcagcaaccgtcgtatcctgaacaaggctacgataggccttatgaggattcctcacaacattactacgaaggaggtatctatataccttcacacacatacacatatatatccccttctacaggaatgaaaattcttgcataagacaacttctacccatgcaaagctcttgtagaatactagttgctggctttcttgaaagttgcagggagcccaaaacaatcaaaataatttccttacaaatatttaaaatgtataaccatgacttgccatttctaacaataataaaaagactaaaacattaaagataattttttcctcagtggaaattttctatttgaacataaatccatcaaacttttttttctcgtgtgtgtttacatatgtataattttacatataagtatagtgcctttaggaaacagcttgctgatctcgtgtagctagtgtgtgctcttgtagctgtctttaattttgtcttttttattttatttagcatagtcatgatcttatgactgtgatgttccagtaaatgtaatgctcgtatggcagagacgctgaaaatgctgcagttcaaccttgcaaaattggctttaactgcagtttgtttggccgaaatccttctgtttggtttgagttttttctttgttttgttaacttctaaaaatcaatatggcatttcattttgttcttgtgttgttggctatgcatcttagagggaaaaaagttacttaagcagacttctcagttttttttcctcttctccaattatcctgtaggaaattcacagtatggccaacagcaagatgcataccagggaccacctccacaacagggatatccaccccagcagcagcagtacccagggcagcaaggttacccaggacagcagcagggctacggtaaagctttgtacagtgtatttttatcaccaaaaaaatgtgctgattgttttaaaatatggaagtggatatttaatacttatttttacaagaattatcacttgaaaattcagttttagactagtctactgttaaaatgttggtttaaaatgttgctcttagataaactagtaatccatttaaaaagaacaacaaactggagatggttcatgaccaaaggtaatgtgtggagtcatttaaaagacaagaaaaatgaattatcagatgtatttgtcatgcctagccctgtgtgtgctgggaaaactgatgattgggtaattattgaccatatgtatataatctgcttagcaaatttattttgaaaaactagtggccaatacagttttttttaagacatactgattttttttttttttgagtacaaatgagatctattcagaatgcataaagaaaatgtttttgtcattccct

SEQ ID NO: 89125 - DNA, 3041 bp, Homo sapiens
gtcaagttaaccaaggcaatcatatgatgggtcagagacagattcctccctatagacctcctcaacagggtaagattccatttggaaaatttgctacttaatgtaattgaaaggctttaaattttaatgaccttttaatctagacaaagtcagggcgttttctttttttttttttttttttttttttttgacaaaaggtagggttctagtaagtacaaaggggtcacgaagaagataggaacttcttatctgttattttctggaataagttataccatacaattttatatcgaaagctcactaattcacagcagaaaatactgttttgtttttgaaaagttataaagggtcaggaataaacccaattttacttcacagcactgtagtatcaaaattaaaaggaaataaatttgctactagtttgaacctatttttaagaagttagcatttgtttttctgagttggtattttttgatactgcatgtatggtcttaacattgattttagtaaatgtggtatgtggagctgctgtgtatgtatgcatatgtatatgaatagctaaaagtatctgaaatgccaaattatgagatgggaatctatagttgagaaataatctttcataatatcaaattagaaagaaagcctttgatgacatagagaacacattatttatatcttgactggttgtggtttttcaggcccaccacagcagtactcaggccaggaagactattacggggaccaatacagtcatggtggacaaggtcctccagaaggcatgaaccagcaatattaccctgatggtaatctctcctgatgttaactttcccattttctatccctgcctaatattaatgtagagagttatttaaaacatttcagtgaggacgaagaaactaacaatttgtttcctctaaattttgaaacacttcagtactctaaagtaccaatgatagcattagtttataatctaattcaaagtatattttaggtgttccattagtaccatcaggaatcacagtctgtcattggaatccttatgtaaaaggatctttttgtaatatgtttagggttgtttgatttcagccaaagcttatgtttattgatttacttttttttaataagagcttcattaagatataattcacctgccataaagttcacccattagttgacttgtattaattgtacaaatacatagagtatatagttctcaagttatttttccaagtctcatcattttaattaatgtttcatacttctcaacaaactaaggtttacattagtgcttgcctttgagaaaaatttgggagactaaattatatccataatatagccatatagagattgagtagaatgggaaaggcaatttggaaataagatttttagttagggttttttgttttttgtttttttgtagaaagtggcttgtgaaaaattggttagtaagatgcactgtacttcaggaaaatttgaatagcaataatccaagcatacaagtaggttttcacagtacagtttcatcaatttttctgtatgcttgaaaattttataatacagtgtagaagaaaaaataattcagaaatacattacaaaatgatgtgggttgttagggtttgccaaaagccttattcatgtatatgatcctttgatgtaaatataaattactgaacagagaaactaagaaacttaaagctaaagtattagcagccattgactagcagcccatgtaagctagcaagaagatacaatttaggatatttgaaaaaacatctcacctgtcattttttgttaatacataaaacataaaggtacatttgtacttaaggacattggtttttgttttgttttttcttttcatatgtaaacatggtattaagatttttttaaattaaaaactttagtaagattgttgtagactctacgtattttaaagacgtgaaatctactttgttaaattatatgtattaagaagtctgctgaaaataaatgattgtttctattttttaatttttaattacattttaaagaattaaatttgacattgttgttttgatcctgggtatctcttgaaatgtgacatgtgtattgttataacctttctgttcaaaatatattggtttgttattttgtaaatatcaaaacattaaggttactttaattcattttattagtggattttaatttgaagggtatcatttttgcataggtgtatattactttatatctgacatttacatagagtattctatttatgtcgacaattaatatttgtaaacaacattggctcttttctctcatgtccggatatttatgttagtaaatatatagattaggaattggcaaactttttctgtaaagggccagataataaatactttagtctttgtgggccatatggttttggtctcagctactgaactcttattgtagcatgaaagcagctatggacaatactgaaatgaataggcatgactgtattccaataaaattttatttacaaaaacttgccactggccatattaagactgcaggccatagtttgccaacccttcatgtaggtatttatgaggtggcttgggaacattagaatactagagcactgagtataatgttcatttgtaattttattcctgtgtccttaattaggcatttttgtaaaattgagtttagattttaggtaactaaaaggttatttcctacattttcttagtgaaactttaaaaaaaagagtgagagtatttttcactagagtccaattatctcgcaggtaaaatttattgtgctttaaaactaaagatatactctgtcaacacaatattaattttatgaagatgtatgtttatgatacttgaaatattttctaaagatttccaaaatggcagcattaagatatataattttgcatctgaagatactttgagatacttaactttatgcaagtaaatgttagaacttgaaaatttttcagtttctttcaggggaaaaacttatggaactcttttatattttgcattgtttttagcatatgctgtggaatt

SEQ ID NO: 89126 - DNA, 1449 bp, Homo sapiens
taataagtgttcattaaatgttagctgtcattttaaacaatattatttaaaataatttgtagattaatgatacaatttttataaaattttagtgtattggtttgtatctgaggatgtgaaatacatgtgtatatgtatgaatgttctatatatatagaatatttgtaaaattacattattcagaattgacagattaaaacaatgttttccttatagttaagtatttaaaaattatttttttcagtctacctaattgtgtgtcactatagacagtgacagtgctcatcacatctctatattaccatggctcctagcctggggtgttgtacctaataagtactcaataaatttgatccttgacttactcttcaaaagaaaattctttttttttttttttgaccactgacttaagataaaattaagtattaaccatctcattggagaaaagaatgccaataatataaaatatggtaatttgggaggtttttacatgtgtttaaaataaaggatgttattttcatagaatatctattagaatataaaactcaaaatgggaagaaataatgtgctaatgataagtgtttgttatatgcccttgcaaaacacttgcaaaaatatattctaggtaattaagacatcagtagggtctttgcatatgtattatcacgctttgtagtgcgtcttaacatcaaaattgtttatgtaaaagatgaagaataaccttaaagtctgtagtaatgtatgataccattgtttgcagaaaatggttgtagaagatgcattttataatgctatttcactctgcagtacaaatttttagaacatattttggggtaaccttttgagtttgcttctcttagtttcattagtatctcaagagataatatacattgccagtgtagcataatttcattatcctaagaaggaaaataatatacttcctaaacaatcagaattgaagtcatagtcataattttttttttctttaatggataaggcttcgaggaaaattatgaaatgtattgtgctttagtagtgttagctgactgcattctctctgtggtttaggcttgatcatgaatgatgttgggatcctctgagggagagaagtgacagtaaaagaagggtagtaattgagctctttgggattggaactgctcacagtcccaaaagataaagcacaagtggcatggtcttttctatctagggcttaagctacaattactttgctttcctttagagcaaggtttagtgttttgttatgtatctttttggatttttttttcttttggctattgtggttttgctttctttttgtttctaatattataggttttagttatatagttaccttctgttaagacaagaggtctttagacagtgttggagaagaaaaggcaaaaccttcatttactgaaaatgaattacataaatgtccgatcaggttac

SEQ ID NO: 89127 - DNA, 1848 bp, Homo sapiens
gtgatggccaaataacaatgtgtatctattaagtgtgccaaagagaattgtgttcacaaaatggaaaggcatacagtaactggccatttttaaatgtaggaggaagagaacaactgataatacaggaatggacattacatttagaacatcgaagtaaagaataatgcctccctctcctcctacaagattaaaaatgggggattggagcgaaactaaccgtttgctttctccaccaaaatatccctaagaagggacccaggtgtggcagaccacctcatatctgtttttccttttgcccttttgtgaactctgaaggttagtcagtggttttcttcaaaattgcattaggaaatttgccaagggcatccttttgaggcagctgtctctgtacccttggaggccatcagtaatgtttccaatctatagcagtagtcggcacaaaaatgttgaactgttgtcttcatgttttaaaacattcctctgctgccactatcctccaccccgaaatagtgtaaaatatggcacattttgggacttagagtcctttcatcattttttgttactgtacatttttaggtaaaatccatcattaataagtgtatccaatacatcaataatgaaaggacatttaatttttttcacataatttagataataatagacacattagaaatgcttaatatataaataaatgagaattttttgtatagaatgttaacattttaattttcactactgagattttataaagtaaatatgctttaaagttttgggggttattaactatgttcatgatgaaaatgcattagaagaattcgaaatgcatttgtgtttttgttcttactgcaatttagtaacataagcaactcttttaccctatgcatctttcgtatattagtctgtttctcttgttttactaaactgtcttctttcagccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctggtaagtttttctcctctaagacattaacaccagagttgcttagcaactgaaacgacatgggggctcaagggatactagattgttgatgacaaaactgctttgaatgcccccgagtacaagctctcttagagtttgttagctacagagctacgtgacctgtattcagtgtttatcaggctgcccttgggctttgatgtagctgacacacaccattcctctgatgaacagaactggctaaatttagtctgtctgaaactgcaatacagttggctttagaagctttttggaaaaaaaggcgttgcaccatggcttaagaattaaagtctgtttaaaaaagatattataacatttccctgagtttttatttacttaaatattgattgatctcagaaacagtatcactgggaaaaacacatggggaaagaaaacagtctctgaagtgctggtgtatttagtatttccttattgatattgaagctgaatctaaatttttttaatacataggtttatagcataacataaatattggaattgattttaaagcaaaaattaaaggctgaaaaataatgtaaacttccttacattatttatacactgagccattctcttttctatttgtcaattttaagtgtagggtcactaggttgatatgttttaagacattggatgctgatttagttacctttggctggtttgaaattttaatcatacaagtatctttacactattttgtttttgtaacagtagcatcaacccatg

SEQ ID NO: 89128 - DNA, 1079 bp, Homo sapiens
ttcttgaggaactgtcaaactgttttccacagtggctgtacccttttacatttccaccagcatatatgagagttgcaatttctatacattgttcacaacacttgttatttttctggacttttaatttttatgttattgcagctatcaaagtgggtgttggtcatttatttttgttttttagaaagccttgcaatttttaagagtgttagaccttgtggttgaacaattatagaagctctagtttgtgttactttgctccaaagagaattaagttttcctttggtatgtgaagtactaggaggttaccttgaatctattaaaggttggttataagactttttagggctgatctatttcaatttcgaccttactcttaaggagtagctggcccttctgtagtctcaacagagagttggagttatttatgaaggctcctctaacttggtggggcctacactccagtctttgtctccatatcagtgagcagcagctggaatctctgctgagctctttagcctcctacctgctatttcgactagttttcttgaatgtttcccctcttgtggtcctttctctctggaaatttattctttagtttccagctctttgatagtcaaaaattctgactcttttttttccttagtccaattggactgcactttctacttgagctgtatttccctgttactcagcaaactcaaggaaaaagccaagataattgtggagctggtcttatatgcttccgttctttcaggagttgtagccccttctgttcctctttgtgtaagtcactctttagtggcttcaaacagtttttactttttgtctagattttatgagttttatttagctgagggttagtttgatacaagttattctagcatggtggtaacagtaatgatgttttattagttgaattacaagaaaatgacctcactattaagagtgagaacatgaatttttaacagaaaatttggacaagaatagaggaaggaggatttctgttttcagacagaagagggttaaggtagccaggtttgaaggatgataaataaggatgattaaaagttagataatat

SEQ ID NO: 89129 - DNA, 1114 bp, Homo sapiens
gtcagcttcatttgatactgtttaacatgaatgatttttataatatgagaaagataatacttattatatattttattagaatgctgtaaaacagttcatggtgtccaacatgtaaaggtactcagtgaatattggcgatgatgacgataataaagatataggtacacattggaggatatcaatggaaaggggcattagattctggagtatttgaagtagaactaacaggattcagttactgagtagatataaagtgtagaagagagtgtttggagactcaactgatggtgatgccatccactaagttgagtacataaaagcatgtcttcattttaaaaggctgaaagctgattggaattccttatcttgtttttacttaattcattgtgagtactgcgtttgaaatatccccagtttagccaaatatacttcgtgaattttaaatttatttaaatatatacttaaaatttttgtaagtatctttacaaagatatctgtacaaaaaataaaagtctgacctgttaaataaaaattgattgaggctatgtagtcttacattttatatattgtttgaaattaagttgcattttttttggtaacatcatatttgacattctgagcagagcccttgggtagcatgtgattagctgtttcttccacacgctttagtaaagatgataatattagtcttcaggttcagcaactgtcctggcaaagcatctgttaaggtacttctctgactaacatttggtcttacagagtttcctttttacaggtgtgattcaagtaaggtgaaggaacacatgcttagagctgtggaacattttgaagattagcaggttgtattacatttgtaacatttactaaatttttagcataggtaactttgttatggttagaacaccaaggactacaaaaagccatacaaaaacctactgtcacttctgtcttctacctgctttttatgcaataaaagccaatataaatatataccttgctgttttctacacaagtagaacttgccgtgtaccctgttctgtaccttgttttttaattacagtaaaaaaaagaaagcatctatattctcatttaaagttatagaaataacttttct

SEQ ID NO: 89130 - DNA, 1636 bp, Homo sapiens
ttgatatctttacaaaattgagttttccaaatcgtgagcattgcatatattttcatttatttagttctttaatgtctgtcaatgaagttttatgatttttccctgtagatggtttgcacatctctcattgggcttattgctagatatttaatactttatattttttgaggccattttaaatcgaatctttgtcttttaagttttattttctagctgcatttgctgtttacatggaaatgcaattaatttgaatctcacattcttgttcagctcttgcttctgagtttttctgtagatgctttcagttttctgtattcatgatcatatcatttgtgaataatcagttttgtttctttcttgtcaatccttacaccttttatttctttttcttgccttacttctctggctatgacctccattacattcctgaatagaagtggtgatagaggacatccttgtcttgttcctgatctcaaagggaaagctttcactgtttgaccattaagtatgatgtttgctgtagtgtttcatagataacttgtcagattaaggaagctcctttctgtttctgatgtgctaagtaaaaatttatatgttgaatggatgttaaattttatcaagtacttttattgcatcgaatgagatgattataagactttttcttctttaatctgttaatgtggtaaaatatactgatatacttttaatgctcagtcagtcttgcattcttgtaattaacctacttgttgatgacccacttggtcatgatgtttttaaagaaattgcgatattcagtttgttaaaattttggttaggatttttgcatctttgtttgtgagtgtgattgacctgtaatttttctttcttataatgccttcgtctggtttttattttgaggctatgctagctttataaaaggagctggagaattttctactttttcttatccagaagaatttacataatatttctatttctttgttaaatgattggtacaattctttagaaaagccatctgaatctgaagttttctttgcaaggaagtttttatttacttacttctttaattgttataggacaatttctatattttataaattgcctattttggtaagttgtggtttttagcattttaataaatttgaacattaattagcatgaaaataaagtaaaagctcttgaaataatcttattttcctaatgtcaacactgtctgtagtgataattttctttttaatgtcattatttgtgacttctgctttgaaatattttttgatcattcttgccagatgtttattatgggttttttaagtcttttcaaagaatcaacttttggttttgattgtgctctgttgcagcatttttcaaaccttttggtctcagaaccctgttacattcttaaaaattactgaggacttaaaagaacttgatgtaggttatattgttaatataaattataaatttttctcagttgtgaaattaaaacaaatctaaaaaatttgttaaaaataataaacttattgcatgttaatataaataacattctttaaaggaaaaataactatctttgtgagatgaatggcatcatgttacgtttttgcaagtttctgttaaatgtctggcttaatagaagaca

SEQ ID NO: 89131 - DNA, 1143 bp, Homo sapiens
accatattcttactacccaaagacttttcagtggtagtacctttgtgtatgttgctttatcaacgctctctgcagacacacacaaattcaaatattacactcatgagtcagtggtctgaatcacttgtggagcgcatgtgcctggaccatcttcctttaaattctggtaacacacgtgagaatgtgttactgattcactgtgatgtttaatttgagcattttctaaatcaacctatgtttgcttaaatcatttcttattttttgcattttagggtgagtccaaactattccagagttgcataaatttcaaacaacaaaaaaaattagtgtcgatcattcatcgtaatttaaaagagttgtttaaatctgtagtttggaagataacttttattctataaagtgcattcccgttgtctaataaatattcatagcttctaggtaaggtttattttataaaatgaaattacttccagcttaattttgtaattatgtcaacaaatagagtgtccattttactttattcaaagtaattgatgagttactcttagtggcctctgtgggaggtgaactggctcttttaataggttaataatcatgagtatttgagaatatttgtcatatttaccaggacagtaccatcatcaaaaataaaatactaaatatattttataacagcccttagcttatatactcctttttttcctcatatcaacatatactctttttttttgttttgtttttcaagacataatctcactcttttgcccaggctggagtgcaagtggtatgataatggctcactgcagcctcaacctcctgttctcaagtgatcctcccaccttagcctcctaagtagcagggactacaggtgcgtgccaccatgctcagctaatttttcactttttcgtagggatagggtctcactttgttgcccaggcttgtcttgaactcctaggcttaagcgatcctcctgcctcagcctcccaaagtgctgggattacaggtgtgagccactgtgcccagcacaacatatactgttttaggaataaaacattaagaaagtaaactgtttcagtgagaaacgtaactatatatagaataaaaatattcaaagtttctgaggaaaatatatttaatatcatt

SEQ ID NO: 89132 - DNA, 1025 bp, Homo sapiens
gaagtaccactgacgtgatattgtgtccttcacagtgcatcctcagtagccatatgttagtagtttgtcccaatattggtgataactttgatgacttagttaaggtggtatcttaactaaggtggtatcataactttatggtttgttcaccataaagttgctatttcttgtaattcatatgtatctaataccttgaggcacatttacattgtttctcatcatacttcaacacactaattttagcatccactaaaaatccaatgatttgcctaaaatagttatcactttaagtggttaccaaatgatgactaaatctatcattccttttacttttacttaagtcctactgtgaggaagaaatttgttcttttcctattccttcattcttcacttatttatctctaaatggacttaaacattattactgtattctctaggttataatctcttactttattatttattttctttaattcttccagatctggccagtgggagcccctcaagctggcttcttgatatgtcttcattattttttgaacatttacttattttcttataccacaaaatgttctaggctcatcctggtttttttttcctgtgcaggtgggtagtcacccgtttctccaagccctggttctttttttggagaatgatgtttagaaactaagatctgagtgctaggttatcttactgttcaatctcttgtatgttttgcattttatatgattgtttccattacatatattattgcttagatgaatcttgtgcatatatttgagaatgttctttaaaaaattaactagctgatctacttctttggtttaactgtggatagtaaggagatcaattcctcaagtcagccatggaatgttaaagcttagaggcacttattagaatacaatcatgcgctacctaatgctcttttggtcaacaatagaccgaaagattataataccatatttgtactataatacccataagattataataccatcttcctactgcaccttttctatttggat

SEQ ID NO: 89133 - DNA, 1020 bp, Homo sapiens
atatttttacaagagatttaaacagtacgtaatgaaattttatgcaagagagctgctgatacactaatgttgctttaaattatatttgttattaaaatgaattttaaaataatttgtaacagcgggtagcaacattaacaaagtcattttaaggaaattttgttttttttgtgtttccatgtttgcttaatgatttatgatagtaatgattgtttgcaggggacagtattttgttaagggatacgctttagagttcttgtacaagcagtatttactaatgccctccctttctgaattttctagttttttattttacttgatgcactagttttatgctaaaccttttctaattctgtttcagatgttggatgacaataaccatcttattcagtgtataatggactctcagaataaaggaaagacctcagagtgttctcagtaagattgataagaaactttttttttattcagttttttgtattggttaattttttactttttactaacagctttattgagatataattcacataccatacaattcacctattttaatgtgtacaattcaatgttttttagtatattcatagagttgtgctggtattacgtgagtcagttttacagcatctttaacatccccaaaagacactgggtatcctttggcagtcactatcccccacccctcaacccgtgacaaccactaatctactctctgtgtgaatttgcctgttgtgacatttcatataaatggattgatatactatgtggtcggttttgactcacatttttcacttagtgtaatacttccgaggttcatccatgttgaaccatgtttcagtacctcattcctttttataggcaagtatttttttccgttatgcagctgtaccacattttatttatccatcggtgatggccatttgtgttgtttgtacttttgactaattttgaataatactgctatgaacatttgtgtacaagcttttgtatgacttgttaatttataaaagaaaactttct

SEQ ID NO: 89134 - DNA, 1064 bp, Homo sapiens
aatgtgcaggtcattggtgacctttacaagaacagtttggatggagtgatggtgatgaaagcatgactggagtggatttagaagaaaaaggctcatacctgtaatcccagcactttgggaggccaaggtgggaggatcacttgaggccaggagctcaagaccagcctgggcaacatagtgaggccttgtctctacaaaattaaaaatagataaataataaaagaaaaggggagagggacgatcaagaatcattaaggggtgccaaaaccatcaagtgaaagatggctgggaaaaggatattcacgtggtgccacatattacttgttaatcacaaagttgtggcggacaccaccatcaccatcaaacttagcatctcctataagaggataaactggcattatatgcgtcctgctgtgatgcaatggaaaagaaataacatgaccttagtagtattattgtcattggatttaacctaaatctgattgagggaacaatcagctaaatctcagttgtaaagcattctacaggatatttcaaaaatgttaatgttaatgaaaaacaaaataaaggcatggaaacttttctagtttaaaggacactaaagaatttatgcaatccaagatttttgactgtatactggatgtgggaaaaacagatgcaaaggacattttgaggacaaccagagacacttaaatatggattgtatattagataatgttgtgtctgttttaaattttcgggatgtgattattataatgtaattatataagagaacaactttgtgggtttttgttgaggggggagggttgttggagtttttggtttttttgttttgttttgttttgttttgttttttgagacggaatctctctctgtcacccaggctggagtgcaatggtaccatctcggcttactgcagcctccacctcccaggttcaagcgattcttctgcctcagcctcccaagtagctgggattacaggtgcctgccaccatgccaagttaatttttaggagagacggggtttcacgctgttggcaggctgctctggaactcctgacctca

SEQ ID NO: 89135 - DNA, 1046 bp, Homo sapiens
actatacgccattttaatttttacaatgtcaattctaactgcgaattttagcaacgcttcagtgtgaagacagcagagaaaaacactgaaaatgcgtgattgaattcttattgagtcactcttctcggaaatcagtcctccccattttctccttaaaaaatagaatcctggagatagtctagtgctggcttttcgaggaacacactacaggggacacaaggagaggaacacggatgccgcagttttccaagtgcagcttgcccctcccacgtgataggtttctggcatcgcccctccttgctggcgattctggggaagattttaacgctccctggagccgtccccagtgacgtcacgggcgcggctccgctccttggccaatcacgcggccggatcccggggaaacccggggcggtggcggcggcctgggcgcgtgcgcgaggtctccgcgtggctatataaacatggctggcgtggccgcgcggcggggccgtgccaatcgcgcgtagggggctgtgggcactcggggttcgtagttttgaaatttctggcgggggagcagctgcgcagttaggctcgaggtgtgagcgacgaccttccgggagccgcaagtccaggctcccccgcagcgggacccgagcctgaggcgcagggctgaggcagcgcacgtgtgagcgccgctgaggaagctgcgagaggtcgggcgggtgtcgctccgggggcagcccaggctcgcgcggacgagaggaaggtccgggacgcgcgtgtcctgccgtgcagcgggcgcccgtcactgacttcgctgctgcggcccccgcgcctctccccagcgatgctgtggaacccgaaccgcaccggagtcggctgccgcgcgccaagcctcccctcacctctgctcccggaaccgcagcgccaaagctgccgctgagcccctgggggatgcccgccggcctcaccgaacccgccggcgccgctcccccggctgctgtgagcgcctcggggaccgtgaccatggccccggccggggcgctgccggtgcgggtgga

SEQ ID NO: 89136 - DNA, 1058 bp, Homo sapiens
tttcttcaggagcatctcattatattcatagattttaaatttttaaatagcttggagtaaaaacatttgttcatctttgtatataagtagcagacatgaaattcagtatgtattgaagacatctttttaaagtgttgaaagaaatgggagaagaaaatatgtgatggttatgctgtatttagtggctcagaggtcacttttttttcttttttaaatataggaaccgttttgattaaaagtaacagtggtccgttgatgttggtatctcctcagcaaactgtaacaagagccgagaccacaagtaacataacctcaaggccagcagtaccagcgaatcctcaaacagtcaaaatctgtacagtgccggtaatataccttaaatatttttcatctttctttgtttctcagctataattttcatataaatgttgtgtatatgtttgctagtaaaaaataatgtaagacatgattctattcagctttttaggtcagcttgccttgaatatgtcaatttaataaagatttttggttttgtcctctgataattgccaaaatagtaaattcagtcttcagattttatgtcctcaaaggaatgttcagagggctatctgcatcttttttgagacaggatctcactctctctcccaggctggagtacaattgcgtgaacatggctcacttggttcactgcagcctcaagctcccgagctcagataatcctcctgcctcaggctcgcatatagctgggaccacaactgcataccaccatgcccgactaattttattttttgcacaggtagcatgtcgctttgttgctcaggctggtcttgaattcttgggctcatgacagtcctcttagcctcccaaagtgctgggattataggtgtgagccactgcacctggcctatttgcatcttaaatggaaagaatataataattctgcctcccgagtagctgggattacaggcgcccactgccatgcctagctaatttttgtgtttatttagtagagacacggttttgccatgctagccaggctggttttgaactcctgactt

SEQ ID NO: 89137 - DNA, 1101 bp, Homo sapiens
aaataattgaaatttgtatgtttcctcgtgtttgtagttattttaaaatgctcatgttaatctgtcattgatatttttgtgtggaccatttatttttcttagctaatttaggttgatgcatattttaagttgggctactccttagtggtagcctagaacagtggaaattagtaaagaatgaagttaatgatatctgtccactttaagggataagcatctcagttttaggcatggaaataaggagctagaacttaaaaatgagagaagatacaactccttgtacttgattgtcagactgtaaatgcaaatgtgtgtgttaagaaattttgaaagtattttcctattaggcttagtctgataaatataacacaagaactagttagaaatcttgtgttcacttttaccttgtatttgatgaagatgtagtttggcccattgttagattggaatctaatgtgcaaatgactagtatttctaattaaatgtgaataaacctaaagcaattgctgtttcagacaggtacagaaaatgaccctccttgaaatgctatttcatcttctaaatttccatacaactcattttattggctctgtgtagaattggttttcacacatttatttcacatatacttcagtccgttttcctcctgtcctcaagacatgcctagtcagtcagtgcagccttgaaaagcattgaagttaccattggctggtctgttgagtcaaaggcggagttgtgattgagtttaagacactttgggccaggcatggtgagtcacacctgtaatcccagcactttgggaggcctaggcaggtggatcacctgaggtcaggagtttgagaccagcttggccaacatgttgaaaccctgtctctactaaacattcaaaaatgagccgggtggtgtggtggggggcggctctcatcccagctactcaggaggctgaggcaggagaatcacttgaacccaggaggcggagattgcagtgagccgagatcgcaccactgcactccagcctggtggacagagccagactccgtctcaaaaaaaaaaaaaaaaagacacttttaagggtgagggggaatggaatttattaggcga

SEQ ID NO: 89138 - DNA, 1755 bp, Homo sapiens
ccccaaacccatgttagggccaccatgtgtccccactcctctccttctatcaattctcagcattttaaatgttcttcctgtttgtaaagaaaatttttttctagagacagggtcttgttaggttacccagactggtctcgaactcctgtcctcaagcaatcctcctggctcagccttccaaagtgctggtattgtaagtgtgagccactgcacttgtccttcttcccattttttaccctcagaacattcttgtctagtacatattccagtctctctaatgtgggagattttattgtacattcaaattcacctatcttgactattatagaaggaaattttcttgaaggtgattgcaacttgacctttttgtgttgcatgcttgtagaacatagacatttaaattaaatgatggtgcattgttcagttttctgtgtgaattgtatgtaaatactattccttatccctgatccccaaacttttattatgttctgtaacttttagtgtttgtctttaagattgttgctttatctcaatgtgattttctaaattactgcctgacttgtgattgcttgtatgaggtttttgtcctgtaggtgatgctagctagagtcacacctcattttgatagaaggtagagaaacaactgaaattcttttcagtgtgaatataagataccacgttttataatattcttcatgcttactttaatggtctacataaaagcagtttatctaaattttagataataagtagattgctctgctttgttcttaagaaaaagcagaatattctatgttctcataaagactttcagatacttcttggagtattaataatattttttgaggacttatttgctttagcactgtttttcacaaaaaatcctaggacagcaggtaccgttgcaatccctatttttgcagagagtaatcaggattagcaagattaagtaacttgcctgcagtcaacacttggtaggtggtaatgaaatagtagatggggtgagaatgaaacccagatctgctagactcaagagttcctagaactgtattatattgccttagactactagagcataacataaaaccacagatgtcaaaattaacttgtctgatgagtgtgaaatgaggcacccactaatgtatcatagtaatacatgcctaaatatttaatacctttaatttcagtctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccggtaagctcttacttgcaccttacataaatcttgttccttgcaagttcttttgaattgtttgctcactaacacttgtgtttgcttatatttacattttcatatttagacaatgctagaaaatgtgaagaaatgcaagaacttccttgcaatgttaataaaactagcatgtagtggatcacagtccccagaaatggggcaaaatgtgaagaagctggtggaacaacttttggtaagtagtgctataaaatcctgcaaattctggaggaatccatataacatgttgtaattgggaaatgcatatttttaaatgggatttatttaatttatttatttatttaatttatgttttgagacagagtctcgctctgttgcccaagctggagtgcagtggcgtgatctaggctga

SEQ ID NO: 89139 - DNA, 1054 bp, Homo sapiens
gctaattttttgattttttttgtagagacagggtcttgctatgttgctcaggctgatctcaaactcctgagctcaagtaatcatcccaccttggcctggcgaagtgctaggattacgggcatgagccaccgtgcccagcttgtttattaacaaataacagtaaacccattaaatgttaacacaactgacatttaagtgaaaaccgagtttcaaaacaacaacagaattgaatgagaagagtggcattgctgtaccaattttgcaaatctctttagtggctgacctaatggaaaacagctggattctcatatcttctgcatttaatctgttttgtgatatgttatttttttgggagtatttggagaatatctggtcttgtgaagagaggtggttggaatagtgattatttttttaaaaatagcttttctccagatcatggtggatattctttagagtctactggtttatcctgcatgctgaatggatcttttacccacgtatgatttttgtaatgacattcattgttcattgggaaaatactggttcactgagttatgcagatctttcaaatgtttccagatttattatttaagatatcaaaataacatgctcattaaattcaccaaccttattagaaaattcttgtaccaggaagctatcaagctcagaatagttgttacacatttttcaaaattgtaattttggctggagagctttaatttttatcattagcaacaaatgctatccattgttttctttactgttagtggtttagtttgttgttgagaaaatatctaacaaatacccaagtctgaataaccacaattgctttgccattcttttcagtaaaaatggaaaaaagtggctagtttagcgactcaattacagtgcttttccttgatcctctgactttgatctgcaacaaaaatgctccatgtatgtttcctattttgttatatacaatattaaagaggtatctactgaagagttgagatttagtaaagttaatttttactgcttcatccaaggatgtttcaaagtgaaattgggtcta

SEQ ID NO: 89140 - DNA, 1047 bp, Homo sapiens
agcttcatccagcaatgtgttcagcagacttctagtgacatggtcattgctacctgtactacaacagtaacaacttctcctgtggtgacaactacagtgtcctcaagccagtctgaaaagtcaattattgtttctggagcaacagcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgtttcttctgctgggaccacatctgacaagcctgttattgggactccagttcaaatcaaacttgcccagccgggccctgtcctttcacaaccagctgggattccacaggcagttcaagtcaagcaactagtgagtaacattttgtttcttccccagttacttattttgaaaattttgaacattcagaaaactggtaagactagtagaaaactagtaaggctatatactgtttacgggtttgaccaattaatttttttttttttttacctcatttgctttgttttcctctttctactcacacccacaaacacacatataagtcctttttttaaagacagagtcttactctgtcgcccaggctggagtgcagtggcacgatctcggctcactgtaacctccacctcccaggttcaagcatttctcatgccttaccctcctgagtagctggaattacaggtgtgcaccaccacgcctttctaatttttgtatttttgttagagatggagtttctccatgttggccaggctagtcttgaactcctggccttaaatgatccacccgccttggcctcccaaagcactgggattacagacaggcaat

SEQ ID NO: 89141 - DNA, 1021 bp, Homo sapiens
tgtcatataacactggtaagatgcttcttattacatatagtgacaaggatgctatgagggaattttagtatttctttcctctccctcttctttacccttaaatatatatactcatcttagtgctgtggccacgtaacaattccattagataaaaacaactgtttaattttgctgatacaaagcaaggagcccagacatcttttgtattttttatgcacatgtatgtatgtgtgtgtgtatatgtacatgagtgtgttttatattttatatataggccatttttgggtaattgctgaggatgtggtttaacgaattcagttggtatagatggagcacaccaaaagtctgaaacagaaaaacaaaactagttttataccatttggttttagaatggctagtctagtaagcttcttcccaagggtctttatgtggatatggacctttcaggaccagataatttctgctgcccttaagtggaatgaatggtagagtacactggggacagctgatggacttttaaccatcttggatgaaaagaaagatgtctgttttcatttctttgtctttcattgcagaggatttatggatgacttggtgtaactccaaatgcctcttggtgtttcttatttgccagactgagagagggaaagttgggacctagaagacaaagttacttctgattcatccttctgttattaaatatacattggtggttagagacactaattactttcaaaagcttaaagggaaaggtagccattcttcacttctcttgattggatgaattaagtaaaataatgccgttagttacaaggagagacctctaattcttttgctctctgaaactctctctctctctctctctctctctctctctctctctctctctctctctgtctctctctctctctcacacacacacacacacacacacacacacacaacctaaaatgtataacttttttttttttctattagagatgaggatgacatcaatgatgtgacttctatggcaggggtc

SEQ ID NO: 89142 - DNA, 1026 bp, Homo sapiens
attactaaccatagtccttatgttctacattagatctttccacttgttcatcctctgttccttttaataagttaaatgattgcattgagtgctcatattgatgctactaagtgttattggctacttttattaaaaaaactaaatacaggaatagcttgtatccctagtggtatgaaccaaatgacttgctgttatcaaggtaaaataacttgatgtagttttggaggagggcgaatatattgggtgattagggatgaaaagagaaggtaacctgagttgaaaataaataaataaataagataactgtttccctctttccaagaaatgtttatagctagattttgaacaagatggtatgtaggtaaccttaagagattttgaatttggaagaatggtcattgccgtgatatcctagtcaaaggttaaaggaaactaggaaattgtcagctactacaccaccagtaagttccctggaggaatcatattattttatttttttttcctttccatttagaactttggaaaaactacatatgattgccaaggtcctcacttgcataaatctttgtgagaatttgctggactgacttaggaatatgtgatcaacaggagaaaaagctatgaaaaaaacaaaaaattaatatcagtattttataattcctagaaacacacaaaaataaataaagatattaattttgtgtttctaggaattttttcatttctcctaggttatctaatttgttggcataggactgttaataatactgtcttgtaaccttttatttctgtaaggtcaatggtaatgatcccccttacattactgatttttgttatttgcatcttctctctttttcttctttgctagtaaagcgaatggtgtgttgattttgttgagcttttcaaataaccaacttttggttttattaattttctgtttttctatttttgatttcgtgtatctccactctagtttttatattattttccttctaagcttcaggcttagtttgctcttcttttttttta

SEQ ID NO: 89143 - DNA, 1166 bp, Homo sapiens
ggtatattttttagtgaggtgattgtttcttgctttttgtctttcagaaaactaagatttaattacttatattaatgtctgctgaggtagataataatctaaaaagattttggttattggtgaatggggcactctttagtttctccttcctattgttggaaggatctgcttggcttaattcctcccccttcaccccacaatgatgtttactagcaaagttctttgaaacataactggttaatcatctctcaaattttaagaatgattaaagtttcttttctggtggagtggatgtagggggatgtttgcttaatagaaacaaaatcattaccttctgaaagttcagcttcctatttatgttggtattcctgcctttagcaggtttatacaatacctaatgtagaatgtgtggcccaggatcattataagactttctgttttcttttttttcccaggcaagtgaaaattacatcctgtgtagtgataccaggtcacagctcaaatttcttgaaaagctggatcaattggagaagcagagaaaggatttggaagaaagagaaatgttacttaaggcagccaaggtaagggccagtgtgatttatgagtgaatgtggcctggcagtgtggtcagaggtggctttatcgttggttgactgtcttggttttattaggcctttagatttctccagaggatttcctaaaacgaaattactaataggatgtctcacagccaggatggtgtggtggctttcagttaatttagtttaatgagtcataatcttttgtcttctcacatttcctgtgtgctctccccatcctcaaacccaggtaaaatgtttcgtaaaatttcagggtctttttaggaatccaatttgatacatgccaagttgaagttgatagggaaaatttggaaagtagacaggaaggttatgggtaaaattagtaatttggattttgtggaacaaaatacaggctgggtggaaatagagtaaaagaatagcgaggcttctttatttaattttatttttggagacagagtcttgcactgtcacccaggctggaatgcagtggcatgatctcggcttactgcaacctctgcctcctgggtttaagcagttctctgcctcagactcctgagtagctgggactacaggtgcctgccacca

SEQ ID NO: 89144 - DNA, 1892 bp, Homo sapiens
tcgttctaataaagaagatccagaacagctgagattaaagcagaaagccaaagaggtaggactttcaagttaccatgcttgtctttgtgtttgagggaaggttggcagctctctcctggcaattaggtcagggtttattttgctgttgcataccatttgcagaagccttggggaaggacaggaactgctaaaggcaagggcagtacttcaaatgaggtcaatgagttatgtgctctctttttaaaatttattttcaaggcttaggcctgtctcgaaatgggtctttgtaaactacagcagcatacttggaggaatataatgtgagattttaaaaaaaaagaaacttttgagatttagcatctgggactgtacaataggctacatttttccagggtaattgttcgttttgtaaatctgatactgcttataattctttggctgggaggcggtgctgggatttagttttaaatggaaaatgcctctggcttttaattttctgggcccagcagttttctgttctggaatggagcccttgtttcacacagttcatgtttagctgcaggggttttagtttatagcttagactggttaagcttttactcccagaggcctctgcatagcaactgtagaaatcaacaaataagttcatttatgtctgcagcctcctctcagtagctgactttttacatttcccaatatccatttcctgacttttctagccccagagaaaaaagctccactaattggagcttattttaattgagccttaatattggatctcactggagttgcccccagagctgctgagaacagaatgaaatgaaagtacctaaggttgaaggtgcagtgtgtgtatgggtgtgtgtgtgaaatttttcacttgacctacagattcttttccctcctgaataaatcatcaagcctgttcacatttctgattaaggatctgacagcagatgataataaagacaattgaggtgtgagacgtgtgatatggagctgaagaaattggtttctatagttacttcactgatttcatgcaatttttaaggatctttgtgctaaataagagtgattttctgagcaaccttttcccttaactgtgcctcttgaactatgaaatttgttgttgcttaacattgctgcagttggctcctaggtgccagcagcagcaggttatttatgaacgttttaaaggcccttattgtttggattaatgtaggaattgaggcaaaacaagtggaaatctagtaagattcttacaatcaatgtggtgtgttttcattaacatagagaaggaaaatacatgaactctgggtggagggatttcaggattgggacagggaacgatggaaagggagaacactttaaaaaaaaagttgagagcagaaacattttattttcagcaacaagatattccttatactgatgtctttccagtggaaaatgtatctaaaattattagtatgagaactgtacctataattctctttaagcaaacctggcatgaggatagattatttagggatgggcaacctactgttgctctgaatcatgggtatcccaccttgttttaattaaggactgactagatgcttatcttctaattgcattccctttttggaaaatgtgcaacagaaagcttacccttttaaccttaccctgtctgttcttccttcataaaccttcataagcatctgaatcttagattaattcttccttcagctttgtatgggatgttttgtttttgtttgcattttattttagtatgttgtttaataattccgtaagggatgaataggtagacaacatttttcaaagaaatctgtgagaggaaatgtaccaaaaaaatgcctctgttaatgagaacaggtggtagcaaacctgtgttt

SEQ ID NO: 89145 - DNA, 1009 bp, Homo sapiens
ataatcgtatcatttgccatcctgtttccacaggcaagcctctaactcagtggccatttttattgaactgaggttacttattgtagtctttatcctcgataaatgccagatttgcattaatgctcagaacttcctccttttctggttaaaagtacctggttttactgttttgtgcttgtcaagatgcattggttttgagaaagcttgttataaatacagggccaatgaaaactatggtcagtttccatttttgttagatttttgtgaaattttctaaaattttgtgtgagagacttcagaaaaccaaagtataatttgcagaatgggagaaaatgttacactacacatagggaatttgaagacagtggtcagtttaaaaaccttttatttggtttgactatcttgcagatgccatttctctacagggaaggactttaaaatatagcttgttgtttgatttgtactgcagggtagattaactaaaatcattattttgtcacctagaagttctgaattgtggcagcattagactctaaaactatattttttattaaaaaggccagcagcaacaagagatattttataacttctgaaaacacttttctaacaatttatttgtaagtaaacacacagtttaaaaggatttctgtcctataatttgtgaagcaagtggaaaatggttcttagttcattttctttaattaattgttgtcttagttcatttgggctgctataatgaaatatcttagactgggtagcttatacacaacagaattttatttctcacagttatagaggctaggaagtccaagatcaaggtgccagcagatttggtgtctggttagagcctacttgcgcactatgttctcacttggtggaaggggcgaggggtttctcttaagtctcttttataagggcactaagtctccaccctcatgacttaatcacctcccagaggccccatctcctaataacagtcaccctgggtgttaggatttcaacattagaa

SEQ ID NO: 89146 - DNA, 1002 bp, Homo sapiens
ttgatgtcagcagttcccctgtcattactaatttaaagtaaatagccaacagagctcctgaagggtggtgaggctcccctcatgaatagagaaataaggaaatggtaagaattaggggcacaggtctttacctccattctcttctaccgggctacaggggaccacagttttctgaagtgttctttatttacttattatagctgagttattaaatgtttaaacagacttattgtcatctaacactttttataaatatgtgtcgattcagtagaatttagagcatgctgttactttaaatgaagtagcttcttatattttaagattttttttttaacattctgttttgttcacgcttcatgaacaaatctgcctcacttattcataaatgacctaaacataaatctgaatcttagttgggtcttttttgagaattccttatttctcacagctttgataaaatgaatatcctctggacccacatgtgtgatcaggacctacatgataaatccactctagcatcccaatttccccaagcctttggatacaaatatttacaatatacaaataaagttctatcatctatctcaatttcactttcaggccaccttctgatctagctttaagtcaaccaactgaattaactgttaaagccactcctagccttctctctgatctaatgtcttctgtctagtatctctattggtgagtccatatcaataacttcagcctgatccaactttatattccttctaccctgaacctacacccttaggatccattcccacaccatcccctcaggtaactgcaggcaaaatcaggtgcttcgtacctcattctctgggggctgctggaacctgaggctgattataggtatagaagcaatgagaggtggtgaggataggtcctgaggaagatcagtagtcccatgtaaggcaacttccttaagggaagtcaatacaggtgctacaggagattaacctccttcagacagacaggggtaga

SEQ ID NO: 89147 - DNA, 1967 bp, Homo sapiens
agttagctttctttatcatagcagtgctggatttatgccactatagccttttctgccttaacacaaagcatgattagggatgtacgaggggagcccatgatgtaccttgttagcatggtggccatgatagccagccatagatacttgttaaactgaaaattatcagtttattattagcaaaatattgagctcacagaatttaagattcccatgtcttttcctcaagtatttctagtgttacattccactgtcccattaagtatttcagttactgttcttcccagggcaaattgtgtgttaatggtgttttatatgtaatatttgaggctttacatggtatttttttcttcatatcactttaattatagttagcctaatcatgagcttatgctaagaaattttttttaaaaggctgtccagctttaagataatttctatgagctttcaggctcccaggaaacagtttttgaaacactccgtctgcctgcttcttctataatttagagtactattactctccttaagttgtagtattctcacaggaccagttatattgttattattccataatgttgtacctgtctctttctgcctttatgcagctgtttggtttacacttcagtgactatgagaagcatgaattgcctgttacataggattgcctataataagtatcagtcaggtcttagagggttttccaaagtgatcaatgagtgttgattaacaacaaaccaacgtttatgggaaaagtggttggtaactgtattaccttttcatagtttaaatgatggttaatttctctgtgaaatttgtcccagttagatgttcagattttcaattaatgttatccacaataccgagtttacatgaaaaacaatgaatctgcttaggtataccttataatgatatttagtgtaccctatttagcttctgtttatgtatgcatttttctcaagaattccatggaatattgaaggaaaagtaaacataagttgattttgaagtgtttatttgaacttgttttggcttatcaggtgtgtgccaacttttttcatcgagatataattcatgtacaataaattcacttttgtaaagtgtccagtccagctctttttggtatattcagaagactgtgtaatcatccccactatttaatcccagaacattttcattaccctacaaagaaatagcttgtttatttggccattagcagtcatcctctcagttcctgacaaccggtaatctatttttcagtctgtaaggattcacctattctaggcattcatacaaacggaatcgtacaacatgtggccttttgtgtctggcttctttcactgagcataatgttttcatggtctgcctctattgtagcatgtatcagtacttcattcttgtttttgattgaataatattccattgtatgaatatgcattttgttcattcatcagctgaaggacatttggttgtttatactttttgctattataagtaatgctgctatgtacattcatatataacttcttaggtggtcatgtattttcatttctcttgggtatatccctaatgtctgggtcatatggtgactatgtttggtgtttttgggaactgccaaactgctttccatagcaactgcatgatttgacttttccatccacaatgcacaagggttccactttctccacatccttgccaacacttgttattgccttttaaaaattttattactgccattgtaatgtgtgtagaagtagtatctcattgtggttttactttgcattttcctgaagactaatgatgttgagcatcttttcatgtgcttgtagaccatttgtacattgactttctagaaataagttcaatttatcaattttttctttggttacttgtatttagttgtcatatccaaaaaaaccattacttaatccagtgtcacaataatttatgttttcttctaggagttttatagt

SEQ ID NO: 89148 - DNA, 1932 bp, Homo sapiens
catagatgtggaattgccaagacattgtgtctgtctagccagttattttaaaatctcatataaaacaccaaagtactgattttaggaaaactcttagaagatttataaacatatagatacagttttagcataatgtatctaatttatggctaaagaaattgcctctagttaaatgtattgtagttgttttttgttttttaagacagagtctcactctgtcacccaggctggagtgcagtggcatgatcttggctcacttcaacctctgcctcccaagttcaagcagttcttccacctcagtctcccgagtaagtgagcttacagacgcacaccaccatgcctggctcatttttatttattttttgttagaggtggggtttcaccatgttagccaggctggtctcgaactcctgacctcaagcgatttgcttgccttggcctaaatatgttgtagttttaaatgggttactcctgtaaacaacaaaatttccactcactgccaattacatgttttagtaactttcttcctaatatgtactttttattcaattttccaaacaaaactgagcttttggtcccattccgcaaaaatcttatgaagatattttgatggtaataatttacaatagttaaagttacatctgagttacaccatctctgagtgttgatgctagcagagtggcatgctagtgcttcactgccaggcttagctgaagtaccagaggcttacacttgtacaaattgcattcattaccaagaaccctgcagaagtggcgagagactggctctatactgtagatgggctctgggataagtagccgaacaattgggcagctgagaccaatttttttccctcttttagaacgtggactttccaaaattgtttccatggatacttatgaacaagtttaacttaatgagtataaaaatatgactgcgacatcatgtccctcaaaaactgggtagtatctcttaaagaagttttatttgtccgtcagataaagtacccctaagtcatgctgtgaacatgcatggaattaagtttgactgattttgaccatggtgttttggagaccttaagagatttccttcccctccatcagaacaagaaacccaaaaaggtggaaggagtaattaaaatttaattgttataaaaggacagtaacagaaccagattttcttcctatgttatctttccttatgtatgtctttcgggtggataaaagagagttgccagtcctatcgagacgttttgtgaaacaaaggattttgttttgaaacaaaggtaaaaagaattaaaggatttcatttttacaaaattatcttttgagagttctgtgtttttcttttcttccaattaaaagtaatagtatatagacatattggtaattcatattggtaaacatattcagaaaactgtcttaattacaggagtgttgtgttttcatcattttaaaatgacatttagaattcatgttgttctgttttaaaccagtacattcagtttagaaaatattgcggataacctgtgttgttctgtgaactctgctaagctctagaggagacagaaaccatagtccttgtcctcagaaagcttatggtctagtgggtatgtagtggtggcgggagcatatacaaattactatagtacaacgtaaggtaattgccacagtgagatttccttggatgaaggacaggtagacccatttgaaatgggtcttaaaagatgagtagattggcctagaatggcctctttgctaatctctgcctattggcagaggagccatgtggctgcagttaagatgtcttgtaaaggagcaatgggaagtgaggttagagcgaaggaagccagagtgatgggtttatacgtgatatggtggataatatagcacagtggttaagagtgcttactttatttttatttttattttt

SEQ ID NO: 89149 - DNA, 1012 bp, Homo sapiens
tatattttaaaatcttacatttgaataaaaagtaatatagcaataatataaagacactccaagtacaatccaagtatgctaggttagactggaggttgcagttgcttcaggcaagattcataccctgaactgcaccaggcaagcagcttcccaggccagcagcccgtacagtgacaccgggccccccatcagcaccctgcacttggtttaatgctctcatgttgccgctgtgacattctgaacactttttgaacaaggggaccttcgctttcattttgctctagaccccatgaatggcgtagctggtcctgctctgctggttccctgttccctgcagaatgaaatccagatgccctccacgtccatccccactgctgggggaacccctctaggcagacaacatggcccagccgtcgtcaccctgaggtctggcacggtgcctggtaggactcagccagtatctgaggactaaaggaaattttgtaaaacaccataaaaaggcttgttctgtatccagataaaatggaagctctttctatcctctcaaaatatccctttttcaaaccaaactcaatttcctagctaaaagccattatcaaacaccaggctcacctcttggttgtacacgcgggtgtttattaaggccacccataaacttaaaacaccttctttcaaatctgacttctttcatttctttttgtgttattcttgtagtggagcttcagtttttgttaaaggaagtctgtctctaatgtactgtttcagcacaagtttcttttaattgactaactgaacaccccagggtaagtggctgtcccagcctaaggaggatgggctgtaggctcttgaattgtcctggtctcagggcaacttttccagcaagagcaaacacagggcctacggcctacaaaaatgttttaacttaaaattcttttgaaatcagaagaagtgataaatttgattcatatatataatatgtaacatgtaaacccagcctggattatatttgtct

SEQ ID NO: 89150 - DNA, 1081 bp, Homo sapiens
aggatcacaggagcaacagcaaaaataatttgtgattcattggttctcggattggatgctggcaaatggcgaacagttctttggctatggaaaggtctgatttctgaacacctgtcatctcttgtgtaaaacaggcacaaataggtctccttgcaaggttactgggggtattaaatgtgattgtgaaaagcacaccgtggccctgtgcccaacatgtagcattgtcttcatacttaatcttctgccaaacccaggaattgtttcttctcaaattccaaatattttccatttcttgctttcctagccatggaagcagctttacatctggattcttgcctggatgactcccgtctcaggggactcctggcctgcaccttctcctcctttatcttaaataccccagccggtcacaagttccgagacatccttatcattaggagatatctttaagaatttgtcaagactctttgaaacaagccttacaaagtaacttctgtttcagctgctaatacctaaagcaaatgacgctgctcaggtaacactggttttgctgttgaattgaccattgggtattgctttgtttcctcttgggttttggggggcgtatttttgtaggtaattaaatgttcatgtcaaagcaacatccaatttaatgggacccatacgcaaattttagtaatcaaagaaacagagaagaactagttcttcatgcttttcccatagcgtcgggtgctccttccaatttctgggaaagtctcttgcatattatcaacccctcttggataaatccaaggacattaggttgcccatggccatggaatcacaaataactccagttagttttgtagattctggggtgcttcaaacccttcctaccctatgggaccattctctgccccaccctcttggatcccctggttccaccctcacctacctcttccttagtgtcacccagaggataggggggctttttctaagatttcaagggaaagacctgtagtttaaaaatactaatttgtatgtaacaagtgaccttaaaagatataatattatctttctacaatttcagagttcctgcaaa

SEQ ID NO: 89151 - DNA, 1036 bp, Homo sapiens
tcctctgaaaagaaaaggttccacaatgaacaggtgtgggcaccccaccagtggggttctgctgcctcctttttacagcatgagaaggcttagcgactttgggcagcaggtgtgtgcaggagccaggagctcagctctctgaacttccagcctttaggaaattaaaacagggagatgccagcccaacgctgagatattttaatgtcatgccagttcaaagtgaggactcttcttactatctcagtatctccaggcaagctggaggaggagtttggaggcataaattgaaagctaataattttccagcctcttgtttgggacatagtaaacattttaaagctaaaatgtggggtcagctgacaccgtctttttagcagttatttttaattttgggggttttagggagttctaatgtgtcaaatttcctcatcccttatctttcacatcacttcagaaatatgtgtgaattaaggtcaattagcatgtgtcgacatccacctcaaactaaatctctaaattgtcttcgtataaatcttgaagaggtagtaatttcagcttaagtggcaattaaaaagcaaggattatacttaataacctctgtgggggtacctgaggtcttctgttgtagagtcttgacaaatactgttagtcatcaataatttagggggctatcgtctgacttccatttagttttacatggttatgcaggctccagttctctctggggagatggcagaaagaaaatagccagcacatgtgtgtgtggaagctggtcactgtgcttaccaggtgcttctcagctgtggccctgagcaagccacccagtcaccctgagcctcagtttcccttttctcagaaatgatcatgaaccagatcttttccagccctgaattcatttgctattcattatcaaaatgctaatatgcaaaatctattttagagctactaactcaaatatagtcctgtgttacgggattaacattaatttagttaagtgtattgtgagatttgacattgaggacatattcatgctaat

SEQ ID NO: 89152 - DNA, 2337 bp, Homo sapiens
ttaacacacagctcaaacaattctaatactaatatgaccacacttcgagaaacactgcctcaaagctcatacattaagcaataaaataatttcctctctagcaatcattctggggcggtgaattcacttgaaaattgaatgcaagttgtgaaacctcttcagaagatgcacacacacacatacacacaccaattttgcctaccatttcagcagagattggagtgaagcctgcattcttgaagctctgcagctacctggtctccaataccactttaatacatatcctcccctggtcaaaacatcatcttggctcctttcttactttagtttcaagtccaaactccccatagtcttgccacagtctaatttcctgacattctctgtttcatctccctgatatgagtccagctctctgttggggacaactccagagagttctggagagctcagacatcgggagaacatttggctgggaggccccaggacagtgatcatggaacttgcgtgtgtttccaaatcacccggaaggcttgttgaagcagggtgcctacatttctcaaaagaagacatacaaatggcaaacaggcacatgaaaatgtgctcaacatcactgatcatcaagagaaatataaatcaaaactacaatgagatatcatctcaccccagttaaaatggcttacacccaaaagacaggcaataacaaatgctggcgaggatgtggagaagagggaatgcttgtatgctgttggtgggaatgtaaattagtacaaccactatggagaatagtttggaggttcctcaaaaaactaaaaatagagcttccatacaatccagcaatcccactgctggatatatacccaaaagataggaaatcagtatatagaagaaatatctgtactcccatgtttgttgcagcactgttgacaatagctaagatttggaagcaacctaagtgtccatcaacagatgaatagataaagaaaatgtggctggtatacacaatggagtactattcagccataaaaaagaatgagatcggccaggtgcagtggctcaagcctgtaatcccagcactttgggaggctgaggctggcggatcacgaggtcaagagatcgagaccatcctggccaacatggtgaaaccccgtctctactaaaaatacaaaaaattagctgggcatggtggcacgcacctgtagtcccagctactcaggaggctgaggcaggaggatcgtttgaatctgggaggtggaggttgcagtgagccgagattgcaccactgcactccagcctgggtgacagagcaagactccgtctcaaaaagaagcaaaaaaagaaaaaaaaaagagaaaagaaaagaatgagatcctgtcatttgcaccaaccttgatggaactgggggtcattatgttaagtgaaagaagccaagcacagagagataaatatcccatgttctcactggagatagagagtagaggatggttaccagagactgggaagggtagtggggtggttgggggagtggtgggaggattaataggtacaaaaaaattagaaagaatgaataagatctgctatttggtggcacaacagggggactatagtcaacaataatttaactgtatattttaaaataactaaaagagtataattggattgtttgtaacacaaaggataaatgcttgaggggatggataccccattctccatgatgtggttattatgcattgcatgccttaacaaaatatctcatgtacccccaaaatacacacacctactatgtacccacaaaaaagaaaacaagaaaagagaagaaacagagtgctgggttcaccctcagagtgtctgattcagccagtctggggtggagctgagcatgtgcacacgctcaggtgattatgctgctgctggttcctggaccccattgtgagaaccacgggcctagaagaggcagatacacatccccagagggaagagtcagcatagtaaaggaggattggtggggctaaggatcaagggtgtggagcctggtgagcctctctgggtcaattcaggaggactcgggggttcagaatcttttttatggctcccatggtaggaggggctgttaaaaggcctgaagcagagtagactcaaccctaaaatatcaacttcctttccaatggggaaatttcccctctcccttccactgatctaaattgtcttgattctttaaggcccagctccaaatcccatgtctctaggagggtcgaaagcagcgaccttctgctgcaggacgcaatggccaggcccttttgccagtgcccttcagtggagcactctccctttggttgtaag

SEQ ID NO: 89153 - DNA, 1078 bp, Homo sapiens
tattttaaaatacagtaaaattaaagcaaattcagcatttccttactaaaacacaagtcttagacaaatcttccaaagaaaacaaacattgggcttttgggactgtggaaatttttttatattattttcttttttttctctattatttccaactttacaagaatagtttcacaaaaattgtttaaaatgtgccactaaagctatatttatgatgcattttaccatgaatttccatatgagccacccataaataaaagactgtcagctattgctagaagtagacatattgtgagtatatttcttgtggttcttctataagtttgaaaacatccttctaggcaagatttgtgatgaattttgagctaaactgcgttgtgatctatattttggctcacacttctgaaagatacctttttattctgatgatttattcattcattcagcaaatgtttataaagcatatgctgtgtggtaagccttgttctgacactgtggatacagtggtgacaagctagttcctgccctgttggagcttaaattgtagtaggggagagaaataaaaaacatgcaaacaaggaagtacacactgaaggttttgaaaaaataagggtgtagggatgacacataatcaaaataggtaaatcgtttaaagggacaagttctgaaatgagatttgaataatattaccaaagcacagttagttcagaacccaaggtataccatggagagagaatacccaatgtaaacaggctgtaaggtagaactgaacttgagtattcaaaaggaaggtagactggagataaacatttcataattcagtccttaaatggatcccacagaacaaaccactctaaacagtaactacttctcactctacttctaaattacagagtgtctagctagtttgaactaattcgatacaaaggctttgaagatttcttttccaaaatatctaataaattgaagtctctaagttggttccaatgttcttttaatcactgaggaaataatgaaccacgatgccaaatctctatgcaatgtaccaaaacagcagtgcatgaaatggttccttatgacc

SEQ ID NO: 89154 - DNA, 1057 bp, Homo sapiens
cattccataacatggtgatttagttaacttggaaaacaaagtaacataaaatgagaagacttatgtacaaagtacattttatattttaaacaaggaatttaatgcttatgtgaatttctgttaacctaaaatcaaactaaaacataatcacagaaaactgcaaatgtattttatgggggtgggatggtgatgatttaaaaaaatgaatgttacaaaagctgtatttcactcttgtcttctctagagttgtaggcttagagagttgtacatctgtatttcaaaacaagagatacattttcaaatctagctgataatacttaacaacaaactgtatttgcaccttttattatagcagacattcttctgcaaactgcaggcaaattaacatttacaagccaaatattttttgtggtaaagtttatactttctgtgatactctatttaattatgttatataaatgtcaacttcagcttttaaatttcttaacctaatttccctaatccccactaagtagatcttcatcttaattcatataatttactagagaaattcttagatacaggtgtgtcttccttgctggtgaaatacatgcccaattcacttttatattttcaactcgctcacagtgcctgccttgtaatgagacatacatattcaggcatggaatggacaaagacaagagactctcatgcagctatgacaaagaactttatacaatgaaaaacattattaatagctctttaaattttaatgcagaggtttttattttcataagtctctcatttattataagtggaattaacctgtatttagttgtctaataaatgtcatttgtgttacatacgtctccttttttgtatctacgcagagcttagtaaattttcctaaaaataaagttaaacaagatgaatatgagtcatccttaaatgagaggtctctgttaacataaagtaactttgaaagtctgaaaaatgaaggttaacctcattaattttgtaaaaattcgccaaacatcaaggggtttgaaaacaccaagagaaacaataagatattcag

SEQ ID NO: 89155 - DNA, 1017 bp, Homo sapiens
atacctggaaggatttaatctcttcatcagtatcttctaaaagctacctcaaggaaaatgttcatagttacctattttttacaatatgcatatggattagaattgagaaggaaaaattgtttgagagaattaaatattttcttttcagttggtaacatggattagttaggaatatgcctggttaaggaaatacatatttttaaaaataaaagtctgatttttcctttgtatagtccttatcaagactgaattatcttaatgatcatggattaaaagaaataagctttttaaaaagaatcttcttgagctaaaacttatgactatcttaggaattttctaggctgtacttctcctgtgcaagaagagagctttcaggcatccccagaggcctctccttgtcaagtggaccatctgggggtgggaatgggagagctatttcagtgctagatgagtccctgcagagcaacaaaagtgaaaaaggcattatatctcctctatgcagcctgctggtttcccctttaaacatttttaaatagaaaaaaatcttactctgaaatatggtaagtattaaagaagcaccttcttgaaacctagaactgcagcccattagctgtgggatctgataaactgcctaaactctgtgagtcttaatttcctcatcaggaaaggaggataatatttacattacaggaattttttttaagaatgaaatgaatagaaagtgactgctctagtgcctgagacatagtatttattaaatggcagcagctacttatgtgggtgtagaagagtcagaagggggtaaaactaaaagaaggtccaattgtataatactaaggcttataactatatgctatcagcaatactgcaatgtctgtattttaattttaccctataccatttaattaaaaatgggctctatttgtgatgatgtgttgttgatattgttctcagttagcatttgccacagtgatgctgcataacaaaccacctcggaactcagtggcttaaaacgac

SEQ ID NO: 89156 - DNA, 1027 bp, Homo sapiens
tatggggcttttacaattttagattcttttcatccttttgttttttttttctctcttctaatcagtatttcattcctattccttgaaatagggtagcagaaggaattttgataattggattgagcaatttattacaatagtcttctgagggtgacaaacaaaattatgtgtgctacttttcctctgacttatttgtttcatttcataaataagcattttatatttatacatgaaggtaatcatttctttagtaaaggctaaggtgagacctgtattagtactgactattgttgatttggcatcatggtcagtaatttctctgccttctgaaggtctgcctttcttggcctttaagaagcaagactgtcattacatgttagactgagagaaggagacattatagagccacttggaaatgaagagttaatttttggttcgtaggtgtgttacaggctgaattgtgttcccttaaaattcatatgtcgaaatcctaaaccccagtatgtgatggtatttggagagaggatcttcatcaggtgggccctactccagtatcattggtgttcttaggacacaggcatacccagaggaaagaccacgtaaagagacagggagaagattgtctacaagccaagcagaaaggcctgcgaagaagccaactctgttaacaccttaatctcagacttgtagtttctagaattgtgagaatacacatttctattgtttaagccaggcagtctgtaatggcagccctagcaaactaatggcggtggtggggtggggggatgttccttaaacagtgattaaaatagctcagttaatcaaatgaaaagataagtttaccattttctttggaaacaaaatttgtattaatgtcattttcaaataactcctatgagaacgtcccaaagccattggtattttaattaattttccagtggtagcttcttcaaatagtaaatcagtaagttgtctttaaagtatcattttctgtgaagcttcaggaaacgtatactctaaaaaataa

SEQ ID NO: 89157 - DNA, 1038 bp, Homo sapiens
ggctgtgagttccatttttttttttttttttaaaaaaaggaacaaaactccatagctgtatttcctttggaatattgtaaccatatgtgtgtaggaggactcagactgtgcatctccattttcaatccctttttggtctcttttttctagctttgaaacacaggtatctaaatttaagaaacacaaatacacattgattccttgtagacacagatgcagaagtgaagaaaggatactactttcttttatcctgcacatcagagcgggtacaccgtcagctacaagggagaccctgataatgcctcagggggactctaagcagagtgtactggaaatacagaggtaggagaaaatattacttgcggctgtgagaattggatggctgaatgaggtggcatgtgtgctagacattgaaagatggcttaaaattatcatgggagaaattatctactgctaaaaatttgcatattttcactacattggcagatttttaattttgatcttgctcaagtacggagcatgcttagcttgtcattattttaagcattgctgctacagaagagcaaatgttgatttatgctatttaagtcttatttacaaagtgcacgtggcatttcacattttttacatatcctcataacaaatttttgttttgtttatgcagtgccttcacgatcataaactattgagtacatgatattagattgtgtcaatacactttagtttgttaacattcttccctgatttgataattttggattttgcttcactttttgatttttacagataatgccaaataaacaacttaatgcttatagcttttttatttcttgtggtgtatttttggagaatgtgttcttaagagtggaattatatgaaactactttttttgttgttatgtattttcatattgcgttccagaaatgtgttactaattaatagtattctctaccatagttacttcatcattgtgtgttatgttaaaaaaaaaaaaaaagaacttgcctccttggcagccataaaatggcatctcaaggt

SEQ ID NO: 89158 - DNA, 1048 bp, Homo sapiens
ttactgaatttgcttgttttcttgatagctgtttgaaaaattcagaacagcatgagatgaagtagagtgcggatattccacgtgttctgtcacttaaaaaaaagtgtcgtaaaattcacatagacatgtttgtataaatggaagtcatcattttaattcagtttcctgactttggaataatcttggaaaattggaaagctggcccataataaattggttgtggtggttcctgtgtggttctggatgagggccgcagccatcttctgtctatcctcaggattgtgtagctgggggccctggtatcaggaatttctctgagcaagataccaggaaccagtggaagctttgtcaccagccagtaggagacagttgccctggcccatgtttgataatccttagggttgactggtttcacttctgctaagtcactggtggatgttgtggtggtcagcaccaggacagcacagtgattcacactgggatattcctgcatcttccagtttggagggtctggagaacaggggagtaactaaaacagtatgactcatgccccacttcccacaaggcattttttgtggaagtagttgctatgggcaatcccctgtgggcagaggaatctttgtcaggaatctctttcataaaaagctgcagcctcaacacctaccccaggagctagcgctctgagtaacgccaggtctttctggatatcagtttgtttcccaggctttaaggacaggttgaagactcctgccactccaaggttctcagcccactgaatttctgtaggcaagaaacgttctcctccctcttggagatcactggaacatgacttaggaacccctgttacacttagctggactgggcaagaaaacggttgagaacaacaaggagcctaacaatttttgacaaactgaatttaaaccttaaagctattcattgtaagacttttttttataatttttttttttgcattctgtaggcagcctacaatttagatggagaagaatacattcatttttttttaagaagatggacaggttgagtctaa

SEQ ID NO: 89159 - DNA, 1087 bp, Homo sapiens
aaactcctttcaaatattttttgacagcacaattaaagtgtgatggcttatattatagataggtttttatatgcaggtggttatgttttgtgagtttaaaattttacagctgtgatttaaaaataccagaatgatggaagtaaattttttcagagaaaaataatttagcattagcaatgcatcaccttttgactcaatggtattttgaaagacagattataattttcagtggagtagctattaaccagaagatcacacaaagcaattctaaggcctgtttgcatatatcaggggtaaaaattacttaacatacgatgcctaatgcttttgagtggactgggatatatctgaaaactatataggaaggtttgatgtacttagatcttatgggtgtggcctgttgttggttgcatctgaaagtagtttacatattgactttcaaatgtaagcaaaagagcaattcaaataggcctttggtttgtaccactggcatatctaccagaaaaaaataaataggatgcctgttgcctgtgtggccgagtgcatcctgtttgtgttttttgtgtcctgtggaaggtagcctcattaatcatggggttaatgctaaacccagcattcacttagctccttaattcatgaatgccactgaagcacattgaaacaaaactttaggtattacagttgaatagtcagactttttttttttttttgagacggggtcgtgccctgtttcccaggctggagtgcaatggcatgatcacggctgtctgcagccttgaccttctgagctcaatcagctcttctatctcagcctcccaagtagctgggactacaggcatgcccagctaattgtttgtttgttatttgtttttttgtagagacagggtttcgccatgttgtgcagattggtcttgaacttctgagatccgcctgctgaggcttcccaagtgctgggattaaggtgtgagtcaccgtgccctgtcagcagtcactagtttttgaacagtagccacatcattagaaataaatacacgtatatctgatattttaggtgcacagacaatattatattgtacacctagagtta

SEQ ID NO: 89160 - DNA, 1059 bp, Homo sapiens
tgtgtggtttcagttttttgctgctgtcagcattcttatgcatgccacctgggtataaatgccagggatactctagggctgtgttccccaaactttatatgagaatcaccagaaagcttgtttaaatgtggatccctggccctagccctgatagtctgattcagtaagcctacagtagagcctgagaatttgcctgtctggcagactcccaggtgatggaacactgttctgctcttggatgtgtaccaaggagtagaattgctagattgcaaggtatgcatgttttcatcattaccagctaatgcaagattgtgttttccatactggtctgccagcagtatgtgcatagtttccccctaattttaggatacttgttgtagtcaaacctcaacatttaaaaaaatctggtggactgcataataatgtctcattttggcttaaatttgaaatctggtttctgatgagagtttttctatgtattttgaccttttggtttgccttgaagtgtctttatgaacactagcctgttggatgaagtttgtaacttgtctgtagcttggccttgctgtgtgtttctcattctcttcacctaacattttcagtcatggcttgtgtaggtgtgttttgaagcactgagaaccttctagatagccgacacaggggattaatatttactgagtgcttactatgagccaggccaagcacttgacctgcattttcatataatcctcacatcaatcctctgcaataggtagacgttattatcattatccatcttacagatgtctgaacagagattggctgaaaccactcacctgaaggcacactgttgtgaggtggctggccagggctttaacagtgctttactttcctgataacaactcggccagttccttgaaagtctgcaaaagaatggacccagtgggagcaagattagtctattctggactttgaaggattgttgcctaaaggaggatttggactttagaatgaggatttaaaagatctcagtttcatggagcaaactcggcttaagaatgggaaaatctaacagattga

SEQ ID NO: 89161 - DNA, 1089 bp, Homo sapiens
gttgagtaaataaagaaaagtctgtttttgcagcgaaaatattggcctttggcacccactctcttgctaaagtctatttggtgtcaacacctttacgattgagttctaatatcctgctacctgatatgatattttagggaactcaaaattcagattatgtacatataatacacacatatacatttactttatggaagtgtcaaatgcatacaggaaaatatacatagaagtggacagcctgctaaatgttcctaaatggaacatactagttaatcagcactgaatcaagacagagttttaccagtacctccttccaattttaaccgtccctcagtggtaactatttatttgacttccaacagcatgatttttttgctcatttatactttgtgaaaccatattctcttttgtgtctggcatcttccactcagtacgcagaatctttcttatatttatatcatatgtatttgtaattgtcacaaaattaggaaagacggacactatagaaatatattggaggtaaggagggtgaagttggtttaaaatggaaagattaatcattttttgcagctaaaggccactcgcacatttatggtgtcaagccactaaataccttttgtgggttttcttacaatatcttttgccatagttctggtagtttggcaatatcacttcagccaaatgccaaatacatttggaattctgttaagttatagtctctcttgtccttccttttattagaacgagagtggagacaaagaactaaatatctttctgacctgaagtttttaatcagaagatttaggtgttaacagactctaatcttttcagcgatgcttcttaataccttctctgagcttactagtgacccagttttcaacaaggctttacccagttttttgtttttaattttggaaagggtacattgaggggtttctacttccacacactgtgtgtatccgggtaccatttacctttttttatatttgtatatcttttttaaagatctgagagtctgccaggagggatgcagattgtccacatttgtcccagcatctttctttctggaggccttttctgtttataatg

SEQ ID NO: 89162 - DNA, 1037 bp, Homo sapiens
tgcgcgaaagaaaaacctactctccctggtctgtcagcaccagttttgccgtagctgcttggagcagcactgctcagttctcgttaaggatggtgtgggtgtgggagtcgcttgcatggctcaggactgtcccactccatacaccagaggactttgtgtttccattgcttcccaatgaagaattgagagagaaatacaggtgctacctcttcagggactatgtgaagagtcattactagctccagctgtgccctggtgcagactgcctcatggttgttcgggtacaggagcctagagctcaccgagtatagtgcaatcggtgcaacgaggtcttctgtttcaagtgtcatcaaatatatcacgcacccacagaccgcatcaccatccgaaaatggctcaagaagtgtgcagacaactctgaaacagccgactacagtagtgctcacactaaagactgtcccgaatacaacatctgcattgagaagaatggaggctgcaatcacatgcaatgctccaaatgtaaacacgacttctgctggacatatctaggagattggaaggcacatggcagtgaataatatgagtgcagtacttacaaggagaatcctgacattgtgaaccagcgccaacaagcccaggcgagggaagccctcaaaaagtacttattctactttgagaggtgggaaaaccacaacaaaagcttgcagctagaggcacagacataccagcagattcatgagaagattcaggagagggtcatgaacaatctggggacatggattgactggcagtacctacagagtgcagccaagctcttggccaggtgttgatacaccctgcagtacatcaacccatatacatattacatggagtctggacccaggaatgagctgtttgaataccagcaggctgagcaggaggctgaaattgaaaacctctcatggaaagtggaacatgcagacagctatgacagaggggacttggagaaccagatgcatgtagccgagcagtggaggagaaccctgctgaaggatttc

SEQ ID NO: 89163 - DNA, 1050 bp, Homo sapiens
atccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagtttaaaaatgtgaagtagtgatggtttttgaaataagctttaaaatatagggatcttgaaggctccctggggtaactattttataacttagataaaatggctagtcatatctgtgtgtttgtaaagttatttttttaatattttaagattacaat

SEQ ID NO: 89164 - DNA, 1105 bp, Homo sapiens
agaaacttatacttttacaatttttgaaaattgcagagtgggtgagtacctccttaaacaatatatggcaaattaactgtgtttcaattcatacatttagtttcactatgtccgttgagaagcagcgtatcccagcagcaagaataagggactctgggtggaattttactctgtgtttcactagctgtgtgatgcttggcaaatttcctaatcttggcaagcctaatttcttcatctgtaaaatgggttatcagtatgccagattgttatgaagatgaagtgaagctcaatacacagcgaatgccaagcacagtgcctgacaaataggagttaataaatgttatgctgtcatcctatggatggatggatgtaagagaacatagcccaaaaagaataagtctttcactaattggagatgtagtcttaaagatatgtacggatgttctctaggattaaatgtgattgccagtattctgggcacgattatgaaagtcactgagaataatacaaacattttctcagccctgtgaaaatggtctgttttaactaaaagtcagaatgcagttttggagaccttgtctagaaatgtctaagtgaaccatgcagttttagagaaaactgactcctatgatcaatctaagcacaagcttacaaacagagaaaagttatagaataatcagaattgtttagtctgaaaatacatggagggatagtatcaacatttataaaatcatacattaaatacaataaatatgaatatgatcacccaattcgaaaatgctagtatgccagaatatttgaaaggaagtgatactgtatggagaggtctgcaaatttataaaagccatgactttgccatgtaataatgtggtccagaacttttttgaggtgggtgaaaaggaatgaaataaagggaacatagaacatgtgaatgttttggagattaaaaaggacttttcttctctaggcactactgtgggacaagtgtgtgctactgacaaagatgagcctgacacgatgcacacacgcctgaagtactccatcattgggcaggtgccaccatcacccaccctattttctatgcatccaactacaggcgtgatca

SEQ ID NO: 89165 - DNA, 1072 bp, Homo sapiens
agtaataattattaacatttactttagagaaaagataaagacatttaacatgcctctaaaaaattgagaaatagtactgaaactgttttttttagtttaaagatactgtttttggatttttattcttaaatatttcactctgtattgtatttttttatcaattaaattatttcacataattctgtaagaaaagatcaatccaatgatagcataaaatgtgatcactgtttagcaatagatgtaaagaatttagtaatattttcatttagcaaatgccaattttcatctgctagattctgtataacttcaggtgtatttaggtgttactctatagcttatttctgttgataaagaaaaaaattgttttggttttggtttaaagattcaaacactggagctcacatatgtttacttcagagcaaatgtctcttctttaagagaatgttaagtaggtattagaagtgatgtaagtatttaagcacaacttaattcaccatatagttttatgtgtcctttcaaaaatttacaagtgtcagtataatgaattttaagtttttggctctccccacgtgcatacattactgttaaaactatatcctatgttttactttaaaaatgattgctgtgcatattttctacagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtatacaaggctacataaatgaagaaatgatatcttttcttcagacgtaatcaacattaccagggaagatatgaaatcagaaaggatatggtatagtttggcttaaagacgaatgaaaaccatgaggcaacttcacagtgtttagaaggaaaagggctgtgtcacatggttcattcgggttgtcattccttttcatttgggacgtaaaaggagaaattgggataaggtaca

SEQ ID NO: 89166 - DNA, 1037 bp, Homo sapiens
agttatttggagacatttacatttttaagagaaaatacaaaacacaaaattttcctctgataaaaagattgatataagcttcagatcctcattctgcccagaggtaatgagaaagagtgaaaaggcaaaggaggaaggtaatggaaaaaacacagaaagagaagaatagataggcagagagggaaaaaaatgaaacagcaggaaggaaaaatgagggaacaagagacagtagaaagccgggaaagagtaggctgggtccagaaagacaggaagaagggcacaccctgaaaggtgattagaagccagcccctcccacccagcccaaggcagagcagagggagagtccgccttctagaatacagtcatttcctggtttggagttggatgcactaaatagctgcctcttctgattccttaagtttcagacactgaaacttgcccatatactactgtctgaattgatgtcactgaccctgatcttaaatttcctcccaggaccccccaactctattcttctatgtaaccctcagaggattgatatctagctcatattttgctcaggcttttaatccactgagttcacttcaactcaacaaatatttatgcattatctgctatgaacagactaggcactgggggtacaaagagaatcccacccttgggggaatcataggctaacaagagagattaacttttaagcaaacatttccgtataaccttcaagaaaactacccaggtgctgtgggcatgcagacacagagcacaggctagtatgcgagctcagagctgggtacctggagaagacggatcctgagcttagtgctagggaagcagctaggaaaggggtgggggagtcctgttccagcggtggtggggggacaaccaccagcagtctggtatgtcacacacataaagaacataaagtcatgccagggaaggacaggaaattagactgaaaatgtcattgaccaagcattggaaaaccacgtgtcactcaaaatagctggaagtttatcttacagtatttgggaagacat

SEQ ID NO: 89167 - DNA, 1056 bp, Homo sapiens
aaaagtaggatgcttgcctctcatttgataaccaaagattagtgggcagagaggcacggttagaatggatctcacattgagttttggtatcaatactggtaagtgccaaggtctgacctagtatccaagcagacaaagagtgatattgtgtttgaagaaagactgcagggcaggggagaaagggaggggttgtttgagatgaggactcttgggatatttctaggtgggatgtgtgttacagtcacatgtcaggctcccacaagatttgtagaatctagacaaaggttctagctcaattttgaggtaatgtcaaccatactgttgtccaaacaccagataatgttttgaacaagattgttaatagacagtgtcctttatttctatggattacctagtttgggcattcataatccaaatgagttctacaaacagtattatattgttcaactgactctttcttaaaattcattttttcccactttttctctgtcttagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacaggatttgttaagtgccagactttgtcaggaagtcaaggagcttctgctttgtccacctctgggtctgtccagccagctgtttccatccctgaccctctgcagcatggtaactatttagtaacggagacttactcggcttctggttccctcgtgcaaccttccactgcaggctttgatccacttctcacacaaaatgtgatagtgacagaaagggtgatctgtcccatttccagtgttcctggcaacctagctggcccaacgcagcta

SEQ ID NO: 89168 - DNA, 1057 bp, Homo sapiens
aataaagtggtcaggtgcagtggctcaagcctgtaatcccagcactttgggaggcctaggtggtgaatcacctgaggtcaggagttcaagaccagcccaaccaacgtggtgaaaccccatctctactaaatacaaaaaattagctgagcgtgacggagcatgtctgtaatcccagctacttgggaggctgaggcaggagaatcgcttgaacctgggaggtgaaggttgcagtgagccgaggtggtgccagtgcactccagcctgggcaacaagagtgaaactccgtctcaaaaaaaagaataaagtgacagtatcagaaaaagaatgtaaaagtcctaaaaatcgtttctataaggaatatattcctattgcttctttaagcagaaacatgtttaagtttcagaggaaaaggtttaggttagaaactgtaactttccattctataaaaaaatctttatcaaaagaaaagaaaaaaaagaggtgtaagtatccaggatactcctggaattgagtgtggtcaggaggaagacagacagggtgaatgaagctggaggagctcagggcccagttgagaatagacagtttgttacattggccatggagaaatgggagaggatcgtccttcccctcaatcctggagaaagacccatggtcctattccatggaagtcaaggcatggatgacagcaccaacatttggagtcaggatcttgaatttcttatggactctccagttagatggaccaagagacgcttctgccttaggtggtgagagaggagcgctggccaacgtgggggtggaggaggcctctaataagagagcgggaagagttatgttgactttcccagttagaactcacaggataataaagcccagcagactccaagccctgttgtctagcacagagaagccagcacgtccttaatgaacagtcccctcattctgggggagcaaaaataggcagccctgagatcacagcctcagacgtcaacatcccgaaagagtgagagtcccagtgccgtgagtcacagtgtctcactgagctttccccacatgt

SEQ ID NO: 89169 - DNA, 1047 bp, Homo sapiens
gagagatttctttttgaccatgatgtaaggaatagttacgcttctcctgatttgtttgtatcttaatagatatcaggatcatgtacctgctcatgttactttctttgtattggctactaatactattataaacaaatctgtgcccttatacagcaatttttcaggactctaccctcagccttgccttcatcttgtttttactattgttatatcccattcacgcttatgtcctcatccagttaaatgttatattgtggtcaactgtatgtgattttgataagcacctgaaatcttttttggaacaagctaaaattataaataaaataacaggtaaatatgcttaaagttgaatttcatcttagacatctttatttctaatgccagatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggtaagttaatatgttatgttgcccatctttaaactctctatcctttccagtttctcctctctttttcttttctaattttcttattttgttctgtattccttatccataggataactcttggaattactctcttttagggatgtgctgtccaatatgggccatgtgactattgagcacttaaaatgtgactggcccaaattgtaatgtgctgtatgcacgttgaatgtgtaatatatgcaccagatttgaaaaacttaatatgaaaaatgcaaaatatgaccttaatgttttttgtgatcattgcatgttaaaataatattttagatatcatagattaaataaaatatacttgtttaaaattgttatcatgtgtttctttttaaaatgtggctactagaagatttaaaattacataaaaacagcaccattctagggcctctcctatcagggttctgtttactagaggttcctaaaacatttctcagtttgcagttct

SEQ ID NO: 89170 - DNA, 1022 bp, Homo sapiens
aggccaggagttcaagaccaacctgggcaacacagcaagaccttgtctctacaaaaaaaaatttttttttcaattagccaggcatggtggcacatgtttgtagtccccactactggggaggcttagacagggggattgcttaagcctaggagttcaaggttccagcgagttgccatcacaccactgcattccagactgtttgtcataatttactgttttattgattattcatgtgtatcagctgtttacagatatttgatataacatgtaagcagctatgctacttgaatgatgtctagcttttacaacagagaacagaagatttcttaaatgagattaagcaaacacattgtgaaatgtaatccctatttctaagactctgcctttattatcagtatgaatgttggtaaaccatagacagcaacttatgtctaagctttaaaatttcagacatgaaattcaaaactaattgtgaaaatcaaaatgtattattatttactggtagcagtattaagaggcagaaaaatttagttcaagtgtataattggaaatagcactaaaaataaatattgctataaattagccactcattcctgtgtgcctcgaagccacttaatagaaaataaattaacaatttgattgagcaaaccaagatactcatatgtttggttggtactggtatttttatgttaaactcattggtattcattaactaattacatacatttcttttttttctttttttttttttttttgagactgagtcttgctctgtcactcaggctggagtgcagtggcacgatctcggcttactgcaacctctgcctcccgggttcaagcagttctgcttcagcctcccaaatagctggaattacaggtgcccaccaccacacccagataatttttgtatttttagtagagatggggttttaacctgttggtcaggctggtcttgaactcctgacctcaggtggtccatccaactcggcttcccgaagtgctaggattataggtgtgagcca

SEQ ID NO: 89171 - DNA, 1050 bp, Homo sapiens
gtgctgggattacaggcgtgagccaccgcacctggcccctgcgatcattgatttttaaagttgatgtttgtaaatgttgctaacgcccccaataaacaacagaacataagactgctcttctccaccagtgcttattgtataactaagttattccccaaaagtttaacccaactttaagggacactaaatcaaatgccataggacagactgcagagcaacttaaaaacttgagttagtggttagtgggctcaagagaatcacccttaattttatgtcttgggtatgttgcaggaataagaaaggtccaatttaagtgtgacatgcagtaaagagaggggcttttaggatggttttgcaaaattaaaaacattcaaaacaaatgcctgtaataagaacatatttaaagagaagaaaagtaagcttgaaagagctgtagatgttagaggtttccaattcatgcagaattcaaaattaattttatgtttgttttatgacagatatgtaaaattagaagatagagataattggatctctgtggattctgtcacatctgaaattaaacttgcaaaacttcctgattttgaatctagatatgttcaaaatggcacatacactgtaaagattgtggccatatcagaaggtaagttattaaatagatctttttcttgattatatgtatttagatttttattttccaacatcagaaaccattgatttgattgtgtataaaaacctaatctcggccgggagcagtggctcatgcctgtaatcccagcactttgggaggccaaggcaggtggatcacgaggtcaagagatcgagaccattctggccaacatggtgaaaccccgtctctactaaaaatacaaaaattagctgggcatggtggcatgcatctgtagtcccagctactcaagagactgaggcaggagaattgcttgaacccaggaggtagaggagcggagatcgcgccagacaaagggagactccaactcaaaaaaaaaaaaacaaaaacaaaaacctaatctcaccccagcacagttgcttgtg

SEQ ID NO: 89172 - DNA, 1456 bp, Homo sapiens
tctctctcactgacacacattcacacacattctcttacattactatagtacagttaacaaatgtagaactttaatattgacatagtccatatttcagtttagccaactatcacactatcttttacagcaattttgtttttctcaggatcctgcattccatttagttgtcctgacactttagtctcctttaatctgaaacagtcccctctgcctttctattttttccctgatattaattttttttaagaatacagtccagttgtgtcgtaggatctctctcaatttgtgtttccctgatggttccttgtaattaaattcacattactgcattttgaacaggaatatagagtcttgttttaaaatgaatttatattgctaattatttgtctgttttgtgtttgttttgttttgttttcattttagaaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacactagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagttaccaagcatagcactgtacagcattcttactcctaaacagcagtca

SEQ ID NO: 89173 - DNA, 4336 bp, Homo sapiens
tgaataaatgaaaggtaaataaaaatgcattgaaccccaaaaaagctgctgaagggaattttcataatggaagggaagtattttttgctgaagggaatctttacaaaaggaagcatttttgatgcttgtttttaagagatatacgtatatatacattaataaatacacatatttacgttaaagagcccggttaactatttatgtaaaagtatttacgtaacataaagcataatgttttatttattaaagatgtctaattgtaaaagtgcaaaataattttttcaggtggcatttcttgagtagtaaaattgctaatttagaataatggtttagagattcttaaattatgcacaagaaccagaaattgtaaagggcattaagtgctttaattataagatgaccttgaacacagtccttatcagttttcctttttgaacatgttttgttgcttttttgttttttcctctaaaactataggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaacgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaagtatcttcatttaaaaagaaatcaagtcagtttttttaaaagaatgatctatggaagaaaacccaatagtacttataatatacaaatgaattatactattagataagaattaaatattctatttttataaagataaatacttagtagataaaaacaaattttaagtttagttttcagacatagaatttcacttttggaggggacccttgaatgttagtttcattcaaactatattttgtttttttcacttttaagagattatatctctggtgttaattactaaaattttctttctaaaagtataatttaatagaattatcttaaaatacatgatcagtattcagtgcgctgatattataatgtcttctatatgtagtatctaaaagcataatttaatagcattgtcttaaaatacgtgatgagttatttggtgcactgatgccataatgtcttctatatgtaatatcttacatgtttgcatgagtgtcagggctttgtccagttatcttcatatgactgttctctgaaaaaaggtcttactacctgatatcaagtacatatcttaattttggatgaatttttccacagtaaagccgaacagtattcttttttgaaaattagcaattataaagattgtttaaaatatcttgatattttcacaaattttaaacaaaaaattaaatatctataaagtgaatgttcaacaacaatgatgagcaatagaaatctatatatgagaaacgtttggataatatttgcctcaaggattgtttacctaaaacagaactatggttatttatctcagattgtaagttttattttgaagtgtcatttttatggcaatattgataacacaaatgaccacaaactaaatcataaaataattgaatccttacactttgagaaaatggatagcttctgtgttatgataccaaacaaaatattttcatatttatttcttagaactatttccaaaatatttatatttcagtttttttatggtactcgaaaaatcaaaccttctgaaaattatgatatttgtacttcatttgtgtattagttcattttctgtttctattacatagtttttaaagtcaatgaaagagattgagaatgttaacatttgttgatcaatgtggagctgtccacattcggtatcttttcatttttatatatattttacagtttcaagaaaacttagtactactagtatctgccttattttcttaagtctgatgttaatttttgtttcaggagtgagatataaacattttgctttttttcagttttgaaatatagtttgtcatcctgtgaaaaccacctcgtttgctttttgtttgtttgttttgcttttttagtgtagacctaaaattatttttgcctataaacagtgaacttaatatgtttctgtgagagtgacagagctgtgcccgtttatcttcattgtattaattattacataaagattaacaaatacattgcaaatgcaaattataggatgtttggaggatttattaatgagcatgtattgattgcctattccatatccagtgcaatgctaggtatgtctatggaaggagtattattacttcatttctaaacaaatgaagtcaagcaaattgagatctttctgaaattatgaagacatcttctgataacttatctgttgtatttcctagtctcaaagtcaagaaacccgtatatgtggacctagggctaataggaggtccctatggcactaactgggaaaattacatggtgcttttcaactacagaaagaagtaatgactaatgggcctgtctgtagagaagaaaaggagaagagtacacatttgctggaactatatataattcacagtggagatagttaattctttgctaaaactagggttttatgagtattttttaaatctacatttaagtttttgtttttgtgaaaagttattcagtaagaaaactttataatattaagtagatacagttatgtattaaaaatttccttatatacccttttgccagccaagatactgatattttaaaacaaaatggaaaaatgtccaatacaatattctctttctggaggcttcctacaagtgaaagcagattttgtcattttatttggcctttgcttgtctttgatatatttctttatgtgtttttcaaatacatactgttgtagatttattgtcttgtatttgcaagtatgccggttgagagaactaaaatggttatagtattgtttatcagaaagaggaagtgtacttaagattattttatttatttagatgaaaggcttctacataaatgcactgaaataaatgctagtaatttcttgtatcccacttctttttttgcttctcatggaaatgtttgtacttttttatcattgtcttttatgaaatataatgttctaaagactttgtgtgaagatgtaattattttcctctcaggaacttttttgggttacctgggatttttgtttgtttgttatcctaaattttaaatgaattattgatgaatatcttggttgacaatagggttgcaatataagcataaggtaaccacagcttaaatacaggtggagatcaccttattccttttatctcaaaaagtagtatttaagtatttttcattagtacaacaattagtaatctattatatcaagataaatatttaagaattcattttagcataaattttctttttcctgcacaacttcaataaactaagctggtgtgttatgctcaatttactacttgt

SEQ ID NO: 89174 - DNA, 1111 bp, Homo sapiens
atttgaagtagagcagaaatacaaattatttaaatgtgctgatgtaccaatggactagatactgttttcttctatgttattaaattataaaataatatagtaagtaaatttaaacagtgtatttgaaaatcctgaagtatatttattatttgtctatttcatttgggtctaattattgtaatcatttgatcatgatgcaacaagtttgaaaaataatagaaaaaagtcagatgggggccgggcgcggtggctcacacctgcaatcccagcaccttgggaggctgaggtgggtggatcacgaggtcagtagttcgagaccagcctggccaacatggtgaaaccccatctctactaaaaataccaaaaaaaagaaaaaaaaaaaaaaagatgatgaagtgtgagtacatttctatttttttctctcggtctgctccatgaagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatatgtaagtagtgtgcactattcctgatattgtacgatataattgcacagtcatagcattgaaatggtagcagcgttatgtccctaaatctgagagaactcaagaaccccaagaatatcatctttaactccatcgtgtcctcctggggagccaggacacagagtggcttttcgttcccctgggtgcttccttacacagaggtttgaatgtggtgtggtgggaaagagagcctggtttctgtggtcaagcacacacagatttaaacttgggttctcacacttacagttccaggacttataggttagtcacttgcatctctgaaggtgtattccttgttcactgggataatagattccatccatagagctgctgtgagatcacatgtgctctgtgcctgctgtgtggtaggtgcataactcatcttgactcctgcctgctctcccccagtgatggtttggagggccacaaagccctctcttctgctgt

SEQ ID NO: 89175 - DNA, 1050 bp, Homo sapiens
taaagtgatgttttagaaaccgaaagaaggtctgataacacttgaagaccagttctccatgccagcttgtaccacttttggtattgttacctcatatttcacatttaaatgtatgtgataggtggtagttttatattaatgtatgctgacctaatgtaagtctctcctccgcttaaaaccccccactgccttctggaggttcttaagtagaggagcaactttatcgctggtgtgttcctctcgacgtccacctgcttgtgtctcttcctgccaggatctcagggctttcataggcaaaggatgagggatactgggaattctaggaaaaatgaccaatgattatgaatcagaaacctatgaacattctcagcaatactgggaaatttttttttcctggaattttttacccagccaaattgacaaatgtgagagtagactaatggcattttcagtccttaattggctaaaagtgtattctccatgggtctttacttagcaagctcttgaagaatgtgcctcaggaaattgagaaagccaaggaaaaggcgtaggtgatttagggaatgaagacgacccaggtgatatgcacacatggtctggagagggcaagggagagttgggcttgagagatggagaaagaattgatagatgatttgatgtgtttgaatgattacatcaattattaataggtgtagggcatatttcttgggccttcagtacaaagtaataatataatagttatatagaaaactgtagttattcccagtttgcaaaagaaaacagttcactcagcactgaagaaatattaaatatttacatagtcctaataatgtaaagtcttgatttaaccaaaaattatgataaaactatattgggagaatagaggtaggggcaggaggtgtggtggtttaactcctccactaccatgataagaagtcaagagacagtgtcttaaagtgaaagaagcaagaaatatcagaactctcatttcctcaaaatatgtagataaataccggaataaatgggaagagttgaaatgtattgctcttg

SEQ ID NO: 89176 - DNA, 2297 bp, Homo sapiens
ttggcctggcatggtggctcacacctgtaatcccagcactttgggaggctgatgtgggtggatcacatggtcaggagttcaagaccagcctggccaagatggtgaaacctcgtctctactaaaaatacaaaaattagccgggcatggtggcaggcacctgtaatcccagctacttgggaagctgaggcagggaagtgcttgaacctgggagatggaggttgcagtgagccaagattgcgccactgcgcttcagcctgggcggcagagcgagactgtatctcaaaaaataaaaataaaaataaaaataaattgaaaaaaagaatttaattttctacattatttctaaacatggatagagtgatgttttggaaacctaaaaaagatctgataacacttaaagaccagttctccatagcagcttgtatcacttttggtattgtcacctcatatttaagtgtatgtgatagatggtaattttctgttaatgtatactgacctttccaattgctttacatcattgccagcacttggtatggtttgtctttttaattttagccatttagtgggtctgtggtagtatcttatttccctgatgattaatgttgatgatcttttcatgcacttatttgcttcccacataccttctatggtgaagtttctgttcagatctttttctcatattttaattgggttgtctttgtttttactgagttgtaagaattatttatgtattttaaatacaagtcttttgtaagacataagttttgcaaatatagtctatggcttgcctttttattcttttgactgttttttgaaaagttttaaattttgatgaagtccaatgtattgatttttgtttttatagcttgggctttttgtattatatttgagaaattgttctgtatgattttctctttcttccagaaacttaatagttttagctcttacacttaggctaatcattgagttaatctttagatatgatatgagctaagagtgaagtttcgtttagttgtttcatcaccacttgttgcaaagactgttttcgccattgaattgctttagcatctttgttgaaaatcacttaatatatacacgtcatatgtatgcaggtctttttctggtctctgtgttccattgactctgcttgtcagtttctactaaaaggtctgctaggctttatttccttagttttgaataggtaagtaacagtataaatgatagacaaagttacctggcttgtattattagatacttttatcttctctcttttggtagaaaatactcaaaaaagtttttttttgagacagagtctgcctctgtcgcccaggctggagtgcgatagcacgatctcagctcactgcaacttctgcctcccaggttcaagcgattctcctgtctcagcctctcgagtagctggaattacaggcacccaccatcatgcctggcttatttttggaaaatactcaaatttttattcctaaaatggttatagtttctccagttcctttattctaaatctgcctttttgttttgttttgttttttgttttgtttctcactctcagctttttacctctgctttttctccgtggaaatgcttggtatttaatataacataccatacttctgtgtgtataaatcattctttaagttttgtgccttatgtactttttaatgtaacaatctgtactgtgaaatctgacttgttttacctaacaagtggaaattctcatctactttcatggagctgtagttgtagatttctagatcagttttactgatctaggaaagtgctagtttcctttgtgtaaacttcaattccccataatgtgtggagaggtgagagagctgtctctggttttttttttttttgtttgtttgtttgttttgtgatggagtctcgctctgtcgccaggctggagtgcagtggcgtgatctcggctcactgcaacctctgcctcctgggttcaagtgattctcgtgcctcagcctcccgagtaactgggattacaggcatgtgccaccacacccagctaatttttgtatttttagtagagacagggttggccaggatggtctcgatctcctgaccttgtgatccaccctcctcggcctcccaaagtgctgggactacaggcatgagtcactgcagcctgtctctgtttttaaaggcatatggtcctgagaattcagcaccagttatttggtgtatgtgatgaaacaatctttgcaaggcaactaaggtctgcgtttttattttcaaaccttttaagtcttaatctcaggcttgatcaa

SEQ ID NO: 89177 - DNA, 1041 bp, Homo sapiens
tccctgagtcaatttttggtcttctccagtctgccctccatattgccaccaaagtagtctttgtagtcaccacatctgatttatcactctcaatttctcatgatgttcataggttaaaggccacaatctttagaaaacgcttcagagccccttctacctctcagctttataagaccatagcagcatgcagcaagggctttttgcgtgtttgcttgctgttgtatctctgatgagaaaattcataaggacgtggctttaaaaccatcagaagttttcaaggattgatttttatccttacctctaggatgtggtagatatatttatttacatacatgactattttgttttaaaggtggcagttctcattcctttccgtaatcgccatgaacatcttccaatttttttcttacatctgattccaatgctccagaagcagcggctggaatttgcgttttatgtcattgaacaggtgagaatacttttcatagtggtcactaagtatactagaatctaaactcttagatatggttagattaaacatatttaggattaataaggtaagtctgattcttagtttagtttttttgagacagagtcttgctgtgttgcccaggctggaatgcagtggcgcgatctcggctcactgcaagctccgccccccaggttcacgccattctcctgcctcagcctcccaagtagctgggactacaggcacccgccaccacgcccggctaattttttatatttttagtagatacagggtttcaccgtgttagccaggatggtcttgatctcctgatctcgtgatccacccccctcggcctcctaaagtgctaggattacaggtatgagccactgtgcccggccaaattcttagttttatacttgggtgaaattacattttggattgggcccatatatttcttttataataattgtaatttggtcaaatgacttaatcagcaatcatgtttcactttagtatgacagcctcgttatattttaatgatattctaaatataggattgtcaatctatggtt

SEQ ID NO: 89178 - DNA, 1661 bp, Homo sapiens
attctcatattggaacagtggagagagagggaaataagaaataactagatttatgttaaacatctgtcatcaacttgattcttaatatttgaggccccttttttaaatgagaaaaataccaatgcagttagttgatggcaaattaattagaactgagatctttcaaaactagtaattttggctggccaacctgttgagaccccgtctctactaaaaataaaaaaattagccgggcgtggtggtgcaggcttgtaatcccagctactcgggaggctgaggcaggagaattgcttgaacccgggaggcagaggttgcagtgagccaagatcgcgcccactgcgctccagactgggcaacacaaacaaacaaaaaaccactagtaatttcagcaattcctaggtattcttgaatgctgcaggtttaagtagaagatctgcgcaggttggacaccttctggggcaagcttgtatctaaagaagaacatgagaatgctatgcaggtcattaaaagtgaagtgtacctgtgacattgactttccattcagatttcagatggagggcttgatgaacaactttggtctataacttccaggcttaaagaaccaggcagctgcttgatgctcttgtctacccagaggcctggagtttcatttatagtccaatgtacctcaaagatgagtcttggcctccctgtttcagaactacttgaggcatatggtgaaaatgctgatttttggccaggtgtggtagttcaaacccgtaatcccagtgctttgaaagactgtggcagaaggatcacttgagcccaggagtttgaggctgcagtgaggtgtgatcacaccactgtactccagcctgggctatagaatgagacccccatctctaaaagaaaaaaaatgcagattcttgaactcagtcctcaaacattctgattctattggtgggaaggaacaagaacttgcatttttaaccaagtgcctccagtttgagaactgctcctggaggtactggaaatgaggaggaataggaagatgaaactaaaaacactgaaggagaatgagggcttactagcttctgcttactcagtggcagataactagattcaccttaaggttaccaagcctaaagccatgtcatttagggacagtgtagctggtggtgtgctgaaaatttgaaagcaggacagaaacttggtgggagaaattgatgtgatacacatttttcttgatgttctcctcatggtgtatataggagaaaataagcaagggaaaaaatggtgcatatgttcagcaagatttgtggttttaaagtaggagcaaactgaatggaataattttgcttgatcaagaggtggtgaggagagattcaggaggatgaagtgttgttttatcagaagataatgaccagatattctcggtctccactggaggtgtatcagcaagagagtggctcaaacagcaaattagggcacatagaagaatgtcctgaaacaggctattaagccttaaaataaatgatcacagaacactgagatcttttctagacaaaaaaattgtaaactatggaggacattcttccacaaacacaagaactgatgtgccagatgaacttttaagatattgtttagctttattttaataaaagctttgccttagatttatc

SEQ ID NO: 89179 - DNA, 1790 bp, Homo sapiens
tcaggcatggggatagtgatggacagaggaagccctctctattgagggaaagaaataaagcctgtctcttgccagcacatatgcgttggagatggaaattaaactgcaaatgatgctggagaaaactgctgacaataatgatgattacagctgttgaagcaataaagctggaaaaaagacaaaaaatgtggtttaacagtgcagaaagaataccagcttcagttacttatatgaactgcttattatttagcctaattactatcattttagcaatcatgcatactattaaatgtatcagatttatttgtgtaaattttatttgattacaatgttagattctgttctttgtcagctgagtcatgatagtctgtacttatgtttactgatcaatcttacattttacttactctttctctgcaagttcataggtttctctttcttttagatgaatctgacctttctaagattagctagtttgtgtatcttgtcacgctgaaggctgagtgtttggttataaaagactgcttatgttgtcagtagaacaggcaggcattagaagattgcaattctttttctaacttattctgggaagcaggtatttcgatgtaaaatactctagcatgcctgcgtggaggctacagacagctctgcctggttaggatgaagtggggacaggaagagaggccattgtgaaaactcctaaaatatagaatagcaggagcaaagaggctctctagagaggaactgagtgtttttatatgaaattgtggccacatgaaactcagaagactcgaaatgggaaacctcaacatttgttggtttgtattttatgagatgaggtcagagagaagaatttggctggagggcgctccagagcaatttgtacctatttggaagttaacggatgacattaaaactgctaaaagatgatctgtagtttcaatagccttttacatcctgttctaacagtgaagtcattgaagatagcattgctttgaagggatgttagtgatcatgcagctattttaattcagggggagataaagaggcttcttgattcttagttctcttttggggttaacggaagtggttttccattcaagattcattcctgtttcaatggtatacattagaaaagctactagtaagaacacctccagtaatgtcatatatttgttaatttggagaatgagtgcctgttagaccaggaatacctcagaagtggtttttcagttttgtatgccaaggggcctgatatatggtaagtgctcagaatcagtactttgaattatgtttgcaaattccctctcttaagaaatgtcagtaggtaacagtaatagtagctaacatttgttggttgtacctaatgcctgacacggcatatgatccttcacacagatgatttcttggaatggatacaaccaccttgggaggcagacatcactgtcctttttacagaggaggaggctgaggcacagagaggttaaatcattttcccaatagacagaagctaggaatcagttcccagtcaatctgactgcttatttcattgttaagtactgtgccattgtgtcccctgtgttgaaaatgttaaaattaaaaatggtattaaaatatttgaatagttgttaaattgcagtgttaagttataatgacatgcaaacattttccaaataatactaaattattcaatatattacccaaaagcaaaacggtttttaaaaagaatttgattttctttggccgatttaccaaacatagaagggtgaccatatatattatcattgaaa

SEQ ID NO: 89180 - DNA, 1021 bp, Homo sapiens
ttaagtgtgattcagatgatctacacttgttaaaaatgcagctgggggctgggcgcggtggctcacgcctgtaatcccagcactttgggaggccgaggtgggtggatcacaagctcaggagattgagaccatcctgtctaacacggtgaaaccccgtctctactaaaaatacaaaaaattagccgggtatgatggcaggagcctgtagtcccagctactcgggggtgaggcaggagaatggtgtgaacccgggaggcggagcttgtagtgagccgagatggcgccactgcactccagcctgggtgacagagcgagactccgtctcaaaaaaaatgcagctgggatacctgttaaaaatgaagcctctgagctaaaccctagactgcaaaagtcagggttcttggttgcaaaccacagaatatactttatctgatttaagagaaaaaagaattcatgaaaatatattagagagcccagagacaacctgggtggctagagaattaggttgagaaattgagcagccagaacaaggctcagaccgctttgaagcatctcctgctgccacttgtcagggcttaaacctcctaccagcattgctcaggtctggagaccagaagtgccacttcttggttcctgtaaagctagaagcttttgccaccacttcgggtgcatttggtcatatgaccactcctacctgttagaggggtttggagagtgggttctagctttttcctttgaaaggcaggacccaatggtgggtagttcaagccgttgaaatgtgttcagttaaagccagtggccataaacgtgacccatgagcttcaactgacacagaaactttgacaatgtggccagtcagctgcattttaaacaagcacagctggtaattcttaggcacacatcaaaattagcaaaccactttatacagaggccagtgtggatatagcagagaggacttcaagtcttcatggaattgaagagggacttcatgggaggggagtgggagaaggtgaaagagaaa

SEQ ID NO: 89181 - DNA, 2810 bp, Homo sapiens
ataattagaagggatttgtgtaagaattagatctacttagatgaaaaccattcaagtacaagtaatatttacttatagtcactaaaagtgaagttaaggcttaacactggtgtatttgattattctgttgtaaacttctttgatttttacttagtatagcaatggaaacactggcactggatttctgtaaagataaagtgaatttttcaaactagaatacagataaaatgtgtttcatacatttcagcagtgtttcatattcaatagtggccaattacactataaagcctattttaatatgtatattttatatgaagagtatgagtgaatacttctttcttgtttgttagtatttatagattttccaaagggcaaatccacattcagctttattgcatttatgtaagattctttgtgctaacaaagtaaaatagaagtttcaccttgtctaaggctaaaaattaataagtgcttagtgtggatgttttgattttaatttttatgggtgaggtagaaatggaaaatgtcaattgcatactctgcattagactgaaaatagacttacctttagttttcctatcttttaattcttattcaaatagaatacgtttgcagtgacctttatatattctgttcttactatttgtggaatagttccctttatggtttaaccctgatagtttctatagttgctaaccttatgaatataacaaaagctccaaggacttcttgagatggatttaaataattcaaatgaaaatcagcaaagaaggaaaagataagcaaacaaacgtcagcaaagctcaaataatgctaatgtaacaaactgtcatgcatatgtttattgtaaaaaaaaaaaatgagatgggagccattttagagtcaacaagtcattgatgaacagccgctgtgcagcggtccctgtgttgttcatagaagcaggtacgggagagacaagactgaacgtggtcatgtgtgtggcagcttggagcaggtaacacacttggagaaaggcatgctatgaaaagattatgaggccgggcgtggtggctcatgcctgtttcctagcagtttgggaggctgaggcaggtgggttacttgaggtcaggagttcaagaccagcctggccaacatggtgaaacctgtctctaccaaaaacacacacacaaaaattagccaagtgcagtggtgcgtgcctgtagtcccagctacttgggaggctgaggtggagtatcgcttgaaccttggaggcggaggttgcagtgagccgagatcgcaccactgcactccagcccaggcaacagagcgagactttgtctcaaaaaaaaaaaaaaaaaaaaaaaaagaaaaaaggttatgaatgtgacaaaagggagacagcagtttattttggaagggaaaggacgatgtcagagagaggtgtcatcagaactgggtcttacaagatagctgagagagaacagcatcaccacaagggaggctctgtgtattcccggactggagagtggtcggctctgcccagagagggtgtgttaagtggcgtgtatgggaaatgaagctggctagaagggtcttgtgtaaaggactgaggaatctgagggccttgtgggttccatcattcctaggcatccatgaggtgagcttcagagggagaagagcctgtgagcttacatgcagacagttgatttatgagcctgtatgcatttctctcaggtgacagtgcatgattttcaaagggtctaggggcaaaaaaaaaaaaagcaaaaataaacaaaaaacaccactgctttagggaaatggagaaccatcgaaggctttaggcaggtgaatgatggactaggattgtattttaggaagattattcacatgagaagctgaacaatgggtgagaatggagaaatactgggatcagcaggagaccaatgaggagcttgctgcaggaagccgacgggcaacaacaagggcaagtgccaaggctgtggcgttggagagaggagaaggcacaaaaaagaacctacagggtgccattggccagatgtggcgaccagttgaggggtgagggttaatttccaggtttctgacttggtgaccatgaactgaagtgtgatacagagtaaccgtcgcatttggaggatggggaagttagtgggttccgtttgggccgttttgtttgaagttcaagagggttaacttggggtctgcctttagtaagagatccggactgaacatcagaggaagtgagaggggaagaaggctgagagtgggtccctgagaaaatccgtacttgtgaggtgagtggcggttaacagaagaaggggagacaggaacctagagaagccagagggtggtgtctggggggcgaggcaggaacacatcccagagagacaagactgctgtgtcttgtcacacacctccagacagcagggagagtgaggaactgtgaaagggccactgaatttggtgcagaaaacgaatggagaacacagcaagcacgaattcagtaaaatgattgggagagaagcaaagtagactcttgagaagtgcgtcagaagtgtatgtagactgtaggtgaaatgagagaagtttggtggcaaagggaaggagattggggtaaaggatctggaggaggtggaggtaagggaagagctctttaggaagagatggacttgagcatgttgtaggcatcatggaaagaaaggatggagagaagaggccgggcgccgtggctcacgcctgtaatcccagcactttgagaggccgaggcgggcagataatgaggtcaggagatcgagaccatcctggctaacaca

SEQ ID NO: 89182 - DNA, 2540 bp, Homo sapiens
tgtcttattgaagtttaaaaatgacagtatgaagtaggcatagatggcaagctacatcgtgtcctgccctgtatcacacagctacagtgtgttggagcaaggatttgaactcaggcatttgactttggtgccctgtatgcagtttaatttgctgactctaaagataatggacctaatgtaataatagctccagggctcccccggggctgcagcccacaggctgggaatgactaacttaaaggtttagaatgagctgtattacaaaagtaagttgagtgggtaaatctcagtttctacagtgtgaggtggtaagaaaacattactcccacccctctgctctgtggatgctagtagcagcacgcagcggtttggaacacccctggctgtgccatagtggaggggattccctggtgtactttcacactccctgtagatcgggctcagccaggggagggacgggagcaggtgttctcacatggttgcaagtgggactgccatgtctgtgtgcaaggataagggtgtgctgctctctagatgtctcttgggaaatcatgctgagaggtctgttccccgcagcagtttgctgttctctagttccttaaagataattgattttaagtacttctgtagattgtatattgtagttttctcccagtgatagtgacgtatttcattccagggagaaagcaaaaggccttttttttttttttgtaactcttttctctctttccaagattatcccgaaggcaataattcaagtgattatcttgttcaaacaacaacgtatctcccggaaaacttcacatactcaccatacctcccctgtccagaaaagctgccttatatgcgtaagtcgtcatctaattttgacttaactgtttacttgtgttacaatacagtcataaaaaccacatgatttgagtgcagcaggagcaggtcatgtgcacctgggtgcaaatgtttatattatgcagcatgttatttgaacttttatttatttatttattttttggcaaagcgcattttgaagggggatgattgaaaagctgaagaaaaatacaaagggggaaaatgacaaatacccatattgttcccaaccagttttaaaaactaatacttcggcttacctatgtccaagttcttttaaaacagtgcttaagagagcaattaatgtgtagtctccttttgaatatgttataatgttcctgattaagccagtcctttttgaccaccatccccagtgctggctccccattccttcctcagaagtaacctcacctctactgagagtttgctgagtattctttccggttatgaaaattgttttctacatagatagatgtctgtatagaaaatagatattgtttcaaaggagaaattatgtaaattggtctataaagtacatttcattcttgtaacttgcttttttacatacttttttgagaactacccatgttgttacatatagatctaatttttttcccttaactattactgtgtggtacgtctttgtataaatgtatcacatctcatttacctgtttccccactgatgaacatttaggtggtttcaacatttttgctatcacaaaatagcaaaaaaaatatatatatatattttggtataaagaacaacagagtgtgagttttcctgtgcgtatatgcatgtgtacttgagggttgatggctagtggtggaattgctgggtaggttggctcaggttttccagattttgtcaattgctctcaaaagcagctataccaatttatatccctaacagcaaagcatgaatgtaccactttgatattgatggacttttaaattcttgctaatctgaaagataaatggtttctcgttgtttcgattttcacttccctcattcctggtgggtttgagtaagttttcctatgtttgtgtttttaaattttctctcctgtgacttgctgcatcatgggctttatcagttcctggttggttattgtgtgttggtattgatctgtagaaattctttatattctggcagtggcctgttgtctgctatgtgttttgtaagtatcttttcacattcccaggcttcttgttttgtcttttattttatggaagtttaaaattatgaccttttcaaattttttaataactttacttaggtgttttgcttttttttggtcttaaaccttttcttacccagaggccatacagataaatacctttatttccttctaatgattttactattttgtttttaacctttgtgtgtaatatgtggtagtgataaagctactgtactttaaatatatatatttttaattatgaagataatacattatcattattttaaaaaaaacactatactgtactgtcaacactcagaagccacacggctattattttagcttttttttgtgtgtgtatcttctacccctgccccatgatttttaagcctactttgtacatataggtttgtatcttggatttgatataaagatttaaataaacatctttttgaattgcttatttatccatattctgatgtattttgta

SEQ ID NO: 89183 - DNA, 1047 bp, Homo sapiens
tgatttatcaatttaaactactcttgttatggaagaaagacatttagtattatagtctcaccccaatttttcctatccttatccccaatataattatgtcacaatttaaattcaaatcggtattgttgatgttgttaagagaatgtagataatggtttgttttcctgagtctagttgtgattgttcgttttgtagatctgtttatttttgttgatgttacttgttaactctttttccccccaatttgcagagccgtcttaatctatcgctgattttcccttaggcacatgagttgaccacgctaagggggggtttccaaaattcccatgccattgtcttctctcttccagtgctgcttttgagaagtctgttgaccatcctgatggcagttactgttcatggaccagttttttctggagacttttgggatctttttgtatttttaaattttacaaagagcatcttggagctttgtttttcttctcttgctgggagcagtcctatcagtatggaatatcttacccttcatttctccaaaatatttttatattatttctttgataatttgtcttcctattattttcctttctttttggaactcctattatgtattatttctctctcgtttttcaattctttttctttcctttctatctttctgggagattgctctgactttactacaatgctttgatttgattttttaaattttggcaaacttatttttaagaattcttttttttttcttttcttactgttactgtctccctcaaataagaatgccttatcttcctttccaggaatattgaagataaataagtaactctaaggtgtaaatcaatgaacttgactagacactgtcacaaaactcataacaatagtaatcttaagcagttttggtgggagtgacagaaacccaattcatgcttattgcacttgctgctaccactagcaaggtaggagtccccatagagagagaagccctttttttaaaaacaaaaacaaaaagaaaaaaacaagaattttggtatatatgtagatatatat

SEQ ID NO: 89184 - DNA, 1032 bp, Homo sapiens
tttttaaaatgttacctggaagtagaagctccattagaattccaggaggttaaaatctaataggctgaaccaataatttaatgatggtagaattgatgtaaatagatttcactattgtggaagaatgtgaatgctcgtttatggcagggttgccacagtgtctgccagggtattattaggtgttactttaaaggattcagtggggttgtcagttgttgtaccctttatggtctcattttgaacagttaaaaataaagatttaatttgtgttagtaattcttccttgtgtcactgtaaacctacacattctactaagagaaagtctgtctttcagctgtagatgttctttcttaaatgtatgtcaaggtgggtgatagttttagacccttctaaaaattcaagactgtgacatattgatctcaatttaatatcacatgtgcttctataaaatccattctagtcatttgcctaatatgtttatgatgccacaaatcaaaacactcttgttttattttaattttttaaccttgaaggaatttttttagaagaactgcctcagcatagttgatgttttaattctacagtaaaagtctcattaactattctttagcatgaatgagtcttctgaatagtaggtcaattttagaagtttaaacattttaaaagcttctgtaggatttgtgctggttgaataagttgattgtaaaaatgttcactgaaagtttgttcaactgaaaggaaatagacatctttaaattggtgtatttgtgtgagtgctaaaaatttgtgcatatcagcttgttttccctggggtatgaataaggtatatgtgtggatgttgagcttgattaggaggaatgattacatgggcaagacaatctttccccatagtatcctgcaaccaaaaaaaaaaaaaaaggaaaatcctttcctcctctcaccaagtcatagtttcaataaagaccaaagaaccaatgcatacttagattaaagtttgcttacttttatgaaactttgaaaacttttcatagg

SEQ ID NO: 89185 - DNA, 1114 bp, Homo sapiens
gatgaagctggaaacgatcattctcagcaaactatcacaagatcagaaaaaccaaacactacgtgttctcataagtgggagttgaacaatgagaacacatggacacagggtggggaacatcacacactggggcctctcgggggttgggggactaggggagggataacattaggagaaatacctaatgtaggtgacgggttgatgggtgcagcaaaccaccatggcatgtgtaaacctatgtaacctgcacattctgcacatgtaccccagaacttaaagtataataataaaaaaaagacattacattttatactactactaataagcaagttttggatttgggttaacatagttttatgtttggaaagcagacaattggaaccattctcatgctggtttagtgtgtcttgcaaccctgtgacatagcactttcttccggttaacagccactttctgtttaaacacagcttcattccctaatgggttttggtctttagggattaaacccatgaggaccattaacctgaggaatgtaactcaattagctgtaaatgatttggaataaaggaatagattttctatttggagaaattggtgtgttgcttttcttaattttggtcttcatctaatgaatagtaaatgcactcttttggtaaataattcacctttgttagaggtaccataaaaaatcattttaaaggcctggtgcggtggctcacgcctgtgatcccaccactttgagaggctgaggcgggcggattgcctgagctcaggagttcgagaccagcctgggcaacatggagaaaccctgtctctacaaaaaatacaaaaaattaggtgggcatagtggcaggtgcctgcagttccagctacttgtgagactgaggtgggaggatcgcttgagcccaggaggtggaggttacggagagccaaggtggagctaccgcactccaacctggatgacagagtgagaccctgtctcaaaaaaaaaaaaaagatcatcatttttaacagttttgttacctacaagttgtataatttaaaaagttgtttccaggaaacataataatgcatataatgcttctacttagcatctcatttcttaggccagggt

SEQ ID NO: 89186 - DNA, 2088 bp, Homo sapiens
gggtcctaggtcatcctaaatttgttatttagtgtttttaattattagagacattgtaatttacttaagatcaataaaacttattaaactggatagcattataggttactcagtggaagtaatttcaaagcatttcctagcatttggctagaaaagtcatttttataatatctttacagtggtatatttaagtagctatatgaagtttgttactatgacatgatatcttgattgaatactatggcctgtttttatatatttgaggcaagtgttaatatgattttactgaaatcttgttacgtgtattgccttcctgataattaagttaattgctcagaaattatgacttctaattatagtgcaattttcagtttgactcataggaagagaaattggacattattttcatttgaatcaagagaccaaaggtagagaattaaaaggtgccttgtttactgatttgaaaatatgctttggaagtctttgaaattcatttcctacccagttcccttctctgattctcattttaggctcattttcctttcatgaatactaagttggaattctgaaaggtattttaattgtgaaaacacaagtaaattggaggtgattataaaacatattcaaatagttcacattttacttcattttgatagacttcttatatactgtacacttatatactctgacatcactaattttcaacaattttataatgtttcctgggcctgcttatttatggcttggtcttttagtctgtaatgtcattaagttagtttcctgattagatttttaagatctgtttaatttcctgcattcttccttccttgatttcttcatttcctcctgattccactttccccagtgtggttcataactctcttagggttcctgtcatgctttaaaaaagctatatagttattattttaagtgaattacacagtgcattagcagatgacaaggctgatagttatcttttgttagatagtgttttcatatcactaggttcagagtctactttttgaattatcaactagggttaaagtaggctgaactaatgatctggttgttggaaaagtccttctgatgttttagacagtttgtgcctttgcaggatcttggttctttacagaggaagccagatggccccttaacttttggcattgcttggtaaacggcagacactcaataaacatgtggataaacatgtttccaccctgaacatttttagtaagatcattggaaaagtcagttttcatttaaaaatgtttaaccttgatcagtattcaaacacaaagattctccagaaataacttaaaattgttaaactgcagagtggaaattgtaaagacaccttttacaaagaatttcttgtcagtttttagtatttgcatctgcaaagcttgagttgttagctaagatctgaaatagatctcctgtatgtgatcattgtatttgttgtttgataaagtggggctctgaacacagaattcttgcagactctgtcagcttataacttgaaaagtagaggtaaggatattatatgttagtaataatttgcactgcagatttccttgagttcatacatggttttgaattattgtcaccatggtcaaatagtactttgacataaaagaatttttttttttttaaacagcctggcacatccttgacatttgttattttttgtttttaatccaagtaataccttccttagtcctaggtgtagtatgaataatatttcatatataatctggcctaactttggggtttacaccattgttattgaagataacatattttcctttacccacatggatgagtaattcttggggatttattgaacaagaggctagatgtggaaagaagaaaaattttcagcatcagaaacagatacttagaagattatcataaattcttagaaattcttagaaagagatacctgattcacatatctgtagttattattgagtggtgcattaagattttcacttttgtccatattatttccagtgttccgtagataatatgggaaatcattttctcttctgtaacttttaaggatctcttctggctttctcctcctct

SEQ ID NO: 89187 - DNA, 2539 bp, Homo sapiens
gaaggcaagtcctggtataagggacgcacataggtccgcgccacatcctgacactgtttccacaggaagtgcgggataggaggggggattcattaatccaggtcggaaatacaccttgttcctcgaggattttggaaggaaattccacccgcgaagtccccttttggagatgcccttttcctttcaggtacagcatccttcattatgtacccccagggtacaatgtatccggggctcgcaacgcgtccctcaacccccagcagcgcggtcaccgcggggtccccgggcgggcgggggcggcggtgacgcaggaggcggtggggccccggtgcggcgggcgcggggagggggctgctgggcgcgggcctatcaggacgcgcggtgtttcgggcgcggggagggcggggacctccaggtttcctcggggcccggcgcagcgccgcctgccgagttccgagcgagcgcgcgaagcgcgcaggggtctcgagacgttcccgccggtcccggttttcctccgcggctcccccgccccttcacgtccgcctctttctccaaccagacgcggctccgacggcgctcggcctctgctcttccggctccccggctctgcccgcagcgcgcgtcgcccggttgctcttcgcctggtgtccgcgggcccggcgggggcgcctcaccccgggcgcgcggcggtaatgccgctgccgcccttgcggccaggcaggcagctggcggcggccggagtcggagcgcgttcgtcgctggccgggacgccgccctggcctgtgctcagctcccgcggcggccgcggggcgccggggcccggcgcggcatgaggaggcggctcggtgcaggcgagcgcccagctcctcggccccgagggcccccgcgggcccccgcgcgtggcgcgcgctggttgcggccccggcgcccacgctagccccgcgcaggcaggagacgccgcggcccggagtaggaggcggcgcagggcctgccgagcggacgcgggcggcccggaccttaagcacggggcttcgcggcgggaccccgccgggcgcgggcagcggagccgggcgtgctgcagttagctgcccctctccgcaggggcgccgcggcgcgcagcctgcgcctcctcccacctgcagcccctcctcccgccgctgcttggcggagaaaacgctcctcctcgcccttccccggctttcttccgtcctgccgtccccgggcccctagcccccagtcccctctcccccctccacctcttgtccctcggcctccgcgcctcccctcccccgactctctggcctcccattcattccgtccgctccctcccatttcctcttttccgctcgggccctctccccagagcctccccgcgcggaccccgctgcagtctcggggttctcagcacatttatggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcggtaagcaccgagacacaccctcgcttcccctggtcacaccacagccagcgcaggctgttatccgatgttacttctgggatttggaagctgttcaaacaggggcccgcagaaaagcgttttgttttaaatgttatttcagacgtgtcaaactgcttcagggcatggctttggtatgtgagttttgttaatgcatgcattttgttaatgcatgtttgttaataacgtaaaagattgcattaaatagacgtagcaaaattagtgtgatggcccgggatgccctagtcgctttcttgagtgttcatgacagctttatccatttaatgttaagtctttaagcctaaactgagtgcttaatcgtagttttattcaaacactctcgggtataataactggttgtaaaaatatggaggagccagcagcagggaatgtgattgagtccaacaatgtgtgttttctagggtcctaggtcgcttttttagaatggggtcagtggaccccattctttttgtgccatacttggggaattttaaggcgatgagttgtcttgtaaaaacaatgctccattattttagtctgcttgggtgttattttcaagggtacgttgcctttgctacctgttaggatgacttctgagaaaatagtgattaaaataaccgttatctaagggaacttgtagtttaaaatgttaaccggtttatcattttttggcctttggtgcaaaatacacttttgtaaaactgcttgaattaacttctttattaaatatccgaattcctcgtcccccatttgttgaaaaggagccaatgcggcgttaattctagtgaatgagaattatgaacttcacatgcatattaaaatatgtcatatttccaaaacttttctgagtttttcctggctattacgtatttaatgttcaattacttagtaacagtga

SEQ ID NO: 89188 - DNA, 1374 bp, Homo sapiens
tgatccacctgcctcagcctcccaaagtgctgggattacaggcgtgagccaccgcgcccagctgaaagggatatgttaatgtgactttgggaaaaaaattaaaaagaaaaaaatcctgcaacttacattttcctcctcccttagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagaaaacacaaagtctaagtctgctgttacaacttgtcaatggtatacgaatattaggagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaattttttctgatgctttgaatatagttttgaaaggagttttgacttttttcccctcattcatctcagtatagagtgcgctatttcacaatacgatttttgtcattaaaattaccatattctttattatataacgttaactattgagttgatctgtttaaaatataaatctcaagttaattaaaaataagcttttcaaaaatgtattatatttataacaaatatactgtaaatagaataaagacatgctattcactgtatagcgtattagtatctgttgattagaaagtctggtttcaaaatatttttttattcagagaatgggcatttggacataagaaatttcaattcagccctgctgcagatagagaaatgggagcaaggttgtttcaatgaatatctcttgtcattggagaaggagggaagacagggtgtaggag

SEQ ID NO: 89189 - DNA, 2054 bp, Homo sapiens
aagagcactggtgaaggcagaaagaaacacatttttcattttgatgaacctggttgaataaatagaacttgccaagcactacagattaatgagaaaactatggggacagtgttttacaagaagttcgctcataaggagaaaatgtatatattcatatttaatacttatttaataattaacttgaagtttaacatctacatgatatatacatagcctgtaatacaggaaaccataaatataaagatgttattatgtggcataatattcattagttaagggaaatcctgtaattgagtccatttaaaattcttatctcatgctttcattgtttaagcctgaaagccaagttaatgctaataattctatttgcattctgcttcattggatattgccttggatttaaatgagaaatatttctgtcattttaaaatacaggttttcaacattttatttttattttcttggtgatacccattcattctccctagatacttggaaggtcaaagctaatgttatgggagcgtagtttaattattttggggtgacggctttaagattcagggtaacttgcagctgggtgcagtgtctcacacctgcaatcccagcattttgggaggctgaggcaggcaaatgcttgagctcagtagttcaagaccaccctgggtaacatggcaaaactggcaaaaccccgtctctacaaaaattaggcgggagtggtggcacgcacctgtaacctagctactcggaaggctgagatgggaacattgcttgggcccaggaggtagaggttgcagtgagctgagattgcaccactgcactccagcctggatgacagagtaagaccctgtatcaaaaaaaaaaaaagatttagggtaatttgtaccaaatcttttgaatgttcaagtggcctccctgtattcaactacattgacaagaattattgaataagtattttgggtatgtataagctatagaaataaaaattttggcaggatatatttaattaaaactgagttatacaaaataaattttgacaacataattaaaagcatttatgaacacaagtgattttcttttaacagataataagttcagcaagcccatgtgcagacttcttttatcgaagtttatcttctgaattgaaaaaaccacaagctcacttgcctgtgcatacagaaaaacagtcaacagaggatgctgtgagattgattcaaaaatgcagtgaggtagatttgaatattgtcatattatggaaggtatgtgctactaaattatttcagcaagcctcacttatagatactcgagtcttaagctaagcacaaacgtatattactatttatattttttatgcttatcttttctagtttcaatattgaaactttaacagttacatatttttttttggcctaaaaaaagaattcattcaaattagataacattcttctgtgttactgttatttctgtgtgttaccgagaatattgtagacatgataagctctgaaagcaggtggtattaaactgttcggggcatttccaaacattctacagagggaaaaatagcaccatgaacctctggaaatccactaccttggctccaaaaaccattaattttttgttattcatatttcatataatccatttaccttctcttctcttttattgttaatttttttgctgtagtatttttaaaatgacatatttcatctgtaaatgcttttatatgtacttttaacagatgaagacttttttgtttaatataactgcacagtattatctttcccaaccaaattaataattcttaattatctaattgatggtctgtgttcagttttttccagattatttaaatatactattttaccctgttaaaaaaaaatcagatccaaataaggttcacacatggcagaccagaatgagattatttagacattagtattccctaaagttaactgaactatactgcaaaggagtcttaattcttacgttacacccttttgtatcatatgcatgtactacctatttttaaaaattattctgcagtaaaattaaggatc

SEQ ID NO: 89190 - DNA, 1031 bp, Homo sapiens
aaatgcttatggactataccattttaagtagttatttaaaattaactttcttttgagactatcgtatgaagtaagtatagttcttgggatattttttttaaaaagcaagattatatgagggagcttttctattagggaaagtggtcacaatggaatatatagatgataaccctctgaattttggcataccgtatcatatcatatcatattctgagacccagataataaggtagatacataagactccattgtgattttaaagctattactctctagggcagtgatattccatcctaattatgtataagagttacgtagagggccagatgtggtggctcatgcctgtaatttcagcactttgggaggctgaggcaggaggattgcttgaggccaggagttcaagaccagactgggtgtcagagaccaaggcaagaccctgtctcttaaaagaaaaaaaaaaaaagagcctcctagaacagtggtattcaaagtttcaaaatgtgtccaatgtaaattatcagaaatcttgttaatatgcaaattctgattccacaggacttgggtagaacctgaggttctaaattgttacaagctcctaggtgaggttgacattattagcctgcagaccataattggacctagattttgtaaaaatacaggctttacctcccctacctctaaagctctggttgattatatcttgggtggactttgggagtatgcattttaagctatccctgaagataatctgaagtagtgacctgctttgaaaaatgctgaatctggggtgtaaaagttcatataattgtgtgctattagtgggatgatttcttctttctgctcgtctccttgataattctaaacatccttatatttttgtacttcttttatcatttgctttcatctgactcatcattatctttttaccatttgaggaaacagctatttagaaatatctccaagtttcaaaagctcagtaatttcaaaatatgcattactttcagagatactgtgcttcctgaatagttgaa

SEQ ID NO: 89191 - DNA, 1301 bp, Homo sapiens
cacttaagatcacttaaggtcaggagttcaagaccagcctgaccaatatggctgatgaagatggtgaatatgattgatttttggggggagatcaccaaagtacagcacattaaccctaaatatcctagaaagcagacaccttatgatgaagatgatgaatatggcgaaaccccatctctactaaaaatacaaaaattatagggtgtggtggtacatgcttgtaatcccagctactcagagactgaggcaggagaatcgcttgatctgggaggcagaggttgcagtggtgagctgagatcaccccactgcactcccacctgggtgacaaagcaagactctgtctcaaaaaaaaaagagagagaaagaagcacaatcagaacattaccatatgaagattatttttatgtgttatacagatgaatttgataagcagggcaaaaacttagacagggagactagtagtttccttccaaattggatagaaagaattgaactgaagttaggctaactatgtaattttacttaatgtattctatggatttttagagtataaatggtcctgagagtgatcagtttttaaaatctttatttggaattagataattataacatagagactctgtgcttaaatgtgcttttttttttttttttaacttcaggcacagaatattaagacacactgcaattatttgtaccagtcggtctttaaatgtacgggccactgtctgcagaagtaattctcttgaaaatgaagaaggcagaggaggcaatatgctagtctttgtggatgtggaaaataccaatactgtaagttggtttaaaactgaattttgtttttaattatatttgaagtgtttcccttgtgtttagtagtggtttttgttttcctttacaagacagcataagctagggattttaggaatgttcatgtagaatagtatgaaatcatcttaattcttcattagatttgtgattttatcccttagtctgtcttcaaataaaaagatcttctgatattaatatggtacacactgatatgctatatagttccattaattcattctaaaagatctcataaaatactttctaggtctcaccattgagatccattggtgttactaaattgtgaggttctgttaatatatcacattcaatattaacttggtaatcttcacttgcacatttctaacagtgccatttcctttatatagtaaatttctgaaatattgccattcctgtttatgcactctaatataaaaatgaacatttttttttcttttttctttgtagacaggttctca

SEQ ID NO: 89192 - DNA, 2940 bp, Homo sapiens
tatgggagattttaaaggaggtttaaagttaagtgaatattttcatttgtatgatgaagtgtttcttaaaataatatttttctataaattgcaaactctggattttttcatgactaagaaatgaagaaaatggactaagatggtgatggactaagatgctgaactggaatgtagggagttttttgtttcttgtgctaaataatgtcatggtgaaagtataatagcgtttatgaggatcaggtttatctccagtatgagccaattagctctgctttgctacatgaccagagaaatgtcattgctttgggggaaacaggcctttttcccttctctcccactgctgttattgtctacctgtctttctttatcatgcttagcccaccattatcttttctatgtaattgaccaattttgaaaaagaggctggtcagagcaaaagaagaaatttgctattattgtaagattaaattaaatgaccatttggccattgttgactatgagcagctaggtattttctctcagggttttattatcttggtggcggtatctttgatatgctcccgttttgaaacagagtctcgctctgtcacccaggctggagtgcagtggcgccatcttgactcactgcaacctccacctcccgggttcaagcggttctcctgcctcagcctcctgagtagcttggattacaggcatgtggatagtggcatctttgaatcgattgcttatccttctcagttgaattggactgaacaaaatgaaaaaaatatatattgagtgcctactacagcctgggtctactctagttgtggaaataaaaacactttgtgtagagctcagcatgtggtaaaaaccaagtaaatgcagactttaattagtgttatttttttgaagtattgatatataggagtgttaataatctgatactttgttcattggaatgtataatttatgaaatttattttttaggttacaagtgaacctgaaatgattggagctgaagttatttcagagttcttaattaatggcgaagaatcaaaagtggtaattattttatcatttctctgctttatgcctttctgaaagtaaggtgaaaacaaatttttaaataatctttattcagtttattttatattctagttttcttaagaactaaaatttggaagattaggacataggaattgctcaggaggaaattggtggtttgcagtggtctttgatttgttagtttcctgagaagcctgttgctttcttcttgatatgctttttatgaaaagttattattgagggtttaggcctataattgttaaatttagacattttcttttgaagaagatgcttttcataaattaattggcattttaaaagtttaggtcatgagtttatgtttttgcaacattatagaattaggtattgtgctatttaagatattatgaaaacataataagactgacttaaatatctccacaggcaagactaaagctctttccccatcacataggggagctgcatattctgggagttgtttataatcttggcactattcagggctctatgacagtagatggcattggtgctcttcccggatgtcacacaggtaaaggctatagcattggtaaacaattagaaaactttcttaaatcactccatagaataaaatggacaaaaatgatgtattttctaaataggtttaatgtatcgttaagtaaagacatttagccagatgtaagaatgacaaatttagattattttaacttctaacatcatctctagcgtcaaaagtaaacaacttgattcccttctgatatattttcttttgttaatttttagactgtatttttttctgtcactgatccaaatttagtaaattctaaccaaataaattctaaccattgattgtctgctgccaatataaaaaccatcttaatatgttcttttttttttgaatatttcctttttataaaacatggaacaaattaaagacctatgttttcacatcactggatattaaataccttaagttctatcttctgtcttgaaagagtagggctttagtgttaatctgatattcttggtgcactatacagtatgttctacacatttttgaagaggaaaactacacgatatgtgcatttaacatagttttctttgttttttaaactcagggaacccttcaagatttaacattaccatgtaattactgtgtgtagttatttgagttcaagttgaaaagatgctaggagagggagtttaccatgaaacttcctacttctggctcattttaatagatatgtcttattttacaacaaattaagttgaatagtccttgacaaacatgaatttagcatttacaaaagctgattattaacattgagaaagtgggaacacttggaaaatttgttggttcttttaactttcaattaaatatacttgccctgggtatctaggataattcagtacaccatttaagaaaaataagtgaaatgaatccatagaaactaaaaacattttactaaagaaaaaaatttgcactaaaattgagtaaggtattctgcattttagtactgtatttgtattttttggttgacaagaaccagacaaagtttatttataatttatataatttataatttaaattatttataatttaaaaatgctaatttattgcatttttaaagcaagataactggatattaacagctttttgaatctcctttcttttcccacttgtatgtaactaggatcttaatctagtacacaaatttatggttgtcagtaaaatataggtagttgttttatttaaggcaccaaatatatgcattaaaaaatactttatatgttattgtataatattaatgggaagagactgaattaactgttaaaatcctatcttctaagcagagttttcatgatttagtatagctcattattatgtaaaat

SEQ ID NO: 89193 - DNA, 1036 bp, Homo sapiens
tttgccaccaagaaaatatgtctgtataacaaaacataacttgtaccccctaaatctatacaaatatattttatataaatgcatatattttaaagctctcgatggctgttaaactttgtcattctaaacattcttatatttgaatttaatcaacgtttctccttgagatacgatttagtattttttttttaaattgtcatattcatagtagcattgtttgtagtagcaaaagagtgaaagaaatagaattcctaatagaggattaattgatatggttttgtatattcacataatggattcatgctgcagtacatgagaattcatgctaattctacatttcccacaacttgatgctgagtgaagagtcaattacagtataagtttcaaacataaaaactaattttatgcattttttagatatacttatgtggtaaaatcatggatgaaaatgatacactttaactttggaatacctctgggaagaagtgatgccagtgggggcgaaggagagtaataagattgggggtggtgcagagaggacatcgactctatctgtgatgttttttttttattaaaaatatttgggatcataggtgaaagttgacatttgttaaattttagtatacaaatatttgttatattagtctccatgccttttctgtatatttgaaatgttttatataaaaattgcttgtggacacgagggaaaatacattctttcagagtcaggaggaaaagaacatcagtattataagcaaaatccagataagctaggattaatgagaggatatttttcactcagaattagaaataggcaagagtgaatgtatatatatatatttttttatttctgtaccttatgtctatttaaaatatgttttatttgagggcaagtcttcataaacgtgttgttaacaaattttttttaggtgaaaaacaagcagctactcatgtaagtcttgatcaagaatatgattctgaatcctctcagcagtggcgagaacttgaggaacaagttgtttctgtggttaacaaa

SEQ ID NO: 89194 - DNA, 1028 bp, Homo sapiens
aaaatatatgtgtatttttaaaaatgcatatgtattaggcatgtaaacacatgcacatacatatataggaggggtgacatgacacaacactattaagctgtaaagaatagttactctggcaaatgacatgaagcatgggctaggaaagatgttcacttttttcttcaaacatgtattctttttaaaaaaattagtttgtattaataatttctaaaaagaaaacatttttctaaaaaataaaataggctcccaagctcccctaagtatttctgacacaaacccgtttttaagaaccactcattaattacatatttctgacttttttacttactagcttttggatcttaattactagagcaatcatctaatcatttagtttttgtcaggaggaggatgaaatagataatagctgccatttactgaatgctttctagatgatttcctcgagtctgtttcagctctagtataattctatgattgacgcagagacagtttatgctaatcaatggtctgtgaacacttttgatgtaactataatttgttgagattatcgcatttaaagtcaatgttttctgttttcaactttccctggggaaaataatggcagcagaacacatggaagggcatggtaagttcagcttgagaacagctaaaaacctggagaaagttttggtgaaaatgttgttgatatttaatcagcaaccttcagtactttctcagttatctgtaaagtgatgactctttcagtcaaaagatttgtcttaagggcagtgacgtaatgtagtatgtggttttgtagatgctgtactgtaagattcagttgaagtggaaacttacttgagttgtattctttattaatgtaataataggtgaaaagaaaatctttgaagtagaagcattgtgaactttttaatgaaatgcagtcgatttggccctctagaattatagcaaaagttgaggattcctttaaatgcagtaaaattttacagagaatgaaatagtagattagaatatttcataatctatgt

SEQ ID NO: 89195 - DNA, 1059 bp, Homo sapiens
ggaaccagttctagcttttttgcatgcaggagatatgactttgcattgtattcttactgccaaattacatgataatgaaaagttttgatgagttataagaagtctttgaagatttttttaaaaaacctttttggtaggtgcaaaacaaggacatagacttcttttcttctttttacagtcagccctatgtatctgcaggttctgcatctgcagattcaactaattgcagattaaaaatatttgggaaaaaaccaacaataaataataacaatacaaaaatttaaaatacaaataaaaaataaagtataacaatgatttacatagtatttacattgtagtaggtattataagtaatatagagattatttaaattatataagaggatgtgtatgggttaataggcaaatgctatacaattttatataaggaacttgacaaaccttggattttagtatcctggagggtcctggaaccatctccctgcaactatcctctaaaactgtaattggaatcttttgctgaacacatttactttgatgtgctaaggtattattgtgctattttatcttcttgtccttttttctataggaatatggtgttggctgaaagatgtgtgttgcttagtgctgaacttttaaaaagccaaagcaaatattcagaggctgcagctctcctaatacggttgaccagtgaggtactgaaactgtgtagtatttgctttaattagcattgttcttttttttttaaaaagatgtatcttttttcttgaaaggctttacaaaacataaaattagccagggaaatctgtctttgggaatttacaacatggctattttagttttttgttgagttaattttaaatgtaattttttataaattaagtttatttacatattttaagcctacatttcattattaactacagacatgtattgagcatactctgtgacttattacgttttgtcctttgaataagaatattgaaaacaatatgcatgtgcattgttcctaatataaaatgatattttattttttgttactcatattttgttatctgag

SEQ ID NO: 89196 - DNA, 1010 bp, Homo sapiens
tgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcaggtaaggtttgattttttggattagtattttaaaaatttaagtaaatagtaaatttaagaattattaaacgtatttgaagttttgttttattttcgttttaagataggccaatattaagacttcccaaaattactatcaatgatgaaattctgttcaactctagaagaggcttattcattttcaataggattttgccagcatattggacagttttctttaaatcagttttattaaaatgaacatttgctattaaagctttttagttaaaatttttttatgtaaaggaaaaatactaaattctttgtttgtcaacatatttaatctcttttttaaagctaatatcaagaaaaggtttgagtcgatctctattttctgcaactaaaaaatggtttagtggcagtaaagttccagaaaagagcattaatgacctgaaaaatacatctggcttgctgtgagtaaagtgttatcatttttgtttttcctctgtttaactctctgactagtgtttgattgtatatcctgcagaagataactatctctttaatttcttagtttcttattggtgaaaattcaggtggataagaagagtgactcaagtaaatcatattaattttttaaaaactaagtaattggacatctaaaaacaaatgggaaagtcacttttggtctgtttccttatttgtaaaacaatgaagttagactaggtattcattagtaaccattctatatctaaaatgtaatggcctgatgattctaagacaagggacacatttaataaattttgctttacacaaaaaaccattttaaggaaaaaatataattaatccattttggattttaatctttc

SEQ ID NO: 89197 - DNA, 1022 bp, Homo sapiens
ttcatatctgtgcctctcttctttccccgtctgactctagtagtccatctctcttgccattattccttacttaagaggcataagcatatgtatgtgcttatatgaacactcgtgtatatacatatcatatataagtagatatcctgagagataatttgaattaagaagaattaggatagtagcttgagtgtgaaaggggatttaagaatatagtaggtgtgagttggagtgatagaataagatccatggaagaagttatgaatttggaggacgagaaaatgctcactgtagcaaataaatgaggccaacagttagcagagtaaccatagttgttgatggatttgatagtatattaagtatgattaagtataactgctaatgctttttaaattttattttgataggaatcatatgaagatggcccttgtactataacttcaaataagaattctgataataacttgctttcattggatggattagataacgaagtcaaaggtcttgatatattttctctaagtttctcttttgattgaaaatatgcactgttgtcagatcatgctaacctttatagataaaagatgggggaaatttttcataatacagaaagatattgggcaggttagtttttcttctgaagattttactgagctacttgagtttgtttttgacacttaaaaatttgttttatatgagtagtgtatagatttcttttaaaatattttgtagaaagcaagggaagatgtgatgcacagcattaattatttaaaaatttacatgattttgagagctttatttctgactttatgatttttgtaatgataacaaattttttttgttatattttttcttacggcttagttgtactatttaaaagtcattctttatattatttaaaataaagtatttttctccatttcctggtttataccgattttcaaattactaatacaggtaccaaaacaaatattaactcaagctcattaattttggggctgggggatgttactgctgttttatct

SEQ ID NO: 89198 - DNA, 1025 bp, Homo sapiens
tttggttaattttaattttgatagagatagggtttccctatgttgcctaggatggtctctaactcctgacttgaagtgatcttcccaccttggccttccaaagtgctgggattatggccaccacgctgagtcaaaacacttgttttgtttcctgtagttccccccgcaatctagtttgaccaccagagctctctctttgaataacgtagaggagtgtcttgcagaattttattccacggaacacactttggtaactgctttaaggtggtatctaagctagctaaatttcaattgccatcatgatttttgttttcgcttttaggttattctgtcctaattttctagaaggataattcttatgtcctcttttatatttttccagtctaaatatgcctttttgggggattattttaatgttatttttgtactactttagtctctattattgcctaaggcctgctcctcttttacttcagatttttttccattttctgttttagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggtatatgtaaaaaataaatgaagcaaaccacaaaaacgatacttcagtttttacgttttggtttaactagtataattattcatattaattgtgtggaatctggtcagttttgatctgtcagaggtgagctcttaggtcagtggtttaaaagctgtttttaactaactgcagtaatcccttatgtgcactcttttcaggtgtgtactatcagtgtgaattaatcattttcttttttttttttgagacagagtcttgctctgtcgcccaggctggagtgcagtggtgtgatctcagctcactgcaacctccgcctctcaggtttaagtgattcccctgcctcagcctcccaagtacatgggattacaggcaca

SEQ ID NO: 89199 - DNA, 1021 bp, Homo sapiens
ggaggctgaggcgggcgggttacctgaggtcaggagttcaagaccagcctggccaacatggtgaaaccccgtctttacaaaaaatataaaaaattagctgggtgcagtggcttgcgcctataatcccagctactctggaggctgaggcaggagaatcacttgaacctgggaggcggaggttgtgttgagtcgagatcacgccactgctctccagcctgggctacagagtgagactttgtctcagaaacaaacaaacaaacaaacaaaaacctcctgtttatctcagtaggacaatatttatcattgagtaataagcgataattaccttaataatatggtttacaaggtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagaggtaagtttttattttagttttaaattttttccagttaaatgatttaacattaatttggagatagcttgtttacgttttggatttatttttgatacaagaatgtaaaagtttaatgtgaattttattaataaagcatttaactttatgttttatcctggcattatattcaacagtcaagttattttatgttagatttcttttttttttttttttttgagacgaggtcttgccctgtcacccaggctggagtgcagtggcacgatcttggctcactgcaacctccgcctcctgggttcaagcaattctcctgcctcagcctcctgagtagctggaattacaggtgcccgccaccatgcccagctaatttttttttttttttttttctgagatggagtctcactctgtcgcccaggctggagtgcagtggcacgatctcagctcactgcaagctccgcttcctgggttcacgccattctcctgcctcagcctcctgagtagct

SEQ ID NO: 89200 - DNA, 1144 bp, Homo sapiens
aaatcgtgatagtagttgctctcctaatcagactatatgtaatatatgggtcattctcatgaggcatttgctggagttaaaatatctgtatatttggcaccaggttagaatgctatttggttaagatgaatggctttgtcctcagcccttccagttgtttaatatagtattataatataagcagaaagaatatatttgctgttttcagtggttaagatgaaagcaaaaggaatataagatttgatatatcagcataaatcagcattggaatggagtccttttagtaaaactgtgatatagataatctgcttaaaacctagtgaaaccactaagttttacgtaagttcaaataaaaagaataattgtgatacaaaatacttgatgtggaacaagagagagttgactttttaagaatcacattatatacatttatacaaacaatgaaaatacacttgtttgtatttgattgtaaggtaaatgtacttcgaaatttcatttaagaggctttgttactgtcatattcaagtaatcaaattacaaagtaagatttaccagccatatcaccatttacattttgaactagataattctttattgtgggggctgtcttgtcttgtcttgtcttgtgagatgttttgcattattcctgacctctttgatgccagtagcataagccacctaccccagaactgataacgaaaaatatcttgagacgttgccagatgtttcctgggggtcaaaatcatgctcagttgagaacctctatgctaagtgttatttttgaaaaagatctacttatggcagtgtgactagtggcagggtcacagaacttgagttctaaagaaataatctttttactcatgtaggtaatatttagagcattaataggtaagtaggttgtgggaacactaggtttgggaataattcaattttatttttgcaaatatatatactcatgaatatatgaatatattcttgtgtgaatatattcttgtgaatggcttaaaaggtgtgtgtacatatatactcagtttattattattattattattttgagacggagtctcattctgtcacccaggctggagtgcagtggtgtgatttcagctcacttcaacccccacctcccgggttcaagcagttc

SEQ ID NO: 89201 - DNA, 1050 bp, Homo sapiens
ctcggtttgcgcccacccctaaggagggcgatgtggggaagctgagggcatggtgtggggaaggagggggacggaagacagcctcttaggaaattgctgcagggagaaacctggacccgtcggatgcaggaccacggggaaaacgcgggtcggaaggtgacacaggatttcgggaggagaaaaaataaacaagcgggtcctgtagcccccttgcgctttcagctcccgaagcccaggtgcggaactccagagaaggggatccaggcacgggtcccgcccagagccagggctcgccaactggggagggtgctcttggctggagaaccagcgctcgcccaggcacggaaaggaaacgagctccagctacaaggcaggggctcccgcaaagcgcagttaccccgctgaacacggtagaacgggctgcgcttccctctgccccagaaacccgggtccgttttgttttgctggagctgtgcacgtgttcccagaatgcccacagaggctcgtcttaagcaaacaaggatctgtgcaaagtgtctttccacccccacccctgctaccctttcccaacacagacacccagcccctcaaagggcaagtcaaactggagcttccgagtgactttccacagttgttagagtttaacaacctgctagggtggggcttggacgttagccgccaagcccctgaatgtactccttcaaaacccagccacaacgtaacaggaggtggcaggctacctgctttacgcacggtctctccaaaccggcggaaattacagagtaaaataactttctcaaaaccgcatagtacttagctaaaactcacagttggtgcaaagccgtggtcgtttctaagaagaatttaaaaacaaagtccctatataaaattggcacatccttaatgtgtgtttgaataactggtggagttggagctgtgaatttgtgctctctgtttactgtgtgtgtgtgtgtgtgtgtgtgtgtgtgtttgagagagagagagagagacgtagtctggctctgtcgcccaggctggagtgcggtggtg

SEQ ID NO: 89202 - DNA, 1024 bp, Homo sapiens
agtagctgggactacaggtgccgccaccacgcccggctaatttttttgtatatttagtagagacggggtttcaccgtgttagccaggatggtcttgatctcctgacctcgtgatctgcccgcctcggcctcccaaagtgctgggattacaggcgtgagccatggagcccggccgtagctgtattttcaaggcctgttgtttcagctttgttcttaaaactcgaggcttaaatttaccctcctttctattactgatgttgttgctcagctgtccagatgtagcttattaacataatatccacaggccagtctggaagccaagatgggctgtgtgagtcataaaatatattgattattttagggcaataacagcctaaagatatctccatttaaattgagtcattattagcattaaaactttaaagttgtgcaaaacataaacagtgggcgttttgaagattctttttggaacagaccgctttgctattcaatgatctgactggagattgttttctcggtttggactttgaatattataatttaccatttacaatatttttccttctactaaaggataatataaatttgcaaaatgttaaattttttgtttaatctttttctttgttaaagtgaataggaaactagcaactggaaaaatagtcataaaatagcattacaagggctgaacaaattgcctttcctctctttactgttctttgttttgacaaatctatgtccattgttctggctgtgggcagaatttccatattcctccttttggcaaacttacttggtccccttccactttataaatgttaaccagagtcctttctgcagtagagattgtgagcgttaataccatttgtacattctaaatgaattactcttttccattgaaattaagttggaaaacgaataaatgcaaatgaaccttctgtattttattatcccatattgaagctacattttcagacatgttgaactaggtggtttatgctgatttttgtttgtaaacctatttcaag

SEQ ID NO: 89203 - DNA, 1053 bp, Homo sapiens
ctcactgcaagctccgcctcccgggttcacgccattctcctgcctcagcctcccgagtagctgggactacaggcgcccgccactacgcccggctaattttttgtatttttagtagagacggggtttcaccgtgttagccgggatggtctcgatctcctgacctcgtgatccgcccgcctcggcctcccaaagtgctgggattacaggcgtgagccaccgcgcccggccgtatatgctttttagaagaaccaaattcaagaacttaacagttggatcttctaagtatcggagaatttgaaaaatagtagtattcttgataatgccttaatttttggtggtactggtgttacgaatgcatctatttagtcagttgatcccacagtatgaccttacttgaaagttaaaaggctggatcgcataagctttcattgagcccttttttaacagtgagtttattttgaatttgtttttatgtaggtttgcctcagtgaaatgagggcacatattcggacttgtcagaagtacatagataagtatggaccactacaagaacttgaggagacagcagcaaggtttgtttcaatacaatatagtttaatgctaaaattgataatgtttataaagaatttaatgggctggaaactttaacattcttatgaaaatatttacatatttatgtttatgttcttaactataatacctggtactggtaatcatttgttgatagcaatcattgttaaggaattttgcactgtctactttaaaaatttccaggggtaaccaaccacagactggagagattggggcaacttcctcaaacaagtttgtgttaacacagatccaaaaatagaatgcagaactgttacatttctgctaggctttgttttctaatagattcctgaagtagattgtgtttgggattatccatcttctgtcaccactgctcatttcaccagctcattccttatcattttgcttgtttctctttagaatatagacagcagcatctcagtatacaagagaacaggctgggcaggcatcctgaatcctttg

SEQ ID NO: 89204 - DNA, 1464 bp, Homo sapiens
tctgaatatttctaattatttttctttattgtaggattttaatataattgaggaagctcttatccgaagagtcttagaccggtcacttcttgaatatgtgaatcactcgaacaccacataattttattaaaacgaagggaaaagggaccactgaattgcaccatttaagatgctgcttgaacaaatgggagggaagttgtcaatgattgatgggcaaaaatgtacaacacagttatgtgtttgtccatgtttattgttatagtgcatttaaaaactgctttaattttaatggtttaaatctgttttacatccttgagattcttacacatctaacaacaaaaaaaattatctacatcagtcattgttacatggaaaagacaggtggtaggcaagtaggtggaggatctcggtttgcaaattagataatactctgtgtataatgctacatatcaataactaccatcatggttaggcacgataactaatctttgttctgtgtaaaaaaatatggagagtgaaacaaagtgcagacattcaaagaaataagaaatctgctccaatgctcttgttctaatctctaataggttaacgttaataatcttgtatgggagttggaaaggaaaattttggaagtcaagaaagtccatttaggccggacgcggtggcttacgcttgtaatcccagcactttgggaggctgaagcaggcggatcacaaggtcaggagttcgagaccagcctggccaacactggtctctgtgaaactccgtctctactaaaaatacaaaaattagctggacgtgttggcgggcatctgtaataccagctacttgggaggctgaggcagaagaatcacttgaacccgggaggcagaggttacagtgagctgagatcgcaccagtacactccagcctgggtaacagagctagactccatctcaaaaaaaaaaaaaaaaaaaatccatttaaccaaattgtcttacataatactgtaacaaaacaaattttgtgttagaaaagtatacttaattctttgactttttataactgcatacataagaattcaatatttttcaaatatttatagcttatttagaaatatttctataatataagcaatttcttaaaaaccatcagatgatacttacagtataagtattcacatccagactttttagtagaaaaccctaagggctttgatatcttttttgattgtaacattttaaaaattatgaaataaaagtactgaaaaccagacacaaaatttatagctgaatgccttattataaggaaatactcttttaggactcagccagtcaccccacgtgtcctttttgtgtcctgtcacaattacaaccccacaaaagtaactgctagactgatttaaatggtaatcactttgttgcatttgattactgctgccacacctaaatgcatatatctatattttaatattatcaatttaaa

SEQ ID NO: 89205 - DNA, 1011 bp, Homo sapiens
tcttagttcttcaactatatatttaacacttgcccccagttttgttttgttttgttttgaggaggaatcttgctctgttgcccaggctggagtgcagtggtgtgatcttggctcactgcaacctccgcctcccgggttcaagtgattctcctgcctcagcctctcgagtagctgggattacaagtgggcaccaccacacccggctaattgttgtatttttagtagagatgggttttgccatgttggccaggctggttttgaactcctgacctcaagtgatccacctgtgttggcctcctaaagtactgggattacaggtgtgtgccaccgcgccaggcaattgcccccagtttttatttgatggctctgactgtttctcatatctgactctttaattatgaatccagggcatagattagtatctccatcttgtaaggatgcaaagaagccatgaaaataagtaatatcaactcctgaggataaaacgttacttgactagagttagctttttaattgtaatcatttataaacttctttgttccttacatataagcatagtcataaccatggtacccaaaattttctataagttattgtaactccttaaaggtcttgctacagttcttttatccagtacaaataattgggaaaatgtaaagctgaatgaaatctagtgagcctcatatcctcccttttagatattgattttaagtttgcttttcacagctgctaaaaagtaacaactgatttttagttccacaacctctctttcttcaatttagatggatcatacaataaagcaaaatctggctggttacagtggctcacacctataatcccagcactttgggaggctgaggtggagggtctcatgagcccaggagttcaagaccaacctgggcaatatagtgagactctttctatttaaacaaaaacaaaaacaaacaaacaaacaaacaaaaagctgggcatgatgcacacctttagtttcagctactaaggaggctgagg

SEQ ID NO: 89206 - DNA, 1024 bp, Homo sapiens
aaaagggaggccttgggcgaagacgggggctgagggcggggcgcgagcccgcgcctggagcccggtgagggcgtggcctagagcgtgaggccgcgtcctggggcggggtgaggggcgagcggggcgggcccacggcatgctgcgagcccagcctcccgccaagcaccgtcccccatccagccccctgtgggaggagccgtgggaggggtcgcctcttgcccggcgcgtgcggcagtagcgtctctgcgttcggccccgccctacccagggccccgcccccttcctggcgcgcgctgtatcctgatgcgatccccctcccccctccgggttcatgtagggagtcgggccccgggccgccaccgtcacctcggccgctgccgctgtcgccatcgccttgtttccccatcccccgccatggccgaggacctctctgcggccacgtcctacaccgaagatgatttctactgccccgtctgtcaggaggtgctcaaaacgcccgtgcggaccacggcctgtcagcacgtgtgagtagacgccccctccccctcgcggagccgggttgtcgcttaggcccggcctccggcccgggaccccgggctgccgcctggcgggaaccgagcccgccgcggcctgcccgagcgtcgctgccccgcgaggtcccgttccccgcccctcagagtcccggggcggccttttcctcagcctcggggcccgctccccgcgtccagccccctcagcccaagctcccgctctcccgctctcccgctctcccgctctcccgctctccctggctttcgcgcccccggggcagtggccaggccgttccctgcggcgtcttcaggccccggaggcccctgtcgtctccgccaggcccgggaggaattgcagggatcttggagcctttttgtttcttagcaacccgggtgaaggctggggtgtcgagtgtcaaaagcggccggcggtgctcgcgcgggcccgctcgccccgcgacctgccctgctttcaagtttcctctttcagaacc

SEQ ID NO: 89207 - DNA, 1026 bp, Homo sapiens
tgtgctcttttgtagtagacctgtttatgtcttgtggaacaacatgtcgatatacatcagtttgagacaaaagcttatgttactcatccttttattttgtaaggggaggaaatggagatccagtgtgcgttaatttgttggcctaagattacacagctactaaatggcagagccaggatccggtttttcctttgtaccatgcttcctctagtaatattattaatatgtagcattaatatttattcatcatatattatgttaagaagttgtaaagcagacttgagtgtaattgttcaaatattcccatctagtccagttatcagtcttactctctgataaatacatatacagttactaaacttctgagatttatgtacatatgagtagcctaacttatttaatatgaatacatatttataatcacttgtttgtatttaattatagagatgaagagagtaattttttttgtaattaatgtgtcacaatgtttggtttagtttctgtagaaaatgtttcctgactgcaatgagggaaagcggagcacattgtcccctatgtcgtggaaatgtgactagaagagagagagcatgtcctgaacgggccttagaccttgaaaatataatgaggaagttttctggtagctgcagatgctgtgcaaaacaggtagagtaaatgtgacatctctcttctttggaagccaagtttctactctgaaattcttatttgaattttcttggttggtgttttttttttttttgaaaagatgaaaggtatttagactgggaattggatagaaaaggccaaaaaaagctgtggtcatagatcttactagattataaacttactgagaaatgagactgaaaaaaaaatcactgaatttcataatacttagcgtggcatttttctaaaagtaatttctcattgattacttgctaaagtaactaaattagcaagctggcatttagctcatttaaaccccattctggtacaaattcaccccttaagtttttctcatggtagcatcat

SEQ ID NO: 89208 - DNA, 1051 bp, Homo sapiens
gattgggaacctctgtaatgcatcatttcctgaatacatatgttcaaaatgagagaatctttgaatagtctaataattataacttttttaaaaaatgtatagtgattcctcaaaaaataggagagcgttatttttgtgttattctgaattaagtatgtttcacttaaaattgttttatagttcttctggtcatcctacttttaagtgtcccctgtgtcaagaatcaaattttaccagacagcgtttactggatcactgtaacagtaatcacctatttcagatagttcctgtggtaagtacatacgtttgagacagtcttctgcttagaataaaacatgctgttctatttatttcacttcatgtatgcaagagaaagtagttgatttatatttggttggggcattatcagtaaggtagatttttgtcaacaaaggattgatgactgtgaagcaaaatgagatatttaaaattgcagtaactctcattataaaaagggagatgcatagtgtgaggtaatatagcacagtctggagaagagtgaagtaatgaaagatgaaccgggaactcattcctgcgcagtagcacaacctgtctattgaggcctcagttacttgctctgtagatggcagacaagtagatctagtcaggtagattgctgtaggtgaaaatacctgtaagtaagaataaagtcagtaggtatttttattgttttcttgcagcatatagtatgtgaatgcataaagcaaggaaggaaaagacttagactttgtatttgatgcctacatattttttgacattttgagggtatgtaagaaaatggtgagagctttttgataatgagggagatagagcagaattcaggattccaacatataatgatcctagaagtgtttcataggtaagttatttcagctgtgaatggaacaggagaaactgagctgggagagagatttccctttcagctgaacattttgatatataaataattgtcttcagaaaggagaataggaaggaaaatgttatcaataagaactgtagatatttctaagct

SEQ ID NO: 89209 - DNA, 1158 bp, Homo sapiens
tagacaaatacagtgccaaagatgttccaggaaatctcgctcatatttaagattttacttagttttatattggattaccaaatttttattcatttctgcataatattcgatatatcataaactttggctagagtttaattactgaaggttttttgtgtgttatttcagttatttatccattcagtttttaagatgtacttcatttaaacgtaaggatatggctgggtgtggtggcacatgcctttaatcccagcactttgggaggccaaggcgggaggattgcttgagctcaggaatttgagacccagcctggacaacagtgagactgtgtctctagttttaagaaaagaaaagaaaaactaaggatacaatttaaagtaaattttccagtttacttcatttttattttacttacaaatgaaataaaactaataataattatatggttattgtatggatcaaatgagataatatattggatatgttgcaggcagccagttagtgataactgtcattacagttggtattattaaaagctagatgtggtttttctgttgaaacatttgtgtaataagagatttaaggaatagaatgtctaagatttctcactgtgttagattaatgtcatttatctaaggtaattgattgggaaatgatctagtcatggaacttggcctttaaaaatgcttctcacgtagatatttttggtaacatatccctgtgttattttaatactgtcaattgtataatatttcattgtttttattattttttgtttaaaacaatctgtttcttatagacatgtcctatttgtgtgtctcttccttggggagatcctagccagattaccagaaatttcgttagtcatctaaatcagagacatcaatttgattatggagaatttgtggtaagtgaattcttcaagattaagaaagtactgtttaaatattaaagttaaaataacttttttgtaatcgacttaaattttgtggcaagctgttgtatcttactggatggatttagagcaagttcttaggtttttaataatactggtgaactttagcttgtagaaatggtaaggtaaaaattgagtttactctccacctcctgtactagagagagaattaataagagtaacagcaagcacccagattaaca

SEQ ID NO: 89210 - DNA, 2316 bp, Homo sapiens
gtctaatgttttgggcaaagtattagagtagttgaatatgtttttcctgttgacatgaatgttattgtttttagaatcttcagctagatgaagaaacccaataccaaactgctgttgaagaatcttttcaagtaaacatctgaaggctgtagacatctctgcatctttgtacctgcaagtgccatctttaagggggaaactacatgaagtcaccgttacagtaacttgatgtgtatattaataaaagtaattcagtcattttagtttttgattgaaaataaaggtagggcttctaaaaacttcatcatcttgataagttaaaaaatgaaagttatgacattagctttaaaggtgtaaaaaagatgtttcactaatgtaacggtgaaagagaatccctgttgtactttatctttttgtaatattatttttgaatttttcattattatgttgcttttgaaatttgatgcattcctcccatttactttattattgtacacatttaacacacagtagcaaattttgaacgatgtgattgatataacctaacaaatctgagccagttattattagagttgcagaatagaaacttgaagtgctaaatggaataatccaaaggaaattttttaaatgcaggttctagctgaaaaattcaactataagaaaattgtatttatataacatttactatttttgaagactagtgagatttctgtaataattttaattctttaaaaagtgaaagcttgttgtaaagatattttctttttgttattagaaggaaatacaaagagaaaaatttctttctttcatgggcatttgataatttcagtctttgactgatttgtaagcctagaatatactaagctgaataacagctctttggcctcagaattttcagtagccagtatttctgattaactaagttgaaactcttattagaaactttcagttggtgatattgtattctagaagatataaatgagaggtttggcttcatctcagtttagaaatttattcaaagctaaagatgtatatatacatatacttttgtgtgtatatatacacatatgtgtgtatgcagtttgtcaggttatatatagaatttctattaaggattttttaaatggacaagcaatagggggttgaagtgtttatctgatttgtttaaaattttgtatatcaccaaatttttaaaaagtgatagtcacagtgctaagttatctagttggctactattacaccttaaaaattgagtttacacacacacaattacctgtttatatggtgctcatttgttattctcaaatataatgtgtgaccgtgatatagtgagaaagattctaccaaccactgtttcactactttttagttaaaattgggtatgttcttaatattcattagtgagaatcacaaagtattttgtagaaggcccaaatcacagaataaaggactaagagtggatttgctgacattccatactaatatacattgtttatgctttctttaaaataactagaagaacataaaagaaagagaatctcagaagtagtttgctgctaatatatacatatattgtataaaaaggtatattttggttttgttaaaacccttgttgacttttctacactgaacattttttttaacttgatttaataaaaatgttaattttggaagtgcagttttgtaaaaacctttttcagtcaaacagtaaagactttatttatggattgtaataacaaccacaagaaaagccatacatcttaatgaacatacgcctttgttctgtcattttaaagagtggtgtttactatgtgtgtgcttgagcattttctttcagttacatgggtgtaatttaaaaaacagctcctttttaagacttttgaccatagtgttttccagtttaaagcaataactttcatagtttctttcaaagtttaatacatccaatatgtcaagttaaaccattctgggatttgcaaagtttaatacatccaatatgtcaagttaaaccattctgggatttgcaaagtttaatacatccaatatgtcaagttaaaccattctgggatttgggaacttctttaaaggaaaattgtagtagaggtcatcttgatggaattgtgttttaaagttttgtgaatgagttaaatatcattgatagtcttgtgtgtctcacatatcagctttttcataaggaaaatactttatttgcttttatctgagaatttctcagtatgaaaatgattgtttaaaatttcccctctttttgtcagtgcattgggaatagggatagactttacagatttatggaaatta

SEQ ID NO: 89211 - DNA, 1008 bp, Homo sapiens
tatgttttcctttcagtttcatcattgtgtaacaagttttcttttgatgagattataaatgtgtattttgaaaatcattccatttttactgctgaatgaaatgcagattgctgcacagtaacttgagacatgaatgagtgtcacaggcaccgtcagtacttacaaagttttataacgtggtatttctcttatgcttcttcatcagtttagactcatccttctacagtttggactaatcttttctatcaggtagtttgtatcacaaaccaacccaaggttttaaatgaagtttcaaatggctagtggaaaaccttcagttgttattttaaaataacaattattatattggggtgatattctatgaataggaactagaacattgcaaacaagagatacagatgaatacatgttaaagtgtaattaggaataaatccttgataattttattctgtaggtgcactggcattcctctatgagtgtatgcctgtgtgtggttatagtgtgaaacatgcaaagcacttgttaatgtcaaaaatgatggtaaccatccatccagttcattcccacattttgttaaacgctccaaatgattctagtatttagatatgtaagctgtatttgaataaaattgtactttacacttttgtgacaatttattatagcttacaatgagccttctttcacattatatactgtaaccctcacaatacccatgcaaagcaggtactgaccatatcttatggatagtctgagtacctggaaggtgaactgaattacccttagttagtagaactggtaacataacccagacagtcctatgagctttttaattcaatcacactaagacatttctcaggtttacttagttgttttttttttttttcctttggacatgtagtctgagtttcattgaccatttgtggagaatctattttcagaaaaaaaattaatcacaaaatgtacccattgtttttcttaaatatttgtattgtctttgaaggcagaatt

SEQ ID NO: 89212 - DNA, 1496 bp, Homo sapiens
tttatgaagttgcagtgaactgcccattcagctaaattgcagtgtttattcttgtctcatgtcgaaatacaacaatcttatgggaaatattatgacagtccgttccaactgttctcagacacatgcataaacagtctctgctcacattccacagccacctgcatgttatccatacagctccctgagaagtccagggatgggaggtggggtgtggaaggatggagggtccttcattttctaaacactttgtataagtcactactcatcgtgcctagcaagtataagattaacattttgaataacaaactggaaaacaaataatccttcaaagaacctagcgaactgttcaaaggaaattttaatttcagtctaccagaaaagttaaatctgttgttggacgtagggggctttcagaaacatgcctcttatatcaatttccactatctttcaagttacctaaaggcaccaggctgcttgagcaagaagaataaaaggcctagagtgcaaattatgtgaagtagagtttttagattgtgggattgtaataatacgggattctcatggttacatcatgttaaatcacactgttcagtctttaaaacttggtgttttaaaatttgtctcattgtgatagccagaaacaaggaataaacgtgatttcagtttaaactatatacaaatatcttctgtaattttgctgctctaatttttaggctataaattttgtaatagagcttatcagatcgcaaatttcctttgtttacaatctcatgtagtagggctcagataatttcttagctataaaccttttctcccactctcatattgtttcatttaaaatatttaagctaagcctaaaaattgaaatcagttaagaatttggagagtttatcttaaatggaaatggtgtattcttttcaaagaattttgtaaccatctttacagtttctttgcttggaaaacttgggttgttaactaccagttaacaatggcattactttccaaaacgttatctaatgggcccaatgtgtacctcaagataaacacagtatgttatgtctaaaaatttccttgtctgttgatttaaatggttctgaaatgtctgtaataaagaaattttcaaagttgcttttcttgcagttgttcctcagtagtcagacctagtgcatagttttctaaggacttgtttcccatcctcacttaggagtagggaatttggagggagtcccgatactgcaagcccattctgtattaataagagatggaagactgtggctattgtgcatagtcagaagatgcgggtaactaggtaacttgatggcatacagagaatccagggcctgtgtggtcaggagatagtgcagaagatgaaatagataaactggtgagggaaaaaaaaaaaaaaaaaaaaccctggtccaaagatagttgtctcaactgatcgttcaccatcagttacagatcagactccttgttctactctttcccactctcac

SEQ ID NO: 89213 - DNA, 1843 bp, Homo sapiens
ggaggaaggcaagcccagccatcagcctctcactcgctctctgagcgagaagaacagatgtgatcagtttagaggttctgtccgatccaaatgtgcgacttctcctcttcccatccctgggactctgggagcagcagtgaagtcttcagatactgccctacctccacctccagtgcctcccaaatctgaagccgtaagtcatttctgtttttgaatgcggtgccagtctttctgtctctctgctcagtcatccactaatttattttcttaaaactccccaactgaagattgcagagtgagcaaatttgtttagtttggagtgagatacacatgctagcttgattattttgaccatttaggaattagagttttactctatgtctgatgagaacctcttggagagtttttaacaggagagttttaaacatgacttttgctgctgcccggagaatggataatagggaggagagagtagaaggtgggaagcagagaagaggcgactgcattaaggtaggtgcgaggtggtaaggccctaaaccgtggcagctggtagtggctggcagagagagacggctgcttcagactgtttcataggtaaacccaacaatatttacttgtgagttggatgtcaggcatgaagaaaagagagcaatcaaagaaaactcctagatttttagcctgggcaacagaatggatattagtgtcatttactgtgatggggaagactgaaggaggagtaaatttatttggtggtgggaggggaagcagaggaaaatcaagaggcagtagcctcacttataactctttcctatatccctgaagttacactgagatcaaagcatagcggatgtgctaatgtattatacacacacacacacacacacacacacacacacacacactccagaaccaggtgccagggtagttctatttaacaccttaaacataactcattcagagcttgattctaatgtaaaactaaaattttggtacagttctgtttagaacaagagaaagggccctctattttgaccatgttcttcaattggcagccactctgaacctttgctactcatttttgatcactgaatttcattatccctgagggagaaagggctagaggtattaagtgtaattctattaatttatttgacagtatctattacagtggctttcttttttctatctctagaagaatcctttttaaaagaattacatgaatcccaatatatagaagagttcaaatcaaaacctacctgaccaaagcacagattgtggggaaggggtcttccttgggtccctgcccactctttgcccctaccgggtgatcttaggacacctttctggaaccctggggctatgcagaaccgggtttttaaaaactatggaattactaggctagatgctagaaatacaatcatcaagaaaacctggactctatcccctcgtacgtctcagttttacagggaaggtaacagatgaaaagcaatgactgttaatacaagttaaaaggtgataaacaataggaaaacaagagagagataatgtgtggagaattcagaagagacagagaaacttctagtcgcgggatgaatgagaggagcctccatggagattatgacattttaaatgagtttagaaaatgtacctgaattggaagagtagagagatgagaaagaaggacattccggacagagcagcatgagcaacgagctggaagctggggcagctttaagcatgtaagagggaaaacaagaagttctgtggggcagttgaatagggctggatagggtgcaggaagggcagtggtggctgaaaggctggtgccagggcatggacagcc

SEQ ID NO: 89214 - DNA, 1052 bp, Homo sapiens
gatctgaaaatataagatgaagacacaaaaacaatatagttacagtgggaaaatagaaaggtcgctaagataaatggcctgaaaataaatgcaaatataggtatatatttgaatgtattttatgaacttagtatataatactttatatatttttaatttatgatataaaagtatataatattagtatacagtaaaagtgacactgcaaattagtgatgaaagggatgactctttaggaagtgcactcaacactcagttaacttacacacacacacaaaaaaaaacctaccttaaataagccaccagagtaaatacagttacattccctgttgggctagtggttaggattcaaaaaatagagatacatagcaaagtattaaaagaaaacactggtaattataccagcgtttctcaacctcagcaccactgatatttttgcactggctaattctttgctgtggggagctgtcctgggcattatagcatattgagcagcttccctggcctctacccactagatgcaaacagcagcttccccagtcatggcaatcaaagctgtctccaaacattgccccctagtgggtatagtcacccctggttcagaatcatgaatctatatcatctcagctagaagcatagcacccaagaatgaaatcacaaaggaaaattttgaaaatattgactacattttaaaaaaaacaactttaatagttaagctataaaattgcaattcaaacaacaaatggaagaatacatagcacaaatgacattttcatttacacaaaaagtaatcagtaagagatctaaataattagataaatactgaaaaatgaatataccaataaatatatttaaaatatattcagcatgcatgctttacctctcatgctggtaagcatgaaataaacttcagtgtgagtgtagggagacataatttcataaagtgataaaagtataaataagtataacattgatgaaaacacagtgggcagtgcatattagacctttcaaatatatgcatattagccaggtgtggtggctcacacctgtag

SEQ ID NO: 89215 - DNA, 1047 bp, Homo sapiens
aatgacttcagagttggaagcatgggatacagattgtgctcacatatgttacacatttttatgtatgagagtaggagtaagttatttaagaagtacacacatacacgaaaatgtagacaaaactgttgaatgtgcccagatagtgacatttagtaaggagaactttgatctgtttaatctgtacgtgtactgtttgatatgagtctcaaaaactggtggacattatctttcagttcatttcctgtgcagtacttcactagacttatcatttcttaattctggaaggtgtatgtttataaagataaattaggaaaaatatagtaaatattgatttaaagggatagaaacacattttttgtttccggatccctgtctgcatcttatccctgtctccatctttattcaaatgggtgactcgccaagtttttcacaaagttctaataaaaaggaagtatagcagtgcagctgagagttttgcagactagactattctaaaattgtatattttgaattatttccatatgttcacatcctttgggatataattgtaatgatatttcaggctctattctggcattaagttttattctgggataacatagtcaataaaaatttgaacgatattcagtacagagaaggataatacttagaagtagtggtttgggcttcaacacagtaggagatgaaaacttagaaatctatgtgaaaatacagaggtgtgaaaggcaatgtgaaacacttaaaaaaagtaaaatgttttgttaataaaagtaatagtaacgatggcctccatttattgagagcctaccatgtgccaagcactgtgagcatttgtttacatacgttcacttagcctgcaaaatagatggtgatgttccattttataggtgaggaacctaaggctcaaaaaactaaaagcattttgtctgaagtcactacactgtaaaggcaagattgaaactcagcttgtagtttagctgatagtattgtatctgtcagtttccaaaggccatggttcttttcatccatctatacccagtatcagta

SEQ ID NO: 89216 - DNA, 1744 bp, Homo sapiens
cacaggtgttcccagctgtgatcttcttaatctggtcctgaggaaagaaaaggtaaatcagagaaatgagggaaaagtcctcactggcctaccctaaaccccctgtcccctctttctgttccactttatctcaattcattaccctcatccacctcctcccaagttcccgtttcatttgtcatccccaagcccttggctctgtccctcacctcccaaaactgtggccctcttataggctactctccatcccctctcatggcatccacaccccacaaatccccaggagtgactgtgaaaagattctgagcttacaatgaaaggaacaggattccctgctcaggccagcgaggcaggatgctcttgccgccccaggtgtcgctggccacgggatgcattttccccagtgttctgagttactcctggccttgtcttagtactgtgttttaaatccagttttgtgggctgatctgacaacttaacctcaaattttattcttgtttccctgggaaaatattaaaattttgcagaactgactaataaatgaacttttggaataccatatgtttgtaaatgggtggctgcctgttttctgataatggtgtatcctgtagtggctcagaatgcctttgtttgggtttggaggtgaagagaaagaaaggatgtttggtttgttttaacactgagaatttttggctctaaaagtactttgtaatcattttaatttttattattctttcatttaaattgggacatttgtaccaaaaatgtctttcagattcatgtaattccttatatctatcaacagttgtgtacctatgctgaagaaaaaattactttacacaggcatttctctatggcatggaaactaataattcttttcaaagaatatgctgagaatttgaaagtagggtagccggtcaggcctaaaccttggtatcaagtcatgctgtgtaaaagatggcttttcacataattgttttagtgatgtgttctgtctgtgtaagtaaaaaaaaaaaaaagagagagggtattgcttgagagatatttacttttccatttttctgtatattttttagaatatttattaaccaggttatcaggacactgtgtgtgtagcatcatcctagaagtaattatccacatacttctcttggttaaacttaactacatgaagtgtgtcctcaggaacttagctgaactgtgtgaaacccattcagttcacacaggcccttgaatgtgcactttaaagcttttcatggaaaatgtctgaacctttattaatatattgtttatatctgaattaagttagggccaagaactgtaattatttttctcctgcttgcatcaatagttttacataggccttctctgctgataaatttgagtcagattaatgagtaataaatctaaagataaccttttaaaaccattggagagccaagaaagtgaacatataattatgatttaaaaggatatgtgactaaggcactcagatgtgtttcatctggtgcctgggtgttcatttctagttttaacgcaattgaatgaaaattacttcctaattccatcaaaatagcatcattggctactttagactttttagagttgatgttaggaaatacaccagtacaccatacaaaattagaaattgaggaatcagaaggaccagaagttcaaccaaaggactaagaaatagtaagttcctagaaaaattcaagtcaactttttctacataacattttgc

SEQ ID NO: 89217 - DNA, 1451 bp, Homo sapiens
ttctaaatttgatggcactctattggaaccatgtctgcacttcagtatataagataccttatacatatatctgctactttcctgaaagttcttgaatataatatttcatttatctttgcattcttcacagtacctttgtggtatgccaggtacacggtagatacctaaatggttgaacagttgaatacacaaacaggtgttaacttactatatgtcttatttcccatggaaagttcttctcaaggcacatattatacagaacagtgttatttttagaatcactcaggcattttcattttacctttcatcctctacttttctgtcttcctttgttatcgtgttatacatacttctccagaggtacctgtgtaaaactaatgcaaattttaattgcttttgttggagctatattgttttgctaagaaagggtctagcataaggtctagcacacttgattactatcagtgcagcttaagctacaggtagaacattctcataggggcacatgctgacaaggagagcaaaacttgcagagaaggtggggagttcagttgttcatccaagaacatataaacgtatatctagaaaaccaacctgcaaattaaaggaagcactctaattattgtccagggcaagaagtggagtgagatgtaatgactgaacgcaatgtagaaagctggctagctgcccagaaaaggaatttatgactgtgtgacctcattttgcctttagcagagtgtcacttttctaatatctacttgaatgttcctcatgcctttgaagaccatgtgtgaaatatctgataggagatatgttgtgtgaatgctgggttcatggtctttggtggaagctgaaacatttcacatccgagaactcaaccaagtcatgtctcagtttatgaaagctgctgaatcacacatcagattttaagcattcaaagctcccagggagtgtattggcaaagtgaaatctgtaagaacattgtcatcattaatgaacactatgttggcatggtttacttaggtggataccagtgtgttcattttgccaggaattctcatctattgttttataagaccttaaagactgatttataaaataattctgagacttctggtacattgacaccattggcagtagatctggtccactctaaagcaggtgatggaaaattaccaggttcatatctctctggcggttgaaaagaaaccaggatggcacctagtgaccaaccttagagatatccttatagaaatgcttgtgggcggctggagcggagcatgtgtcagctgtcgcctttggcattgtattcttccagatgccttattttcaggtggttttgcttgggaaagtatccatgaagacctggaaaatttgtttcactatttcttgtcagagtcttcttaggaaaatgtgaaggaagagaaaatgtaggtctgggtctctctgat

SEQ ID NO: 89218 - DNA, 1032 bp, Homo sapiens
aaagttcatctttcactgggtcgttttgttccagtgttaaatgtttgtggcaacaacacagtgaagggtgaattcaggaagaaatgatgttgttttcaccatgtggtagaagcttccagctcatggcttcttatggaaacctgattgctcccagctgtggctggtttctagcgactgacccagttgatggtagtgatttaattattaaaggggggtaaagtttggataggtgtatgtaaaacttggaaataaaggaacttttaaaaaaattattttcttaaaataagagctttatgagagatatggaaagggagaatatgagcaaatacattgcagaattatttggtgtcatactatgtggcttttctagattgctctataaatgctagtaaagctctaaaaattttagagtcctttgattgctattttcacatttcagcctgtttactcagaatccttgcaaattatttactgaatctacaaacagaaagtatagtattaaaaaaaaacccacaaaaattgtagcacaaaacagggatggggttcaaaactcctaggctactgttttccatttctttatacttacatttaggtactcagtggaaagttggttacttgaaagggctaacgccagttcaaatataatttaacctatgagataatatgattaacatcaggtggaaagtttaaacaagctgcctgtgaccacactgttaatggagtgtttatagcatgggtgggaaagtgcttgtctcacttcataatttgatttccatattggatttgtacctctaagaagtagtgtgaccttttaaaaggttcttttttaggaatttctttgagctttttctatttgtggaaaacagacttcatgggttccaaaactgattgcagtgctagcaaaacttcctgaattgaagtcactctgctccatttcttaggcttggaatcacttgcctttgtgagtcactatccagggaagtcttgtgctggctttctgttaaccctgacccatttctgtagttgttgagt

SEQ ID NO: 89219 - DNA, 1067 bp, Homo sapiens
ttgtagaaagcattacatctgttagattgtaactcaggcaagtggggcagttttcacaggggcagagaatgaaacaaaccccctaccctacccattctgtcatcagaatggttcctactagtagtgagatacatgctacttttagcaagtccaaattctgtttctgtctttgtggaaaactggaaagaaaggtaaattgctacattgcttcatcctatatacttttacctaatctgctgtattcatctatgaggaaattacgttttagtctttcccgcaaaagcgctgtgaaaagctctgtcaaatcagtcttcccaaaagagtgccctcattttatcacttcctcaaacccctttagagactgcatcctgctgctagattctttgacttgttgttgaatgctttccagaggctggttctggtctacttctccaaactgatcttttctattccgaagagtgaacctcccactcttgctacattagtcgtctaactgtttcctgaacatactagacacttttccatttacacagtctctagctagctggagttacctccctcagctcatcatttcatcaggagggttcagccgtcctccgcagccccacatggtctcctgatgtgtcccattcatttagcacacgtcctcagtcttcattcaattaccttttcctgtgtacacactcaccagttggactgtacagtccttaacaagttataccaattctaaaaaacacctgaagcctttggatctgtactcaaaagaaaattctttgtggctatgggtgtttgacttagggatctcaaacttggttatacattggattcacctggagaactttaaaaagactgatgtggggtcctacctccagaagttaattggtctggagtgttggctggatatcagaattttaaaagctcccccatggttaaaatatacagccagtgttgggaacccattgttctagaatgagcatccacaatgtgagataagatttcctcaaacacacacaaatatttgtaaatattttggtgtttggaacttctttttaaaagaaccatccagc

SEQ ID NO: 89220 - DNA, 1098 bp, Homo sapiens
gtgtggaatacccttttttaaaaaaaaaaaaaaaacaattcagaggtaaactttatctcatcttgggatgaactgtcaacttctgcattagtcaagttttaactaatgaaattttattgcaaagtatggagaaagcagattatgaattctaagtttctcatataaaattgtatttcctaggagagtgcgtagaagggctgcgggaaaatgactatctgctgattcattcctgccgccagtggaccaccatcactgcccacagcttggaggagggtcactatgtcattgggccaaagatagagattccggtacattatgcaggtaagactcctccaagggccaagatgaggcagcgagagaaaggggatgtgaatagctaaacttttcctctaagaattgtctgtaaactagaaagtagaatgacttagagaatcaaacatttgtgtgtggttattgatcagtgaaagctcagattcattttgttagaagtatttctaattaatgcatgtagttaaatgaggattcttattaggtatttataagatagaaattttacaaataaaacacctctattgtcttggaattaaaatcaatacatgtagccaacctcagaacttcagggggtcatgtctctgaggaatcctgtatacagtttgaacattgcttttgtgaatgactttgtgaagatttcacaagattccgtctcacaaattaacattgtggtctgggtttaaaagtattggattggtagttcatatacctggatatgtctctcctttcaataggcatttagattacaggcaactgagatgccctcactactttagttaaatgagtgtaatacctgccttctcacctcactttgaacccgactcaatgcaatagtgccatataactgatttttattgagtatattctgtgtgccagtactgttctaggaggttgggatacatctagtggcttaaataagctttaaatagtgatagcttataaatgccattaaaaaaaaaaacttatgttaccatatgctttttccggcacttataatacattatataaaggatcttagccttttctctagtattgttcaatattttc

SEQ ID NO: 89221 - DNA, 1022 bp, Homo sapiens
cacttgaggaggcagtctgtccattctcatatctcagactccgtgctgggagaaccactacactcttcaaagctgtcagacagggacatttaagtctgcagaggtttctgctgccttttgttcggctatgccctgcccccataggtggtgctctacatttctcattcctcttgcgtagcactcatcatggcttctctaatgtaaaattacatatgaacccacctcactctcaagaatgacttcttgaatgtagggactaagtcttctttatatttttgcccattccctcattgccttttgcataaaagataaaaaatgtttgttggataatgaatgaatgtttgttggacttgttaaaaataaatgtgtgaactgtcccctgttctatataatcctgatcttcttacccattacttcccccacccagcatctctcaccttcgaatgaatttgtaatttaattacttagttttgttattggtattggctgtcttctccctgttgaatagtaagtgccctagggcagcgatcttgggtttgttcacccgtatgcgcctagcactcagaacagtgcttgttatattggttgagtgaatgaatgaaacttgaagccaaaggtcagtttttcccctttctttggattattgtcagtgtttttcaaggtaagagacattgtggcattggaagagcaggagagagatggagagagaccccaaagtcagcttctgccacttactatgctgtgcagctttgagcaagtttctcaactcctctgaaggtcatttcctaacttttaaaggttaatataacttgaattacaatatttatagaaggattacgttttagagggaaaaaagcataccataaaatcagtagcttatgtgtcctgatcactgctaatacctgctagaactggtgctacacactttccattcactgtgtgtctccacatccactctgtgcagcagggcctgttgtattaataactatttcacaggtgaaagaaggaggttcgtgcccaag

SEQ ID NO: 89222 - DNA, 1014 bp, Homo sapiens
ggggtcccttcactaatcttacccatgagggctctaccctctacttacttcccagatgccccacttccttataccatcaccctggaagtcaggatttcaacatgcactttgggagaaaacaagcattcagcttattatccatggagggagactatcttggtggcccgacctaatcaggcaagccctttgaatggaagagatttccctagttggtcacagaagagaaagtcagagatatttgaagcctgagagggatttagcatgagacaggttttctggtgctgagaaggggatggggccactgggcaaggacctgagaataggaatcaagagcagtttccagtgaatacccagcaaaaggacagggacttcagtcttaacaactgcaactgaattcttccaacaagaatgagcttagaagaggaccctgaattccagatgagaatgcagccagctgacgccttgatttcagcctgagtggagagcccagccttggagtgctagacgtctgactatatttaagctgctaagtttgtggtaacttgttacacagcattacaaaactaacacgttatccttctcttcatttctgtctacttacgctgattattggtcttgagtcttgcagtgttagcatctctcaagcttacaatatgttttccatctgtggccttaagagccactgttgcgttaaatgaaagagaaccctactcgtttctttccccttgtctctttttgaaacccccagttcgatcttattggttctattgtattatgatacttggtatggatttcaacctctggggcaggtaggaaaggccttagcctctcagttgagaggttacttgttaaatatcatcatgcttaaagtgatttgaggatacaggtttctttcccttttactttactgagttaattcttggtgattttatgtcatgctcacgttatcctttggagtgggtctgttattcccatttcatatgtagcaaacaagcaaaagaacagtatgtggct

SEQ ID NO: 89223 - DNA, 1052 bp, Homo sapiens
agcgcagatactgaggaaggaactccagctgctgcataagtgagaacagtctgaggtgccgcaagattgttggattctctgtaatgaagacagagccacggcagagaacgttcatgtttatgaaaccaatgcagttaagtactatgtggctctcttgcatccagctttgggattctatttttttttttttttcatttttgaagagaagggggtctcactgtgttgcccaggctggtctcaaactcctggactcaagctgtccgcctgccttggcctcctaaaacattggaatacaggcatgagccactgcgtcagccgggattctgttctttgcaaattaaatggaaacgttttttacaaacttcccatgggtatatggtttcccagtggtggtcattgggatggatgagtgccccagggtggcaattcagggtcaggaatagtgaatccataaagtgggggagtcagtgcccagcagcagttgaaaccattagatgcatcccgggaggtagagatgtgtaggagtttaaatcatagtgcccatttccctcaatatcagtggccagcagggtttttttttttcctatttttaaatattttctggtccctaatatagtcattttggcaaaaaaacaaaaagacttccctttcttctttccccttcctgtctagggttgaaaagtacagtcaaaggagcaaagaaaggaagtctcaagacctcagcatgacagatagagtaataattttgaaactatttaaagctatgataattatgctcagttaactttaaaaagccaagtgaaattgttgaaaattatttcaaactttattcttaaagactaataggttttggctgcattcatttctcaattaaatttatctgagtttaagattctgtttatctccagagcctgtggagtgtgttcttttggcctagtggcactgtaaatgaagcaggctatactgttacgtggctcttccactcaccttaggcgaggtgacaactgctttcgtatcataatatctcaaagtataaatgggtttcggttgct

SEQ ID NO: 89224 - DNA, 1064 bp, Homo sapiens
ttttaatgtcagtaaaagaatataatttttaagaacaggaaaataatcatgctttgcctgttggccaggccattagtcaaacatcctattttctctttcagactctagaattaaagaaagaggccgggcatggtgactcaagccagtaatcccagcactttgggaggctgaggcgggtggatcacgaggtcaggagaccgagactatcctgggctaacacggtgaaaccccatctctactaaaaataccaaaaactagctgggcgtggtggcgtgtgcttgtaatcccagctactcgggaggctgaggcgggagaattgctcgaacctgggaggcagaggttgcagtgagctgagatcacaccactgcactccagcctgggcgacagatcaagattccgtctcaaaaacaaacaatcaaacaaacaaaaagaattaaaactggagaaaattcagagaagagtagtagaaatagtcaaaggcttataaaaaataaggcccataaatgaggaaagggtaaaggagttgtgaatctttaatttgaagaaaagtttaagagaccacttaactgtctgaatatgcaaaaaattgtcaagaaaagaaggctgaacaactgttttctttctcacaaagaactgaagaaagagaaacagttcaagagctacttagattagatgaaaagaagtatttcttgcaaaagagaaatccatatgagtcatgcttactgttcaacatatctttgtttggctgtgttcttaggaggtagggtacaagccttcactgaacatttgttgacttagagtcttggacacaatattagcactcagcctcaaaattagcatttttatctcgcactattctttatttcttggttcttctatgcacattactctctcttttgtgtctccaccccctgtttctctcttctaagttataaggtagtacagagcacaaaacaaattcttgtggccactaagagactttccaggaactgatcaattagcagactatggaggaaaatcttttcccacaatgtttatgaaaatacttggaatcactgtttacc

SEQ ID NO: 89225 - DNA, 1043 bp, Homo sapiens
gccaaaccattcatgagaaaccacccccatcatccagtcacctcccaccaggccccacctccaacactggggatcacaattcaatgtgagactggggcaaggacacagatccaaaccctatcaatggttaaagggtaaactagacagaactcccaaaagttgtctcttacaataccatgtttaagtttctagcttataagaattaaagcctctaatggtatgtggccttcaggaaggttacaaaatttatcaaacttgcaaatacaagtttttcgaccatttttattcataagcttgtcaaactgttttaacaattttcctccaggtggctggctgctccacatcttaaagatcactgcatttttaatggcattatattttttaaaaagatgatttccttttcctcttacataatctaccaccatttttagaactctccatataatatactttccctccatatatagtcatattttttcatgcacttttacttaaatttcataggacccctttttttccctttattcatgctattgtgtgttggaagttttttgagacctaagaaattttaattttcagatttagaaaatacagctttaatatacccacaaatgatgtggcattttttgaaaggtcacattttttatggttagaaggaaaattggaaatattcatgagtcattttagttgtctgagcttaatgccagtttttctctccaaggttagatgcttaatttaaacccagagtatcacttatcttcacgtgtctgattttgatttttatgatgtgacagaatataatgatacagtcccttggaggaaaaattttaatgagcatttgtgggtgataagcatgttgctgccatcagcttttctgtcgatgcttctgatagtggtgatactgcaccagacctcagctccctcaaacatcaccattgcaatcatttcaagattgaactctcaatttccatgtcaaactcagggaggcagacattcctggttctctctccagctctgtcatttattaacagaatgatttgggg

SEQ ID NO: 89226 - DNA, 1044 bp, Homo sapiens
ttagaaagatttaggcttggttattgggtattaacaatagtgattctgggaggtggacattacccagaatgctgaagttgttctttgaactatttctatttgattcttatgatagaaataatcctaagtggcttttgatcctttttggatcccttgccaaaggatcatggactccaaaattattaaaatgatttagaatatcactgggaaaatgtaggagaaataaaaacctaatagtgtagaatgacatatagttttaagttgttattgatataaaagcggtccaacagtgaatcaaaatttgagacagggcatttccctttaattgatggagataataaaagttaatatggacgatagagactctgaaacttaccttgcccgttccccctcccccataaaaggaaggtgtcattgcaagtctttattttagagagttattttttgagaggagagggtagtacataaagaaacataaattcattctgtaaaggtttttgaaactgtaaattttgctaaggctttgcagatgatacaaaaaaaaaaacttgaactactgaatgagaaaaggagaatagaggactatcagggaattcaggggcaagaatgcagcaaaggactaaaacaaggaaccgaaaagatggaagatgattccacatactcattcttgagccaatcaactgtgtctggagagttgaagcatttagtattaaatgttgtgtctggggcccctcctctgggggtaagagtgacatttaatggttgtattagtctgttcttgcatttctataaagaaatacttgagactaagtaatttatttaaaaaagaggtctaattggttcacggatctgcagcaatatgggaagcatggtagcatcagtttctggggaggcctcaggaaacttacaatcatggcagaaggcaaagggtagtgaggtacctcacatggctggagcaggaggaagagagagaggggagaggtgctacacacttttaaacaaccagatctcacgagaactcactcactgttccaaccacagggg

SEQ ID NO: 89227 - DNA, 1742 bp, Homo sapiens
atttctaaactctttaaaacatttttcttttatttgtgctcttctttcttttggattgctttcggtttattctgttcttttttttccagttgcttaaagtggaagtttagattgatttgagccctttctacttttataatgtaagcatttaatgttataactttctttctaatcactgcattagtagtatcccataagacactaaaaatcccaaaagacattgttagaatttttctttgcaccatcatatttattttaaagaaattaagaaaagaatagtctgtggtatttacccagatatttactatttctattattcttccttcattcctgatgtttccagtttccttctgttgccatttctctctgtttgaataatttttaaattattttattttagggcagatctgctgacaacagatatttctcttagattttcttcacctgagaatgtctatttcaccttcatttgtcaagaatattttcactgggtatagaattctgggttgacagttcttttaggacttgaaaaatgttccagttccttttgacctccatgatttttgatttttgatgaaaaatcaacagtcaattgaatcccatttttttctataggtagttgttttaatcaggttgctttcaggattttttcctttgtctcgtgttcaccggtttcattgtgatgtgtaagggcatggatttctttaagctcacccaatttggtatttgctgacatttttgagtctgtaaatttatatctttcactagatttctagagtttttagccattattcctttatttatttgtttatttttgagacggagttttgctgtgttgcctaggctggagtgcagtggcgtgatctcggctcactgcaacctccacctcctgggttccagcgattctcctgcctcagccttcccagtaactgggattacagttgtgcaccaccacacctggctaatttttgtgtttttagtagagacggggttttaccacattggccaggctggtcttgaactccaggcctcgtgatccgcctgcctcggcctcccaaagtgctgggattacaggcgtgagccaccatgcctggcctttcattatattcttttttaataccatactctcttttccttctggaccgttatagcatgaatattagaccatttggtattattcgatagtatcctgaggatctgttcatttttttcccttagtcatgttttaatgtttttcatattgggtaatttctattgatttatcttcagatttactgacttttctctgtatatcagatctgacatctgtgtgcaccactcagtaaccagtcttggtcttgggtagtggtctgtactgcagttcaattcttaaagcatttgacgagttgtttatggtcagatccaggcatgcaaagctttcctacaaagggattcatactcaaatttataggatcactctgttgaactcctttctctctgtgatatccctgacattttctagctctctgaaacccccttcctagtcttctggccaaaaaaatcaaagctttagcttttcctctctgccctgcactccccacaattgcatttacagggccaagtggcaagagtacaaagagatttaaaaagcaacagttatttgccccatactcttggaaccacagtttctctagtcagagaggattctcctcgttcagggttttagggacctacctagctgttgccgccactgtcattacttg

SEQ ID NO: 89228 - DNA, 1115 bp, Homo sapiens
tgggttatcttttcactttcttgatggtatcctttgaagcacaaaaattttaattttaaagaagtctaatttagttttctcttctgttgcatatgtttttgattttacacataagaaaccattgccaaatccaaggtcacaaagatttactgctagctttcttctaagagttttatggttttaactcatacatttgggtatttgatccattttgagctgatttttatatagattattttttaatgagagttatctgtgtttcttagctgttttatcttcggtgtgtttctagtgtttgaatccacatgaaattacatgaaaagttttaagaaaaacacccatttcattcttctttgtattatttttggtcatttggtggaatccacttactgacatagagttattaattttaattttctttaacctaatgctattgtgagttgaagaatacacatgttcccttttacagtagcaaatacaagtcagtgtagtgctgaaggctcttgctctgttaacctgaacagttggtctctgttctagaacaatatcttcattttctgagaacatttgtttgggatctttcaatgaaagcatctctcttcccatcagcctcttatctgcacaatgaacaaagctactgagtagagggcaaaagcttaagacatgcaggtgacttgggaactgccacatcccatatgctgtaagtgctgaaagttaacatacatattaaagttgagttctggcaacttcacaatatattctcttcctcaaataatatgctataaagttttattataaagtcatcttcttttaaattttttattaaaacaagatgttttttcatcctttagtatgcttaatttagcatttggtgatactgctctttttataaatagcatgttttaaatttaaaagtgttaagatctcttaaaatgtactttgtatttcaaagagcttctgctaccctgaaatatcacatgccgagtaaaaagctgaaatggaatttttgcactgaattcacataaatttgtttctgttctttggttattttggtgtacttagcttatcaggttcttaaataatttgctataaatagctgagtttcacattttatg

SEQ ID NO: 89229 - DNA, 1560 bp, Homo sapiens
ctatttatgacttactatagtgattctaaacttttttaggtggaaataatttattacactgtagtaagatgattgaacattacagtcctgcgaaacaaactaaatcatatttacacatagaactttgactagttaaactgggagtctttagcttcaaccagtcagcttgattatctttcgtcagaagacttctggtttatattcattaattcatgaacttgaaatattactatagcaatagttttgacaagactattgatgccattcattttattttctctctctttttaaaataacaatgtgaatggggttctaggggggagtatatacccctattggaagagcagactgctggtaagcatttctggtgtactgttttacacatagatcataggtatactgcttacaaatctgttcttttatcttcatgaaagatgcccagataatagctctttagccttttttttgcaggggcggggggtttagtgaaagcaatatatcttttaataattctgtaatttaccctttttactaatatgtgtatattttcccacctgcattcattagtttatatagatgctgatgtctttccaaaatgagaaatcaaagagcaggtttgtgttggggagtggaaaagtaagatgatgaggtcaggggttggatgtgctgactttgagttgctgatgggacttccaggtggagatgtaccccagttggttgttttctctctcattcacctgtgcacatccatgggcacaggtgttctgggatctcaggtcatggacagatccatactgatggttgggaagggaggcaggatacgctacaagaaggaagtattgcctatgctgagtcttgaagaacagataggaattaagccagatgaagagggcctgctttattttcctgtatctctcaaacatgtctgttaatcttacaaagtcatacccacttaaatgttcgtgccttaggaacatatgcattcaatctagaatttgctgaaccagcccataggaaaagggatatagagagtttttcacttgctagcactaggttaattcatcggggcaggttggaaacaactggggtgagacctggcattgttgggtgtttggggttcccagggacggcttagttcagctggttttactgtgatcctttctgttttttggaagtattaaccctcttgaggattatttctcatatgaagactatacttaaaccagaatagaatgtgaaatttctagtgactcccaaatatgcagtggaattgctgctgtattttgatatctggcatgatcatagaatcatcccgttgaaaccagaggccttttcttcctagcaccctagccatgcacttaaacataggtggcaactgaggttcacagagccattggcatttaagcaagcctgggggcaaaagcagagcaggacttgagccccttaactctgagcccatgctatttgcatatagtaaattacttttaaaaacattttattaacatgttttattgaagaataattcacatactataaaattcacccttttaaaaagtgtac

SEQ ID NO: 89230 - DNA, 1385 bp, Homo sapiens
ctgtagaaataaaaccaattttgtgaacatgcctatgatgtgcaaagcggatggggaagtataaggtccctatcatcaagaaattttaaaatttggtacttttagtactaaagttacatcatttcttacaactctttctgtaaatttggaagatttaacaaggaccagatctataccaatcctgagaggtaactattcatcattattgctttcctgtaaaataaatagttttctagacttcaccactacattgttatgatgcgataagaaaatgttgcattaatattaatatgactatatatcttcttttaaaagccttacttttctataaagggaatttatttataatatgaggagaaggagtgtatgcccataggactgtgactcagaaatttatttgacgaatggttttgttaataagcttttaaatatgcgaaagtaaaaattcaaaagtagagaatttagttgaatgttttgatatgtaaataagttagccagtttcttatttaaaggtatatatattaaattccaaccagaaaaatagtcttaaatttggtaatattttattcagaaatttggctcaaaacatggaggaatagtgtagtaaatgtaaatgaattatcagaaacccacgcacagcttcctactgaatgtaaattaggtggtgattattgccttgaaagggttgtaactgctgtttgtgcacacttgtagtagaaacagtgtatatagttttaaaagcagcaaagttgcatgtaattagtgctctctatggatacaggacaatcagggccattgatggcctgtggcagttgagcctgctgggatgatgtatacagtaaacgttctttaataagatactgctgctcagttactgtttggaggttgtgcctgatgacactcaccacggctggatttttctgtttccactctgcactcacagagagttttatgatcccagtgtcttgaagttttaatccccacatttatttacctagaataattataggaattgcaaggggatttgagaaaaagtgttgatggaagcaataataatcagctcaggaagcctcatacaagacatattgatgaactcacaattagaacaaaataggaaatagagaaatattggtactacatttgtcaacttctgttttttgtttgctttggaagttgttattcttttgaaccacagtcagatacggatttcatttccaatttcctcttgtccctgtgtgtgaacttgggaaattaataaacttttctgaatttgtttctctctatggagaatcccagcatcctggtttggtcaggatagtccagcttgcatttcttatgccctcttagattctcagaagtgtcttggattgggcaatacattgtat

SEQ ID NO: 89231 - DNA, 1018 bp, Homo sapiens
gttttattccttccctttttatatttgtctttttaagctgtccaagagcagagagcagggatcctgtcttgtctttgcactgttcatttcacacagttcacatgatctggtgtgatgttccaacagatggatcaaaaattttgtctgaatgactcatctacagagttgttgggatacttcagcctatccctaaagtatttacaagcttccccgactaatacacacacaggtgcacacactctgttctttacaatctgactttttagcaggttctgggcaaggaaagaagtgatgattccagcagcctcttcctgctcaaggaatttagagttctttctcagtctctgacttttccaactgtctcaagcctggaagagacccagaatatgagaatatgtcctacttttaagacttagtgaattatatttgcatatattagcctgatggaaagaggttgaaaaatactctgaggcttgtgaagccaattcagcattaaaattttgctgggaaatcattgagatttggctatactacttaatcagaaggtgttaatttgtctggatgtattgtaagaatatatttcagaatggaaattaacatatttcattgattctaaggtgtacattttcatatctctgaaatcagcatgtgtcttatagttaatggcatgacatagttttatcagcagcattgtgtcttggtggttgtcaaacaatgattgtcttgcaagtgatggcattctaaattgtatgaattgtggtagtgccatggagtatctttgggtccagtaattcaatgtgtaaagcaaacataagaaacaaggactttttgtgaatgtcccaatacagggtgggagataatctaaactgaaaatcaagtagtattccctgaaccatccatccctaatggagaaagtgttagcttactcatttaacaacaggtaagatgaggtcactattatatacaaccatagtgtaattttttctcatattacgttttccaactttaaagaataact

SEQ ID NO: 89232 - DNA, 1015 bp, Homo sapiens
tgactaagaagagaaattaaaagtccagtttaattctctctggacatagatccaggggttgatgggtaataaagtacatatcaccaacagggcacatgtatacatatgtaacaaacctgcacgttgtgcacgtgtaccctagaacttaaaagtataataaaaaataataattaaaaaagtacatatcactctgccaatttagcacctgaggactctataaatagttgtatttatcagtgttgtggtggcagttgctaaaagtgaaacaacaagatagctttaagagaatcttttagtgccacaccaaagaagcttcaaattaactttatagtagatcaggtagactgtgaattttactcacccctcccccatcttctgtttcttttttttccccttgactcaattgggaagatacttacctgagtagattgtgtacagttgaataatgtgtgttatcagaggagagtttcttgctaagcagaggccatggagttgggagggaggaaatgtatgaactaagtataaatactatttgtagtcttcattcccctctgattataaacatatatattatgaagaatttgaatacctaaaactatttaaaaacttaggtattctgaagtcttgatataaccaccaacattttgattcattctctgttctttctacacacacacacacacacacacacacacacacactctctctctctctctctctccccccctacacacacaatctctctcccccaccccccacacacaattttacataatagtggcattttagctactttttaacaaactttcttccttcatgacagaccccattcctccaaaccagcccacctacataatccaaatgtaatccactctaacagtccagtgcatgttcttcatatcttcttcatactcacagaatcctacatcgctattacatatacatacagagacatgcagaattctgtcattgttccataaaaatgggattatatgacaaatacttttcagcctct

SEQ ID NO: 89233 - DNA, 1027 bp, Homo sapiens
tacaaatggcttataggtatatgaaaaaaatggtcaacatccgtcattaatcaggaatggcaaatcaaaatcgcagtgagatcgatgttactctagatagaatggcaaaaagacaaaagtgttggcaaggatgtggagaaaagggaacctttacatactgttggtgggaatgtaagagtgtaaatttcaattaataaagccattatggaaaacagtatggaggttcctccaaaaattcaaaatagaattaccttgtgattcagcagtcccactactaggtgtatatccaaaggaaataagtgtcaactgaaatgagtatccacattgtctgtaaaaatcttaagacattcagttcatttctgaaaggaaaactggtttgactgttgtgatcaactgcattatagtttaaagagggagtattttagtctctttcactcattggctgccttactgaaatagcaagttcttgtagaccagcttgtaaactcgtttatttttgtttgagattcctgaggtatctgtcttttcacttactgagctgccggttctaggaagactcataaactccccatgcatcttcagcaggactctcaatcttaacaacaccagctatgatatgccatgggaaaagtaacttttatttctggtttatgtattgtttttgtaaaatataaaatacctgctaaaatattattatttatttatttattttttgagacagagtcttgctctgtccctcagactggagtgcagtggtgcgatcattgctcactgcagccttgaactcccaggctcaagtgatcctgccacctcagcttcccgagtaactgggactacaggcacttgccaccacacctgcctaatttttgtattttttatggaaatggggttttgctgtgtgcccagactggtcttgaactcctgagatagagccatttgcctgctttggcctcccaaagtgctggaattacaggtatgagccaccacccctggcaggatgaattatttcagacctttccacatgaaa

SEQ ID NO: 89234 - DNA, 1062 bp, Homo sapiens
ctaaaagatttggtgaaactctgtccctaagcacatttttcagttaaatgctaaaacttttcattctaagtttaaatgcttgcaggggatgtaatttctcagcatattgtaactattcatattttaaagtattacatcattctaaaaactctagtaaaatatatatttgatttctaatatcatttgtttaaaaattcatgagattcaagaatcaatcttttgaaagttaaacattttacaccttttctttatctctttaaattcttactccatttctcttccgctgtatagaattctgtctcagtgtaatatatttttatgcttgaaagtattctattgatcactctgccatactctctgtaaccaaaaaaaaaagtatatagattgaaatctagtatttcgtatttattttgatcataagactttcaatatttaatgatttctggttgtttttaaaacaaagaattggaaattacctgacttaacagaaatagttgttacctaaatagtggagactttaaccctgcaacacgaatcaatatttttgttcctttgtttgtttctctacccaaggtcttttcaccctcaggcaatgcatcttagaaagatgtagagaaggtaatacaagtgcattacttttgtaaagtgagtgaagaaccattgtgaaggggagatggtgaacgacaggttccttccatcacagtgaaggtcatcacaggatggatgtccaacgcaagcgtggacccaagcccattaatttttaaacaagagtacgtttggaaatttcaaatgtagaaactgattcctttacagttgtgatgatgagacccttgggaagtgttagctttgccccaaacatgtaccccagtttaaagaatgctggtctagcacaataaaagatgtgttaatggccctgtttgctgaaaggaaaaggaagaccaaggctgcatggaaaggcagggagagggaagaaaaagagtaggagactgctaagtaggtagaacaggagcagtgaccgtctctccttcctggctgtgcataggaatcagatcagattctaag

SEQ ID NO: 89235 - DNA, 1003 bp, Homo sapiens
gtgtgtttggtcttctcttgttttcatcataacttcagtgggctttggcgtcatgcgattttagactgtttgcagaaagaagcctgccctgctgtggggcagctgtggaagtacacgggcccaggctggcaggcaggcagagctgtgactacacaggccaggtcagaagaacactaagcagaaagatgtcatttcgagtcacaggcactagggttactccttgtttcctggggtagaagagtgggtaacgtgagatgtatacatacacaaaggagtttttattctgtttcttatctgtggggtttgattagacatttgtatatctgatgtgaaaaatagatgcaggaaagttcgtgaaggctggaaaacaatcttggcttgcttgctatcctcgtttgattgttggtagtagtagggtgcattgggaataagctggaagttttaaaactagtaatgaagtgcagatcacagtagctgttgaagcggtggggtgggggcgggggggggggacgcacaggtggtgtgttgaggcgtttctgcttcgagtgggggtgggaaaatgttgtgtgctttaaatagcatctgcagacctgaactggtgtgtgtgtttgtattcacagcgtttcatttcctcctccaaaattgtgtatattggcagattgtgagtccttaccttttcctaccttctctcatctctgcacactgccacatttgctagctaggcagagagcattgctgcatgtggtgtaaaagccactcaaaagcttcattaaactgaaagtttaaaggggtggaatatctcactttccgacatgactttcagttttatttcccacttttctatccctgccattcataaaaaggatctgaatcagcagtgtactcatcccacacttctttctaaaatgaggacgtgggtagcaagtcttaacactgtgtcctttcaagctgtggaatggattttgatcactatatgtaattccaattcttcattgtaaatttc

SEQ ID NO: 89236 - DNA, 1051 bp, Homo sapiens
tcctttttcggactccgcccgcctgcacccaggtgaaataaacagctttgttgctcacaccaaagcctgtttggtgatctcttcacacggacacgtgaaacaattatgtttctaacacattaatttgggggacatattcaaaccataacaataaaacgtttatgaaaatcaatgttaagggcacagccctgcacaagactgctcttatttcagatgccagttgcaagtttgggggtctctggggccacccttacttctgaccaactagctacatattcaaaggttcgtatggctaccctcaggtttaataattcactagaaagactcatagaatgccccaaagtgctatacttatgattataattttaacatagcaaaaaaatacaactcagaaccagattaaaaaaatgcatagcttccagttatcttctccctgtggattccttcatcatgttactgcttccagctctggtgtgtgacaatattcagagtgttgctaaccaggaaagttcacccaagctttgatatctaaaatttttattgaagtttcattgcatagcataattgaattgttggccatgtggttaactcaatttccagccccttctgttggggagatcagtctgataccatgtggctcaaagccccaaccctttaatcatggccttggtctttctggtgtggccagtcctcatcttgagttaactctttagcacaaactatctaggggcccattatgagtcatctgactatcaggtgtggtctgaggaacccattatgaataacaaagaccctccaatcactggaggtattttaagggtttagaggttacttcccaagagctggcacaaaggtcatacctctctttgggtaaatttactacacagatgtggtattctttactacacagatgttttaatttaaaaacttttagatttttaacatttttggaatatttttatgacttgcataatatacagattaaacttaattttttccccaatgagtagctagttgtttcaatactgttacaggtagataggcatgagcg

SEQ ID NO: 89237 - DNA, 1030 bp, Homo sapiens
agtttgaaagcttcatatcctaaaggctgtattgtctcagaatgtgaattaaatacccataattcctaagaagcatgtgagtgtagtggggttagggcttttaactaaaattggtttgaccagatattgatatttcggcatattaggaagtaaaatgtatatggatgtataattttaaaaggcaataattgtagctctaaattttagcttctaaatattagtttgcaatcaaaacacaaaatttgttccaaaatctactccaggaaatatatatgtactttatattttataaacatcattcaagtatatgaactcattctaataatgtttatacatatgtactttgatattttaaatgttagtttaatgctgtttgatttctttaaaaagtgatctgatattccaatcacttgcatgtttactacagaattctgttagctggacagaatttcccaacacatatttctttgacatatctaactgagaaaaggatgtcattgtagaggctgtatcagagatagaaacacatatgtacattcttattttgccatgtgagaaatgcagtcctgtgagtaacttaaatacttataatttcaaatcagttcttccctggtttattattcttttgttgcttttaaacgaatgggatggagctgctcttgaacttggtgggtttttttgtttttttttttttgatcattcaagtgcaaccatcaagttgtctgtaatatttaaaagctaaggcttcatggtgttatttgtaaaataacaccacataagtatttgggctttggtttctgtaaaatatagtattggttactctatgaataaaagcataatttcaattcaagagacttttgcctgaagccttataagacagatgcatctgattaactttggtgaaactggactagccctttattgtaatgtagatgttttcagggttgagagggtatttttaaaaggcatgcaaagaggtctttttttaattatttttttattttttttaagagagagcgagcgagactca

SEQ ID NO: 89238 - DNA, 1050 bp, Homo sapiens
aattttgcccagattccatgtaattgctgaatttcttaagacagcattgcaaaaattgactgaacatgcagcattttaaactgtagcaacctcagcaaatctacagctttcttttcttttggatagctgaatggctatgaccatgtagaatttttgtaagtgtattaaatacatatatatatatttccatatacatatgatctgtgtttgtgaatatatgtttcttgtgtatgtatacatgcacaatcataatcatatgaacctagggccagcagaatgatcttaaaaataattacattagctgataattagctgttatggtttctagacactgtactctccattttacgtgggatatattatttaattctcatgcaaatgctttgaagtatgtacttatatccccatttttcaaaggaaaaaactaagacccaagtcaggtaacttgcccaagatcacccagcaagtaaatcttagagatgatgtttgaatccagaaccgtagtttcagattctgccctcttcacaaatactgcctttcagcatgtgctatgtaatagtatagacgaatttttgatgctatccaagaaaatctacatacttgagttgttatatagcatatggaaagcaatacagcatagttattaaaaatagcatttctgaacacaggctgcttatgttcagtaccagcccatactgataacacacactcaaatatatgtcattgttattttattagaaatatgttgtgattcagtaggactttagtagtctatacattaaccagcgtagactcttagaaataagtagatttaaaaaattcctaaaaccaaatagctttataatcataagtggagtaaaaaaaataatttacaacaaactgtcttacaaaatatgccaggcataatttctcaagtctgaaggcctgtactttctacccctgcctaaagcatgttgctacagagagggctacatgtttacagggctctttgatgtcatagcactgttgattgcagtgtaattgtaagctggacaatctggaagctataat

SEQ ID NO: 89239 - DNA, 1018 bp, Homo sapiens
tttacacatttggtagttccagtgtagtttgtttttagaagcttttgatcctgattaacgttttctggcaacaattagtggaaacatcacacttgcagtttaaactaccagaacacattataccatttgatattgtgaatggtaaacttagaaaaggagaaaatttattaaacgctctttttaaaaagtcctctgcattgtataaaacattaggaatttggtaagctcatgtttttgtctttcagtatcaagcaaagaaagtaatgaatatgaatattgaaactgtataatcaaaagatgtaatacttttcttaacctatatttgtaggaacagacacaaaggtctaaattatgcctttcttatatatatttctttcttatatttattccaatacaggtcttaaatgaatttccatccagaaaggaaaatgcattatctttagttgtgctatttacaaatgatgatttattcagttctgcaatctgtagcctcagatttcatattgttcttgctgtgcatactactaattgattactgtacagtgattataatgaatattcatggactgactcataaacagtaactgtttttgttatttttctgactgtggttttggtcataaatcctttatgctacatcagagtgaaagaaataataccccatgaggagtcctgtatacctttccacctggcctaactttatgcctaaggcacctatattaggccttgatctggaatctgctacagacccagttatttatcatgatactttgtatctatgacacaaagacaaatcatcatagtggtcactgagatggaagcacatttttgcttctatagtggacattgctgttgatagcccatgcatttttcttttcattaaagtactttgggagatcctgtagcataggatttgggggtcaaatagatcccgagaatgaatatcagcaatgtggcttattagctgacttagtgattctttgtggagttgtgaagaataaatcatctatgacaagtc

SEQ ID NO: 89240 - DNA, 1055 bp, Homo sapiens
agatacaggcaatgaaagaacaatgcctctgttgtactggatttccagcagggaatgatgctgtttgggttaagacacaggtaaggcagaggagctttgagaataccatggctcaggaaggaagaaatgtgagaaagctagagaggtacaggagactacagaggagaagggaaaggcaaaatctggattctgagtaatcagaagttgtcgtctgctttggtggctcctatagttccctttgtcttcatcagtgacctgagaattcacagggttttcaccagtaatgtcactgggcaagtgtgccaggccgaccacccaataagaggacaaggaagagagagtggaaggatcagcagaactgtcaccactctgattctgtggtgtgggagctggggatgtggggtggggaatctctctctagaggtttgttctctgctgtgttactcccatctgtgatggctttttctccatgagcttaaatggtgatggttttcttccaactattagggaatacattgataatgttagtgattcatagagtgtctgaaataatctctgcaaatgttatgtgtagttggttatctggagaagtaacaagcttttatcaaccataataactaaatttgtatggtgatttactgtttgcaaaatattcaattatgttatatttgaatctcccacaatcctaggaggttgatgacaccatcaattcctttataaggatgaaggaaatcaagctcaattactttcctagaggcactgggtttgatagcaaagcacaaattttaatttactggtttactaatgcatcctgcttcattcaacacctcttcacctttaaaagtaaaaattgtctcagtgatagctatttacctttagaaaatggctattacaaataaagaactcttacatttactcagattgttcagattaaattctccctttaaacatactttcaaggtagtttatgtacacagtaggtatttaataagtgttaactgcttgattattgtctctttgtactcctccagagcaatcattctgattctcacaca

SEQ ID NO: 89241 - DNA, 1030 bp, Homo sapiens
aatatacaggaattttaaaagagctttattgtgatataattgataatgaactaaactatttaaattgtacaaattaataggttttgacatatatatatacatacacacacacacacacacacacacatatcctaagccatctttagaatcaagatagtgaacatattcatcaccaccaaaaatttcctcaagctccttggtaatgcctcccacctgtccctcccccatcccaagcaaccacaaatgaattttcagtcactatagattagtttgcattttctagagtttatgtaaatggaatcagacagtacatacttttttggtctggtttctttcactcagtataattgttttgtgacttatctacattgtgtgtatcaacaatgtgttcatctttcttactttatttattgtttatccattcatctttgattaacattgaggttctttctggtttttgactattacgaataaagctactatgaacattcatgtgaaaatgtttcaacagatacatattttctttccttttgagtaaatgtctatgggaattttaaatgatccatgaaagaaaaaggactttataaatataagaattaaaagttcaccatggaaaatcattatatttgacaacattaacattttaaattactgcaactcaaaaaaaaatgttcttaaccaaacttcaggttaaatgatagtcaaagaaactgtataagtaatagctaacaatgataagaacttgccataagcaaagcatcggcaactctgtctgatctatcagttgatcttcacaacagtcctaaaaggttaaacactatagtgccacatcctgtgtacttaaccactgttcagtggtgcctccctgtgtggagaaggagtatatattatacatagacggtatatttgtcaaaaaaagtttaatatccaatcgtaggaaattatgtgaaacataatagaaataatttatatattgtatatctctgaaataaatatgtgagaccatatgtcaataacctaaatataattt

SEQ ID NO: 89242 - DNA, 1022 bp, Homo sapiens
agaatggccagcctgttctctggttagtctggagctaattccttcaagaatcacaggtcagaagtgttgcattgtggccccttgttcagtcttggcaaaaactgagggaacatggcaaagtgggaagaatatagaccttggagtcagatttgggttcaaatatagtaattttcatggctctgggacctctctgtgtccatatgtcctcatttggataacccagttgtcagctgggacttcctagccccttgagggctcacataaagttggctcaaaccaattcgaacccttttcaccacctttgggaatactggagttactgtcccctaacctgttattcctctcaccctaatatctatgcacattgtgttctcttttccccctttatcaaattgcaagtgaaactctgtcccctcactggtgaccaccaaagagctcactcatgttggtgtgtccagtaacttcactgaaggtttggggttggcaaggactggtgtggggaggctcacagcctttgatgtctctccagaaacctctatctgcttttttcacccttcacatatgcctccagatagtttcctaggaacacaaatattttccctcttactatgcagagaaatttagctctcttctgttcttgttccaagttttcatactcaaatgcatcaagatgcccagaacaaagggtcttccaatggcctcctctgaaagcaaagctataaatagaaaaaaagggttatctgttatcttttgaaaatggtgataatttctaccttgctatttttcaagatttgtggccgggcgcggtggctcacgcctgtaatcccagcactttgggaggccgaggcgggtggatcatgaggtcaggagatcgagaccatcctggctaacaaggtgaaaccccgtctctattaaaaatacaaaaaattagccgggcgcggtggcgggcgcctgtagtcccagctactcgggaggctgaggcaggagaatggcgtgaacccgggaagcggagcttgcagtga

SEQ ID NO: 89243 - DNA, 1085 bp, Homo sapiens
tatgcttcggtatctctgccactacagtataagcaccttgaggacaagcactgtggcttgatcactgtagtgcactcagaggacagcgtggtcctggcttgatcactgtgatgcgctcataggacagtgtgatcctggcttgatcactgtggggcactcaaagtgtagtagggttcctggagtatgaaaggcactcagtaaaggcttgttttgtttccattcgtttatttttaattgtcagataattatagtgtatatttatggggtacaatgtaatgtgttgatccgtgtatacattgtaggaagagtcagtcaagctaattaacatatccatcacctcaccaacttattttttgtggtgaacatgctgtttgttgagtgagtgctcagaattgaaaggcattgtgtgctgtggaggtgcagaggacaggcaccaaacccaggcagttgtagaaagttggggaagatttcagaggaagatagacaaactgagatttgaagggtgacagcaagttagcttggcatagggagaggacaatcctgtcaaaaaagagcatggacagagtcctagatttgagaaagagcaggggccatagccataggcaaaaaaccatgcagctacaccttttgttaactatgcctgagaatcaaggcagaagtcagtgtggtagacatacgtgtgcatctatatatgtgcacatgagaggaaactttggtttttgaaagtttaattagatgcaataaaaagtcaaatccgtcagcctctaaaactcttgatatttagcccaaagccctctacatgattaaacatatccattaactttctcattattttctttttcctcaagctgaagtttattttttctatcacattttaattctctgttttaactgttggcattttagtagtatattttaaatagttccactgcagacaatagtatggttaaggaaagatatttgaatctaaccaccttgcatgaagttgttatatacaggaactgttgcaagttccaaacactcaacttagaaatgaacatttagaaaattacctgtttataaattgaggttttgagtgtataagg

SEQ ID NO: 89244 - DNA, 1045 bp, Homo sapiens
ggtggacacaacagggatgacattgtgtttcttgatccaagaatatggtttacaacctaatctccaatgttgattacatgtgtgtgctctttttccctagaacctgaggaacttgtccttgaataggacagacctgttcaagtcttaaagttatatttatattctaataaaaataaaattaggggtaaggatcatatctacagttgttttatttgtaaacattgtaaatttctttctgcacacatggcataccttatgtgtcctttttccccgcactaggggctcaagatctggatcgcatccgactctccacctacagaacagcatgcaagcttaggtttgttcagaagaaatgcaattgtaagtatgccagttgtttggactaattaccatcatgaatcctatagtttacatttggtactaagtttattaaactagattctgttacaaatattgctaatattgttatatatgtttacacaacaataaaaggggtattatgaggcacaaatggtagagatgactcctaagtagtcttgaaatctgaaaatgcttaaatactaaagcatatgaaccgtttagttcatactaaaaggatgaacctctggatacatatacaatataattctgaccttggaatggtttaaatctggatggatgtttttcttcttttctctaaccttggtatcataaatgcagtgccatcaaaatggtttccaacatcattctcagcaaactatcgcaaggacaaaaaaccaaacaccacatgttctcactcataggtgggaactgaacaatgagaacacacaggaaggggaacatcacactccggggcctgttgtggtgtgggaggaagggggagggatagcattaggagatatacctaatgtaaatgacgagttaatgggtgcagcacaccaacatggcacatgtatacatatgtaacaaacctgcacattgtgcacatgtaccctaaaacttaaagtgtaataataataaaataaaataaaaatggtttccaagaactttataaaatatcaaacat

SEQ ID NO: 89245 - DNA, 1029 bp, Homo sapiens
ggtaactaggtacatggtgtttctaataaccagcagaaggactgcaggaggaacagcaggttagtactacggtgagtctgagtattatggaagagctctgtaaagataatgagttctcttttgaacatacttagtttggcatgaggtatctaagtgaaggtttcagataaatgattacataaatctggtgctgaggcttagaaataaatatgaaagagtcactagcatagggttcagtcaattttgcattctggctggttgtatttgaggtattacactaaaaatgacagcgacagtgataaataacaaatgatccctctctgaaacctagtaaggaacaaaaccacgattatttatatcttatttttcttatatataaggcatatgaatcttattcatataaattatttattccatgtactaaagctttgccaatacaagctttacttacctttcagacacattattattttaaataactcttttgaccattcttaagattagcaactatcaaataaatgaattactaatatgatacagtttctgattccaaagtataagaataaacagttgattccagctggaaaatcatttagctgaaacattatactttttatcatatcccctttatatcacatttgtgaaggacagatttgttatacttcctgaatcaatgaggatttggcagcacttgtgtcatttgggtagaaagaaagtgttcaaacagagcttttactttttttttaagacagagtctccctctgtcgcccaggctggagtgcagtggcacaatgttggctcactgcaacctccacctcccgggttcaagcgattcttatgtctcagccacctaagtagctgggattacagacgtgcaccaccacacctagctaatttttgtattttcagtagagacaggatatcaccatgttggccaggctggtctcaaactcctgacctccagtgatctgcccacctcagcctcccaaagtgctaggattacagacgtaagccaccgtgctcggccag

SEQ ID NO: 89246 - DNA, 1044 bp, Homo sapiens
agccaccatgcctggcctaaaactatatttttaattgtacattacagtaattgaacggtaactctagagaaagcaccctctcaacagtgcaacatcttttaaagccacctataatgaaagaataggtacaatggggacagtgtggcaaaaataaaatcacttcccaaagattttcagtcagaaagctgaaaaatcatttttcctaccttttgtgtatttgcctgccagagaattctgttctgccttccacctcacagatgtgctccagatccacagaaaagttggtccataggagaaaaatggcaattgaattttatgtatttgctttctttgttttgatagaaataattccctcctccttgtctgcatatctcatgactcctgccttcccaaatacataggttcacattctcaatatgaaatcttataaactacatattttacagcagccacctcagcagagaagtgctcctgacatctctttcaccatcgatgcgaataagcagcaaaggcagctgattgctgagctagaaaacaagaacaggtgagactttgtagacgtgctggcttgtttgatcaatgtgcgcattccttaataaactatggtcgtgctttaaagtttcagggctttacaccctgtatggctactcaagggaagacatctacactcagtgatgctcacttccaaaaagctggtctttagatctttagaacttcagaagctccatgagaaaacggcgtgtgcatgtatgtgtatagttctgagatatcaatgcaattaatgttgcccctctagacggtctcacttccctttttctgagatacttaattttgttcaagagcttctagtacaggaggaccctcctgggtactaggtagaaggtgtctctaccacccagaaacaggtaggaggctcaccagagaggccccctggaaggaccctgagctaaagaggcatctggagagacaccaccatcacccagttactctccaaacatccaaagatctccacctgcagcccatcagcaggttcttcctctattc

SEQ ID NO: 89247 - DNA, 1801 bp, Homo sapiens
ttattccttttccctccatcagtgtcctctttaacaattggtattgggaatactttatctttactcaacaaaattgacttttcagtaattagatatgtacagtgtagaattcaattcttgttgatctatcttgggtaagacaagactagatagttcataacctgctgctgtttctggcctgttaatctcatttgataaccaaaaataaactctttctgcttccctttccaaatataccaaatgaaaaggactgaacctatctttcccctcagtgaatgacaggaagctttgaaaactgccccctatgtttctattgcttctgtcaccattagctatgactctttccctatgggatagaagtctattcaccaccagccatgttggtatcaacctagcctaacagagtactgccttttattgagatgtacacataccaggacagagaggtggattgtgttgaaaaatggttgtacatgcagagaaaagagatgggcctgtagtctcaaataaccaagtagacttggagtgatagtcactgaggtggcagaggcctggacctgccgtcaaaggtgtgttgatgtttccccatcttgcgttccttcacactgtgtacatgctcttattggaaccctgggtaatctaactgttattgattcaatctttctgtaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgc

SEQ ID NO: 89248 - DNA, 1111 bp, Homo sapiens
gggatcaattttatctctgccattctcttgctcagaaaccttgggtaatccagttatctcctcttagcctcagtttgctaatatataaaatgggaataataatacttcatatggttattaagaggattacatgaagtattaggggttaaagtgctttatggactgcaaattgctattcaaatataagatattaccacttgtaccactgtactaggaaaatgaaacaaaacagtgtatgtaaaagtgctttgtacattgaattacttacaaaagtggagttatattattattgtgaacttctcaccatggaagacaatctgagttcccagggatgagacggtaacccacactgatagccaagagaatcctacttcttaataaccactctgtccaacttcccttctctagtccccactcccggctgtgtttggtcccttgataaagaggacagagacaagaggctcaggagccttgctaaggcctctgccttaaaaagggtgtacaagaggaattgccaaagtaggaagagctcagggcatctgaccagcgtctgtctccattgagggactttttgccagccatggccagcaaggctcccgcagcccagggcactcagagcccctgggctcagccccagccctgcccctctgactccgtctccagataaagcaattattttcacctctctgagtactgggctccacaacttcacatttagagtaagaatgcatacttcccagggtcatggagagaaatcagtgagagtgtatgtgaaaaccctttgaacatcataaggcacaacgcaaatgtgaaattatttattattggcatgggaaggtcaaggatgcagtggtagctcagaagcagaaggtttcaaggtaatggggctgagctgccagagtttgctggggaaaactagacccctccttgagcaggccgagggaagcaggctgcaaaaacatcacaaccgggcaaagttctcttccttgggcctggacagaccattacaaggtactgttgagagtgaaagaatgggaccctcagcccattgggcaccccatgggttattttctgtgctctgttctgttttgcttcatttttaattctgggt

SEQ ID NO: 89249 - DNA, 1040 bp, Homo sapiens
aatattagatttttattcattttaatgaattaaaaatgtaaccttctatgagtaaaatgaagggaatttctactaatgacttaagattcaactggagtttttaccatcgctggtaaatcttaagctccctctccctctcctttcttttccgtgcctcatgacttccaagaaaaggacagggaagaagctgggagactataacaggcctgtgtatctccactcaaaacatactccctggaggagatgtcaaagtggttttccttgaatgctctgtgagcatacggttgttggatggattggaacgctactctcactcaatagactctctctctctctgtgtctttgtgcatggcttcccgccaaataattcaccagcttgactgcatcacagacttgacgtgtcacctttctcgtttgtgtcctttgtcacccacaggtcagcttgcaaggttgaatgcaatatccttttatcacactcctctcaagtaagtaccatcttatttaggaggaatcatggccactgtacactgaattctgataacctgtaatgcgaattcacaatcacttctcttagtcatttctttctatgtgataaaataccctccttaactgctgatatcgaagagtcgtctcagtctgtggagggtttcattataaaccagtggagatttgccagacatccttgggaggtgacttcttactctattagctaggaaaattggcacaaagcttctaaacctagagacgttccagtaatcctctgtggctatgaaacttaccaataagtttgtcacatcaccaatccatgacaatatcggagtttgtagccgctctagcacttgaaaaggaaaagtcagtacctctagagatgggccagcttgttagtcatactatacctcgggctcaagagatcaaatgtgtgtgccttaacgagtgaaagcaaaatcatgcattaataaagagaacaaaagagcccaaacagaggaaaaattctgcagccttatgtttttggaatacctgattcaaatccattgtggaat

SEQ ID NO: 89250 - DNA, 1058 bp, Homo sapiens
gcgcggaaatccagcccgttatataatggagcagacactgcctgcgacccctgctgcaggcatgcatttgtgaaggcggttgtgattatttggtatctgtttccatgtgtcatgttgggtttgcattgaggctccgcgactgcagatggaaagcattttgtgaataggtttgctgccttcgaggggtctccctccatctctttccttccacactgataaaaatgcatgctgttttcccccgctgtccaaagggagacaggcagtagcacttcctttcctccttcccttttagattttaaaggagccattaggtagcagtgccaaaaggcagaaaacgggagggtggggagaaaaacgtttgcgcttaacctggagagtgtgcaggaaagatggaatcctctagattaagctgcagtctgtgatgttaaaccgccagattgatggagctttgtaagaattctgctcgctgattggtgcagggattgacagcagaggtgatagtgtcagacattcaccaaaattttctccatagaaccctaggtttattagaaagagactggactgcaaaggacttgaaaaaaactgggcgctgttatgcattttctaaggagtttatggccaccgcttgggtgggggagcctttccttcttatttacagtaggaaggtgattcctggtcttttgctgaggtctgttttgaggatgggactgatcttggtcattgtattgtgagccttttgattaatgagttggcctgtacggttggcatcatttttacattaacatatctggcaatatgttccagtagataagctcattaaaattgtttgcattgtttgataaggataacaatgtaatggagaatgcagctagagtcttatgcagctcaaggccagacttgaagggagactgatagcttcggtcatatttcctctgaagttcttttgtactggggtagttatttttaaatgttaccttgataaacgctaacaatgcttttgctttgaggcagagcacacatacctctaaagcgcatcctctcagctgatgagcaacagg

SEQ ID NO: 89251 - DNA, 1066 bp, Homo sapiens
aaaactaaaatttaagcctaaagcattggccataacatccagctttgccagttttaaaaaacatgctgttgttaaggaaaacaaagagaaatatcgtaatattgtgcatgtgtgtgtgtttttttgtgcacgtgtgtgtataaaagagttgtgaaagtgtgttccattcaatagaggctattgtaacatggctcacttttatcagaacataggcttcacatcacattccccaaaacagcagttatagattgcaaaagtctacgttcatgtctttattatgtatttgttagtatcatctaggtttaatactgtcaaaggaggttttccaaaaataaagatttttgtccttactatttttcttagtgtttgtaaaaatcagaagattacttgatgctttagtacatgcccaactctggaacttcttttacggattttcagagcttctgttaatggaatggtcttccgggtgctcttgctttggggagaggctcactcctgctctgtagctggtatctgttgacagtgcattatcttagagcagtgctgtgagattgtcctctggaattcagaaggttgatttccttatgcagcatcttttctttatttacagggacctcttgaagctgcagtgaataattctagattaattggaaggggaaatttgggactaatttaaatattctgtttggtttagagaattaattaattttacaaatatttgaaagtctgctctggccaaggtctgtgctagatgccccttgaaggatcttgagtcctagtaaagtccgatggaaaaccgctcattttgtaaaagacttacagtgttggtattttgcttagtctgatagcgaaagtggtttgcatttcctgaacccccagtgacccaaagggggaaaaaaagtttctctgaagtccagtgtgctgtaggaagctaaaagacactgagagaaaccagaaattttgctgaaaagaatgtaggctttaggatcaggcagaattttcactggcctggccaggtgtgttgggcagtggtagaaaataaaagcattgaaaagcaggcggggta

SEQ ID NO: 89252 - DNA, 1050 bp, Homo sapiens
atcaagctcctgccatttatcaagtacagcaaagggccctaaaactgagattgcaggtaattgccaattttttggccactctgagtgcagtcctctgtcctcctccaactcagcctaacctcccaccttagggaacttaattgggcaatatctggccttcatgtgacccctgtgtgtgatgacggccaggaaacaagccatctgcattcaccatgcatttctgtttcagccctctcacccaggagtctgggtgaaaactgagagaacccccagggagactgaccaattaagaaaaaaacaagaacaaagctttgaatatattatcctcagtatagggacctgctcactgtcagcaactctgaaataaaaaagcttgtggaacttacgagctgaatgtctgctagaaaaggaggaagcagaagacaggatcattgggagatggagtgtaatgggaagtgagtgcagcatggaggacagtgagggtttcttggggtgaacatgccagcctctagagagagtttagttctctgcctccctacccccaccccatctctctccctgtcttttcaagggcagagtaaaccttcccttcgacacttgttctccaaggacagaagaaaatgaagagctctgtgttagcctaggcaggggtctggcaggagaagggaaacaggaccaacaagtctctcccaagtcccttaatggggcctggaatacacagtaaattgttaagtttgagtttgggaagccaatttgggaagccaaattgataagtttgggtttgggaagccaatttctttccccctgaaatttttgacaggcagatagcattgtcataacaatgactttaagatgtcagcatgtacctatttccagcctgtatgataagtgtgtcactgctacctctactccagttcaaaatttggtctgtaccgaaaagggaacctggattgtcccctacctcctttcctaacctccaggaggaccagttggggtcctcaaagtgcacagccaggaagttgcttgaagaggcagtgaggtatagtgggc

SEQ ID NO: 89253 - DNA, 1034 bp, Homo sapiens
ttttatataaatgggatcacagagaatgcactcattagtgtctgactactttgactcagcacaatgattttaagattcatccatatgggatgtctcagtagttcatcactctttattgctgagtagtatttcattgtatggctataccatattttgtttatctgctcaccagttgatgaacatttatgtttccagtttttaggaattatgaagcaagtttctatgaatattgttatacaagtctttgtggaggtgttttcatttctctggggaaaatacttaggagtggagtgattgggtcatatggctggtgtttaactttttgagaaactgtttggcaaacagttgtccaaaatggttgtaccattttacattcctagcagcacagtatgagagttctgattgtttcacatccttggcaacacttactatcagtctcttaaatgttggccatccttatggatgtagaatggtatctcattgagattttaatttctattttcatgatgactaatgatgggtatgttttcatgtgcatattggccatttgtgtgtcttctgtagtaaagtgttcaaatctttttccatttaaaaaaataggttatctttttaaatagaattatacacatatgttttgcataataatatagtcttgaattgtattttaatatgtacaggtcttatattcttaacttgaatataaagtcccccccacacacacacacaaaaagacctagtctttgttcacaatgacttttacagcaattagttacatggtccatcctcagtaagtacatattaaatgagtctatttagcccgggcactgtggctcatgcctgtaatcccagcactttgggaggctgaggtgggtggatcacttgaggtcaggagtttgagatcagcctggccaacatggtgaaaccccatctctactaaaaatacaaaaaatagctgggagtggtggcacttgcctgtaatcccagctacctgtgaggctgaggcaggagaatcacttgaacccaggaggtgaagg

SEQ ID NO: 89254 - DNA, 1067 bp, Homo sapiens
actagaagctgctgcccctgatgcctagaacagagctctcattaagctgcagggcagctagggagcttttggtatctgtgttccagacatttccctactcacctttaaaaaaaaaaaaatgcctagaagacagggtcctttaattcactcaaccctagtctgttcctagccatctcacatagcactaggggcacgtattgatatttgccttttgtatgatttggcacacctttgtttgcattcattcagcatttatttattgtgtacctactgtgtgccacacacagttccagacacaggagataaagctgtaaacaaaacatattctataaagtttctgccttcatagagcttacatcctgggggcaagaggagtggacagatggtaaacaaacaagataattaccaatggtgttagtatcaccgagggcagagtagagagatgtgggagtaactggaagcggccacttcagaagtgggcatggagggttcactggggagttgacatttgagccaaacctgaagcatgagatgcagccaaccctgccaagtgctggaacaagctgctcttccgtggcatgaggtcttgagccccagttatccctaaggatgaaacttgaggctttgctctgtcatttgtttcttattatgagaagatttagaaaaagcagacaccgaagtacctgagaaggaactagcaccaccaagagtacaagagagctcagaaccaggaggtggggaccactcctacaaaatgtgtgcaccacaggactttgcctagtggcagcatgattgtttgatgaccgcatatgcttctgctatattgcatgcgcctgattttatgcagtggactaacaactgagcatgaccacccactatggtaccagcagcacctatgtcctgaaaggttgacccagggccctgctcgttgggggcagcgtgggcatgactggaaaagacctgggatcatgggaaagagctaaggtcagggtaagagggaacgaggccaagtagggctgggaaagtaaacagaaggcatatggtcaagaaggagtggatgtgctggg

SEQ ID NO: 89255 - DNA, 1013 bp, Homo sapiens
gagaacttttgtagttctctcatgttttcctctctttttcctcttaagtttattttgatgacttggagcaggtggtagccaggtggaagaaaatgtatatttcttttctctggtagaagctagaaggagctccttttatcctggtttccttggctttatagtgtgaggttctgttggttggttgtggaacctggtgatattctgatgcatggagtacaatacacggagtttagggttgggaagtggcaggtgctgtattgttgaggtacagtcccttccctctagctcccagatcctgtggacaaggagatataagcgcattggtaagaaggacacactctgctctgagtgatgatggtgcctgtaaggacaatccccttccagcctagcagtcctctaccacatctgggtacagtgagactcactccagtactgttcttgtttctttccaggagcggcctattgccaattcatggacatgctcttccctggctgcattagtttgaagaaagtaaaatttcaagcaaagctggaacatgaatatattcacaattttaaacttctgcaagcatcatttaagcgaatgaacgttgataaggtaggagacttgtacctccataaaatgtgttgttttttcttaaaattgtttttgtgcataaatgcaaaagtccaggagcataccaatgggatatatcttgatatcccaacagtaggctggggtctgtacctagcataaagcatcaccctaagttcttgtatttttatgaggttttcatttcagattttctaaacttgtagccagtagactaaaaactaacagggctcacaaatgttaaagtgttattagttaaatttagcattgcagatgagaaacttttaatgtttgccagatgccactgtggttctttgtattttgttcttttggagaaacatcatgtcatggcagaaacagcatggttttgaatcccagcttcatgacttgagcaagttatttaaattctgagtctcagttt

SEQ ID NO: 89256 - DNA, 1056 bp, Homo sapiens
aaagagaaccagatttgggaagaaatcttgagtttgttttgaacatactaagtttgagattcttttgtgacatttaagagaagatctacataggcaatttttgtgttgggggtggtgcacatgtgtgtctggagctcaaaggagttataggctaaagataaacatttgtgattcttccacatattgatgtaatggaagctggaagcaaatactgaatgataaagggtagagtgtcttgagaaacttggacatttactggttgagtagaagaggaagggcttgcataggaagcagagaaggtgccagaaagaatgaaggaaactaggaagtgatgtgtcagggaagcagaaggtagggagcataatggtcaacaatgtctacatctgctgagaagtcaagttaaatgaggcctgaaagagttcattagatttctcaacttgaatgatttctccgttcagtagaatggtagagccaggaatggcttgaggaaaaagttggagaaaggaaattgagacagtggaaagatccaactttggagccataatgggtgagcctatatagaataaagaaaactaagcacagatctttggaaatacatacatttaagggggaggaggaagaagaggaagctgcaaaaaagatgaacatcaggaagaaaaccagaagagctcagcatcagagaacaaaaaccgtaggaaatttgtagaaagaggggtcaccaacagtgccaaatattaattgtggcgatatcaaataggatgaagcctgaaaaataggccaaagtctgactcctaggaggtgattaatagtccctcagagaattggtccattaaaatactgagggcataggcctagattgcagcaatttaacaagggcttgtggaagtggaggcagtaagagtagattcaacctttaacaaatgtgtcagaaaaaaatggaggaaaataaaaacatttggtttgtgtagggaaaagagtgatagtagcttcaggaaataagattggaaggaagatgttattttttttcaactgttcttgtttgcttttaggataagg

SEQ ID NO: 89257 - DNA, 1050 bp, Homo sapiens
gatacggctgactgaggctagtgctccctggagttggtgttcatgccatgcttcactgggttagataaaggaataaatagggctgtttatttctaaatagtgggaagaacaattcacctatctgattctcagttgataaacataacgtaagccaaaagggccccaagcagtctaagtagatgtcccaaagtccttgagctaaagctcctgagctccctcattgggaggggcctctttgcctgggacaacccatgaaatgtggctgctgtcctttccttagcctgggaacctctaacactgctgctctggtatctaagcctacatcaggttagtaacataacaaagggtctccttcagggcgacactgccgagcaagaagaatgacagcaagggagggactaggaaatggagcaaaagcccacatccctatccattagtgaggagtgacaccccccaccaaaataccatggaggccaggggtgctgcttttatattacagcagctttactcatggttgtcatgatgctcttggatcactgtgtttggtttactcttttacaaaggttaggaaagtatgccatgtattctaagaagatttccttccaaaacaaaatagttgggtgcctaaagcctgacgactgtgctttctagaatgatctgttctttgatcacatggggaagctaaggcgcccctgcatatgtatcagacaccggaagctgggagacgtttgcatggcgagttgtgcctaactaagcctggtgccctccacagccttgagacgccatgctggcagtggcaatgggctgggatgctgcagggccccattcccagtcaattatctcagctgaaacttctcccctgcccacaggagggccacacagaagagccggaagcagaggagcaagcccacgaacagcagcccccgcagcaggaagagtactgacccaccccggctgctcttgacacttccattgtgtgtgggaacgtttcttctggagaattggaacatgtgtggccccaagctcaacagaaaccagttgttcccaatc

SEQ ID NO: 89258 - DNA, 1022 bp, Homo sapiens
ttcacagtattcacaaattactttatagtgtggactctttgatggcgcataaggaccgatctgtgcctgaaagccttcccacattcattacatatataagcttcatccccagaatgaattctctgatgctgaacaagggctgagctccttttgaaagttttgccacattcattacactgataaggttcctccccactatgaattctctgatgtctgataaggtttgagctcaaactgaaagcttttccacattcactacattcatagggtttctctccactatgtattctctgatgagtaatcagctctgagctctgcctgaaagcttttccacattcattacattcatagggtctctctcctgtgtgaattcgctgatgtctaatgagttttgagctctggctaaaggttttcccacattcattacactcataaggtttctcaccagtgtgaattctttgatgtataatgagatatgaactttgactgaatgctttgccacactcattacatttacaagctttctcaccagtatggattttccgatgtctaatgagggctgagctctgattgaaagctttcccacattcactacattcatatgctttctcaccactatgaattctctgatgaataataagataggacctcaaactaaaggccttcccacactggttacatttatagggcttttctccagtatggattctctgatgttgtgttagagaggaatgctgcttgaagctgtgcccacatacatcacatctataaggtctctcttctggaggaactttctgacacattatagagtctgtagttagaatcaagcatctttcagcctcatcataaaggtctctctttcctagagatttgtttgtgaagatcacttgactaaaactgcccccttgggaaggagatcttagtttctcccctgtagcacttccttgcttccacactaaattgctttcatgctcactaattcctcgaaatgaaggttcctgagggagtccctgtgatttttc

SEQ ID NO: 89259 - DNA, 1106 bp, Homo sapiens
tgtggactgtgtgaggcacttcgtctcaggaactaaaaaaaaaaaaaaaactgacccaataaagaacagtgacagagcagcaggaaaggtggggaaatggcttcatcaatgatttgttgagcccagggcaggccaggaattagataggcatgagaagaaagaatataatttacccaaaggttattttttgagtacctactttgtcccaggaactaggaatacagtggaaaacaagactgtagtctctacagtctaatgggcaaggcagccagacaggcagtgaaagtggaatgctcctatgtgaccttaaggagcacctgactcagccttggataaggaaatgggggaaatggcctgaaggatgaggaggagttagccaaggtggtactctagggaagtggtaccccagtaaagaacagtagccaaaggccagaaacaaagtgtggagcattccttgagttcctgttgtagtgaggtcttgtctgtcagagaagtctgggtctggccagactcttaagcagtgccaatggagaagttcctgttaatagacaaaacctggagcccttgggccacagggtagtcaagagctttgtcttggtttatgtgaccccagggaaagggcaaatatgtggtttccttgcccaacctgtaggctatcctagaacttccatgagggtggtggtgggaatgagggtgagaaagagcccagcctatacctcaagagtctgctagagtgttaagactctattctcctttgattctaaagacaatatcagagctgctgtcaggtttcttaaaattcccaacgctctggatcagaagctgccatatcatttgtttctggggctatacgcccacaattcctagtacattcccttgggctttggtgctcaaaaaatatttgtcagttgctgggtctgtgacattctttgggcacctcgcacatgttcagttttgtcttatgtcaccagtatttcacaatatcttttgcaatttttttttttttttttttttttttgagatggagttcgctcttgtccaggctggagtgcaatggcacgatcttggctcaccgcaaactctgcctcctgggttcaagcgattct

SEQ ID NO: 89260 - DNA, 1362 bp, Homo sapiens
gtcagtcaagacttcccttttctgaggggcctagcaggaagagaatatttagactgatgcttagtgtaagaaggaatgttgtacaggttaaccagcaacacaaagacatattcaaaagacctaataggtcagaagaataacataccacaccaaaaacaaatctgtatggaaatctagaatcatgtgcatagaaaaagaattttcatgaggataaaaagaagcaaagagaagtaatgctcttattggggcgtgcatcagtggacatgtgctaaccagtaagaacagcaggaggcctaaatgcccatgtttagggagagaatatggaaaaaatggatgggattatttggaaaagatgtaagagattaaaatacgtggtaagagctactcaactcttgtttttctccttttccatagataaagacctgaacaaactgaaaaggtaggacgtaaagtaggaattgtaaaacggaaatactctttatataagaaagctctactgtatgtcagaaagcaatgtaatagatagaccaagcacagtggctcacacctataatgccagcactttgggaggccaaggctggaggattgcttgagtctaggagttcaagccgagcctgggcagcatagtgagaccccatctctacaaaaaataaacagaatttgccagacgtggtagtgcatgcctgtagacccaagtatttgggaggctgaggtgagaggttcgcttgagccctggaagtcgaggcttcagtgaggcaagatcacaccactgcactccagcctgggagagcaagaccctgtctccaaaccaaaaaaaaaggaaaaaagtaaatgtaatagatacttgctaagggctttgtatatacttattattgttatttctcagcacgtatgtagcagatgaggaaatgaaggctaaaggtcatatatctacaaagtggggaggtcagactttgaacccacaacctgactgtggagccacttcagtatactctctccccataagaaagttccaatagaaaaaaaatgctacttaagtagggaaatcacaaaataagtgccaatgaacaataaatgttcaacctcactacagttaaaatgtatattaaagcaagagttgagatgacacttttccttataaaacagacagggattcagggacattgggactctaatgctgctggtaagacatgaataaatacataccatctctggcaatcaataccagaagctttaagcattgccttttgactttgaaattgtacctggaaatgtatgtttcagtaaccatcatgaatgtacacaaaatcctgaaactcttaaaactgatgtcacaggccaggcacagtggctcatgcctgt

SEQ ID NO: 89261 - DNA, 1134 bp, Homo sapiens
caatatggtgaaaccccgtctctactaaaaatacaaaacaattagctggtgtggtggcatgtgcctgtagtcccagctacttgggaggctgagacaggagaattgcatgaacccgggaggtggaggttgcagtgagccgagattgtaccactgtattccagcctgggtgacagagtgagactgtgtctcaaaaaaaaaaaaaaaaaaaaaaaaaacactgatgtcaattaatattaaatgaagtattcatgatatattgttaagtaaaaatattacaaaacaatatgtacagtatgatcctatgtaaaatatatatttatgtattaaaaatactgaaaacataaagtgctatactggttatgtgtgggtgctgaggttgtaggtgatgtaatttttttcttgtgcttttttgtgttttccaaatttttctatagtaaacctctaatactcttaaaattagggggcaagagtgaatggaatcccaggatgcttgagaaaatattttaaaagcacttgcttttcatagcatctcttgtctcttccaagtttcaggaaattagctaacttgttaactctgatcccttcatcactggtaaaatgacaatggtaaacataaccatctcacacctagtatattaaaaagtctacaaagtataaatctgggtgcaaaaggaattcttgcctgaaagatttacagttgagaaaagcaatagctttgaagtggagatctttgattattagagtttttccatgtattccatagccataagcaagtcatcttccaactctagaccctcacttaaaggagctgatgtagatgatctcttatggtcaaaacttcaacattccactttttatgaaatggaaggggcaccaatatagggtggatgtcaaaggaaattttttcgtcttcaccactcttgcttggaagaaaagtaattcatgcctttcccttctgctcagggctgtcctgtttctcttggtatagaagcagtccagggaataataatgtctaccttaaatgagtcttaaacagattttaaaagataatgtgcaatttagtgtacttaactttgatttcctgcctttccccttccctcatttccatagcctgcaactaatacatccagctga

SEQ ID NO: 89262 - DNA, 1061 bp, Homo sapiens
gaagtctttagtgactcatagaccagatttaggtatccctgccatgtactttgatggaaacccgcatttttcctaccaaagcacttaccacactttactgtaattactgtttagtatatatgcatatcctattagcccttaactctgggagggcaatgaccaggtctacctcaatgcctagcacatagcaggtgctcaataaactagtagacttgaattaacctcagcaggaagctcaggattgaggagacaactggcaagggggcagaatgaggcaccattcctcaggtactattttactgcctcagatattattaaactaatagcataattcaatattttcacaacctccaaattcaacatttcagatagttgaataactctcagcacatgcctccacctgacaaaatacaaatgctcttgccaggcacatttgccatcttataagaagctctttcaggatctctgccccaatcctggcattactgtgaaggtgcccaatggaaattatatctgagttggcagagagtggagtgaaggggatattgatgagtctcatccagaaatgggttaggcatttcaaggaaatatctaccattctttttggagaagacttgggtaacatttttcttccatttaacacttcaataatcataacaaacatctttgtgtgcatgtcttcttatagtaccgaactgggagggaaggacagaagttctgctctcaggaaacttttcttttctgtggagtctcacccctacagtgaactccttgcatttcacaattgtacaactcttacccacagagttaaactctggtgtgtgttctctgatgctgcataaggcctgacctatgcctaaatgtttttctacattcactacattcataaggcttctctccagtgtgaattctctggtgctgggtgagggctgagctctgattgaaggattttccacattcattacattcataaggtttctctccagtgtgaattctttgatgttcaataaggatagaactcctaccaaaagccttaccacatgcaatacattcatagcttt

SEQ ID NO: 89263 - DNA, 1051 bp, Homo sapiens
gaatgtattgcatgtggtaaggcttttggtaggagttctatccttattgaacatcaaagaattcacactggagagaaaccttatgaatgtaatgaatgtggaaaatccttcaatcagagctcagccctcacccagcaccagagaattcacactggagagaagccttatgaatgtagtgaatgtagaaaaacatttaggcataggtcaggccttatgcagcatcagagaacacacaccagagtttaactctgtgggtaagagttgtacaattgtgaaatgcaaggagttcactgtaggggtgagactccacagaaaagaaaagtttcctgagagcagaacttctgtccttccctcccagttcggtactataagaagacatgcacacaaagatgtttgttatgattattgaagtgttaaatggaagaaaaatgttacccaagtcttctccaaaaagaatggtagatatttccttgaaatgcctaacccatttctggatgagactcatcaatatccccttcactccactctctgccaactcagatataatttccattgggcaccttcacagtaatgccaggattggggcagagatcctgaaagagcttcttataagatggcaaatgtgcctggcaagagcatttgtattttgtcaggtggaggcatgtgctgagagttattcaactatctgaaatgttgaatttggaggttgtgaaaatattgaattatgctattagtttaataatatctgaggcagtaaaatagtacctgaggaatggtgcctcattctgcccccttgccagttgtctcctcaatcctgagcttcctgctgaggttaattcaagtctactagtttattgagcacctgctatgtgctaggcattgaggtagacctggtcattgccctcccagagttaagggctaataggatatgcatatatactaaacagtaattacagtaaagtgtggtaagtgctttggtaggaaaaatgcgggtttccatcaaagtacatggcagggatacctaaatctggtctatgagtcactaaagact

SEQ ID NO: 89264 - DNA, 1051 bp, Homo sapiens
aggcaaagtgaaaatgggtatgagagaatgtggcccactgaggaaactgaaggtagtttggggagaccagattaatggctgtcacttctgactacggctcaaaatcagccatgaaacatgaaccgcaaggcagacttcctgagtcagaatctccatgggacagggctttagtaagtgccacaagagcttctgatgagcagccaggttaagaacccggtgccagaccctggggcacagttaatgaatggtgagagaggaggtctgagaggttgaactacagagtttgcattgatccccatggccacagtgatggctggaaggtctgtgtgcccacccagagagtggcgtggagaagacatgggaaggggtttgttgcaaccattcagaagagagactgtgagagactgagctatgggaggcaaaagacaaaaagacgggagatttgacaggacttgacacaccgtataagggcttggaagagagaggggtcaaggactcaagtttgtggttggcccttgtgactagaggatgatggtgctatttgctgagctattcattaagaaagttaggtctgagatgcctacgaagcagcgtctcctaaaccgtgctttgccaggtattaatagatttttcatacatatctaaacacaagaaccctggggatatttctcctaattttttttttttttttttttttttttttgagacagagtccactctttcgcccaggccagactgcagtggcgctatctcggctcactgaaagctccgcctcccgggttcacgccattctcctgcctcagcctcccgagtagctgggactacaggcgcccgccactgcgcctggctaattttttgtatttttagtacagacagggtttcactgtgttagccaggatggtctcgatctcctgacctcgtgatcctcccgcctcggcctcccaaagtgctgggattacaggcatgagccaccgtgcagggccttctcttaattttttagtgtaaaatactagagaccaagcacagtggctcatgcctgtaatcccagcat

SEQ ID NO: 89265 - DNA, 1050 bp, Homo sapiens
tctcagaatgttctccaggattctgaaggcaaagaattctgtgaatttggggataaattaaatgaaaaagatcagaacgtctttaaaaggagacctcataactgtgacgaatatgggcaaagctttgtttggagtacaagcctttttaggcatcgaaaaacgcactgtgagaaaccttatgaatgggataagtgtggaaaggccactggggagaaaccttattcctgtaattggtgtattaaaagtttcagttggagctcagaccttattaaacaccaaagagtccacactggtgaaaaaccttataaatgtgatgagtgtgggaaagccttcagtcagagctcagatcttattatacatcagagaatccatataggagaaaaaccctatcaatgccgtcattgtagtaaaagttttagccagcgctcagatctggttaaacatcagagaatccatactggagagaagccttatacttgtaaccagtgtaacaaacattttagagttctgatgtgataaaacatcaaagaatccacactggggagaaaccatataaatgtgatgtgtgtgggaaagccttcagtcagagctcagatcttattctgcatcagagaatccatactggggagaaaccatatccatgtaatcagtgtagcaaaagtttcagtcagaattcagaccttattaaacatcgaaggatccacactggagagaaaccctataaatgtaatgagtgtgggaaagcttttaatcagagctcagtccttattttacatcagaggattcatactggagagaaaccctatccctgtgatcaatgtagcaaaaccttcagtaggctttcagatcttattaatcatcaacgaattcacactggagagaagccttacccatgtaatcagtgcaataaaatgtttagtcgaagatgagatcttgttaaacatcacagaattcatacaggtgagaaaccctatgaatgtgatgaatgtgggaaaacctttagtcagagctccaaccttattcttcatcagagaatccacactggagaga

SEQ ID NO: 89266 - DNA, 1051 bp, Homo sapiens
ggcaaagctctgtgggaaaaagggactggaccaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagtgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggat

SEQ ID NO: 89267 - DNA, 1007 bp, Homo sapiens
aatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaaacattttctaccgacaaggcactgtgctaggtactgtaatcctaccataagtaggtaggtatttcttccactgtaaatcataggggtttgctgttttatgtgagtt

SEQ ID NO: 89268 - DNA, 1033 bp, Homo sapiens
tccgtcgacgaaaacgggaagtactagtagaagacatggtatctcaagaagaagctcagggattaccaagttctgagcttgatgctgtggagaaccagctcaagtgggcatcctgggagctccattccctaaggcactgtggtgaggaccagaactctgtgtgggctagagggtgaaagagagtataggccttttgttcagaactttgcttgttctcactggtggggggatcatatcactcttaatctaatatctcagtttttttctgattaagttgattttgctggcctcagaccttttattcctagacattaacatcttcagccttttcttccctttcagtctccttcctaaaaagagttgcccatgtcaggctagcatttgccttactttgagccagcacccacccatggaccaagtccctctattttgcattcagtattacttgtcatctgttttacatccttttactttcaatctcctgcctaattccattggtacagtaagcttacctgaaaacctcttctaatctctttgttgtatatcactgaaatctttctaaatatttatttctgatttccttcaacgtctacctagagtcattttcttctaagaagcttcttttgtagaaatatttggagtaatttttttcctttttctaagtatttatgcaaaaaaagcctccttagctataacatgctttaaatgcagaaaaatcttttttaaaagctcaaagttgtattaattcacgagaccagtctttcccaatatattagccattaacaccatatacttatgtgtatcctttgatatggcccagtatattcctaaaactgctagattgctttctcatgtttatgtgaactaaaatgaaattttgtttgactctgctttagtaatcattccttgaagtagttggagatggtgctggtatgccactgaatgaggtctgagcaggttttcttcacatctgaggggacagtgccagccagtcaacttttggggtggggctgaagtctgctgaaaatctgca

SEQ ID NO: 89269 - DNA, 1062 bp, Homo sapiens
ccggccgcaggcggaagtgccgtggttccgacgctgttgtcacagggtggcctttggtcatctgaaatccgcggtcctgagtgctgggaagaggggctagaggacgtcgggccggggccggggccggggccgggatacacagcaggtctatgcagcagtaaggtgggcgatccacctgggacgaggtaccctgcccaaacattgtcgggaccgtgggccttccctccatttcccacaagcggtatgctctacagcataaaaggaagagaaaattatgtagaaatacttgcaccgttgataagcagggtcttggaataggaacgaatgaatgttggctagaccttatgtataaggccaccacactccagggtatttaattaaaccagtatgtattacttgtctgataaggccttttctgattctagtcttcatcttgcttgggttacaataagtttttttaagttgttattgttcagattttgggccctgaataaataaataggctgaatggctcattgctagtatgtgtcgtaaacaacagcacgggcatgatcgtgcaaataataaaggtccagaagcagtatacagtttcactgaaggtagaagctggggaaactgtgagtcctccagtgtaaggacaagacactggaccactgcaggaagtcaaggtgcttatgcgagtgccttttcttaatagaagtttctgtgattaatgcctatcattataaatataaatgtacgtatggtgtggtggaagactgaatatttacgtattatgtgcaagataatttttcaaaattatgtgatgtttttcacatatgatcttttcaatattatgtgatctgctactcagcaagtgaacattttttcacatataagtccaaggagttcttaaacaccttaaaaatattttttaaatggtaaagaaaatttttttaagcacataataataaagcgaaccttccttttgagttgacttgtgtgtgtcaggaaacaccaatcctgaattggaaataatgcgttccagggtcaggcacatttagaaagcactgaagtagtctg

SEQ ID NO: 89270 - DNA, 1461 bp, Homo sapiens
ccctcttcattcctacatcaccctcttcctcttctacttggctccaatcctgcttcaggatcacctcataccctgcctgacactttcagtgtcctcctgacaactttgaatgactttgttcatcacggcatatctactggtcatttgcctctgataagaggtcagttctggtattggtctgcaggatccaaaagaaaaactcagacactttaagagaaaaacaattagctggacttgagaaatcctcttaagaccaaactcaggtccagtctgctctgactggagtttgactctttcttaatctggtattaggcatggtttaaaacgacctgtaacgttgaaaatatgctcttcagagccagaaggcagtccctgtaggtgagggggacccattttcccccatctcccaagttaaagcatggatctgtccaaattttaaatgtgtttcatgattgatttggcacctggtggagggctaaacatgtttgcagtaagaaatctcttaatttctgaatccatagtcattggaaaaagataccagatatttgttactctttccagtgactgtaaattgggagagtttaacttagtaaaaataaagggtaacgaaagaaatcaatggactatggaacttgaccccattatcaaataggacagatatcctggggagagattacaaattatgccctcttacaaatgcatgaaacaatagtgtcatttaaaataatattctatctgatgggaatgtgtgggccttatttggatcctcattcaaacaacaacaaaaaaaactttaaaattttgagacatttgggaatctgatatattttgatatttgataatattttggaattctcacaaatagttgtgattatgctattgtaatgttaaaataattcatatttttagagacacctactgaaatatttatggatggaatgatatgacatctgggatttgcttcagaatgatatgagagagaggaagtggatgagaatcgtgttgaaataagattggccatgagtcagttatagttgaagctgagtgataagtccatgggggttctttatactattctgcctttggtatatgtttgcatttcttcataataaaaaagctttcaaaaagaatgagatatttttattactaaaaattgtgatgaaatcttacccaaagttagtgctttgcattagcttgcactggcttacagatgctgaaagtttgagaaatgctgcctaaatggtatgcggtcttgaatagaggaagtacccaattcctaaaacatctaacaaagaatatagaagagaagaaccatggacaggtaaagttgtcctgtaaatgttcttaatagaggtcttcattgtgtgttcagttgtcccggagggctgtgtatttaagagtattttctctgtagaggttaggaagcctgagagtgagaagaccaaagacttcagctttgag

SEQ ID NO: 89271 - DNA, 1057 bp, Homo sapiens
gtgagcgggggccgggactgggcggtcggtccgggaggggcgccgcgcccgaccccggagtcccgagcccgaggggagcgtcgcggccccgcggtgggctcgccgcagcggagggggcgcgcatccgggtgagcgccggcgcccccgcctcccccgcgcagccgcacgggccgccgccgccgctgccgccgagcacgcagcgcagggaggaccgcgcccgagcgcctgcgggcgccctgcggcgcccgccgcgcgacgagccccaagtgagcgggcaggcggcgcgcatgcggggcggcccggagtagcgccgcccgagcccgcgagcggggcgcccggagtagccgccgacccgagccgggcgcggaggcgggggcgggcgcggcggagcggggcccggccggacccgcccgcccgccgggggagccgccggcagtggccgaggagcgcgcggcggacggcggcccgagagtagcgcgctggccgcgggaccggccgcgaccgccgcggccggcccggaggacgcctgccgccgccgccgccgcgcgcctagcgaggtgagtgtatcgcccgcggctgggcagtcccggagccgcagcgctgcgcgcgggtcggaggtggagaaagaggccccgccgcggccgcgtccccggtccctttgtggccggcgctgcctggggccggggcgcgggcacgctcggcgcgggttcgggtctgggaccccggtgccgttggacacgcggcgtctctggttggcagctttggcgagcagcgagtttccgtcctagtttgacattgagttagaaccgtttttctttagaagacggaagtttgttttattgacaaaaataaagctaaatatggcttctgggttcggccgtgtggtacttgcaaccgcggtgccagcctgaccctcgcggcgccacgggggaggggaagacacgccggcagcgggggagggggcttcccggcccgctgcccccgaggaggacccggacctaaattagcaaatgtttgtggttgggaagtagcgggctttaggtaatgtagtagcttt

SEQ ID NO: 89272 - DNA, 1051 bp, Homo sapiens
ggatttcaccagtttttccgttaatatcttctttctgttccagaatccagtccagtgtactacattgtattttgacatcatgtttctttaatatttggtttgtgatagtttctgtcttgtctggttttccataactttggtagttttgaggaatactgtcctggctttctttgatggacagctttccatactcattctcatgaaaggtcacaatcaggttgacgctgtttctgcttttacttatttatttatgtaatacatctgtcatgcttatgtaacatacaactttggtacttttttttcagtaacagatttcttggatacagttcctaattggttgagatgcagaagagtgttataccattgcagttatataccaagttttattttttgatgggttaagagctgggctgaggtagaggaggaaggaaagaggagagatcagttaaaagaggcagttaggcaaagagggaccaaggcaaagggagtgacagataatggaggaagaggagtgcggcaacttcgtagaagagagttaggagtgactacttactgtttgttcatttattcaattaatatttattgactcagcagtcccagtctctctggcaccagggaccagttttgtggaagacagtttttccgtggaccaggttgggggccaggggaatggtttcgggatgaaaccgttacacctcagatcatcaggcattagattctcataagtcttgtgcaacctagatccctcatatgtaaaattcacagtagtgtttgccctatgagaatttaatgccgctggtgatctgaccggaaggaggtggagctcaggcagtaatgctcgcttgcccactgctcacctcctgctgtgtggccaggtttctaacaggccacagactggtactggttcatggcttgggggttggggacccctgtatggagcgattaatgtgtgccacacccagtgctgtagtctcaagataactgggggtggatagcattaaataaacatgcaaataagtacataaatacaatttgtgattattgctacaca

SEQ ID NO: 89273 - DNA, 1068 bp, Homo sapiens
ctgggatatatgcccaggagtacacttactgggttgtgtggcagttgcatgtttagttttttaaaaaactggtgagctgttttgtaaaatgttctagcatggctggaacatcccaaagtgccgggattacaggcatgaggcaccacgcctggcctgtcaccatttagccattctgataggtgtatagggatgtctcattgtggttttaacgtgcatttccttaaaggctaatgatgttgaacacttctcatgtgcttatttgtcaactgtatattttcttcagggaactatcttttgttcattttctaatgggattgtttgtcctttttactattaacttttgagacttgtttattctttatatattctaaatactggtcctttgttgggtatgttgtttgtctgtagcttgtcttttcatccccttaataaggtcttttgcagagcaaaagttttaaatttgttgaagtccagtttctcagtttatttttttatggatcattctttttggtgtcaagtctgggaactctttgcctagccctagatcctgaagatttttcccttgtgctttttttccctaatagttttgtggtttttacatgatccagtttatgaagctgagatttaggtcaaaattgtgtgtgtgtttgtgtgtgtgtttatgcgtgtgtctatggatgttcagttacttcagcaccattccttgaaaaggctgtcattcctccgttgaattgcctttgtatctttgtaaaaaagcatttggagctgggagtggtgggcatgggcatggggtagactgattcctcctacactttttttcccccgttattttagctgttctagttcctttgcttttccttataaattgtagaataatcttgtttatatctacaaaaaaggtctttctgggcttttgatacaaattgcagtagacctgtatcagtatggagaagatcgacgtctttagtatgtatgttgcatttttcaatctgtgaacacaggttgtctctccatttatttagatccttgatttctttcatcagcattgtgtagttttatcatgcaagt

SEQ ID NO: 89274 - DNA, 1028 bp, Homo sapiens
aggccagttattttctctggttatgggactctgtgttgatagttctttcagcccttgaaaaaattataccactttcttctggcttccatggtttctgaggagaaatccactgtcattctaataatttttcctctgtagaaaggaatcgtttttctctcactgttctcaggattttttcttcgtctttagttttcgaaagttttattatgatacatttcggtgtggattcctttgggtttatactgcttggggttcactcagattcctaaatctgtaagtttatgtcacttgccaaatttaggaagttttcaccattacttttttgagtactttttcagcctgccctctttctcctcttctttcaagactctgatgactggaatgttcagtcttttgttatgattccacatgtttttgaggctttgtcaatttttctttagtccatttctctcttattcatattgggctcttgtcttccagttcctttcctgtgtccttccctccctttctgctgctgagtctttttattttggtatttttcagctctaaaatttgctttaggtttttcttcatatcttgtatttctttgttgaggctttttgtttatttattcttaatttgtttcaagcatgcttgtaattattgaagcatgtctatcacagctgctttaaaattgttgtcagataattctaacatctctcttcttggtgttgctgcctcctgatgtctttttcattcagtttgagttcatcctggctcttggtatgatgagtgatttttaaatgaaaacctgggtgtttttatattatactatgagattctggatcttacttaagccttctgttttagctcgctttgttttgataccaccctggcgggggaaggttggtggggagggcacatggcactgtctagtgatcactagaggaaattagaagtacaggctccccacttggcctttcttgacccaagaggtacagtatcttgtttccaccaggtgggagtagaggtccaggatatccggggga

SEQ ID NO: 89275 - DNA, 1067 bp, Homo sapiens
tacaggtgcatttttagaaatggaatcagatggtctcgtcaatgggtgaaggaaaaataagtcaatcacttgatttgtaaggggtgtcaccattaacagcaatggaaaaaaacagagtttgagaagagttaatgaatgtgtcttggtacatatccagttgcaggtgtcagagaaggattccaggtggaactgtcctgtaggcttcatagttggagcactgcatcttgttgggagaggtcaggtctggaggtgcagatgagcatcatcagcattgaaatgatgaaaacagggagtggtagaaagggctgaggaataaacctgaggggatacttacagttacgggcccggatgaggaaagtgacttttacatcctcactgggcacatatttattgagtatctgtttgtgccaggcactgtgactacaatgggaactaaacagacatagatcctgtctttgttgatcatacaatttaatgaggaagataaaaatagaaacaattaagtaaacaatgggagaaatgacatttcagctgagacccagaggtcaaaaagattttaataatacaaagagtatgggcaagaggattctggtaaaaaagaatgctatgcacagagactgtgtagcaaagaggactcattctgtttaaggaactgaaataccagtgtggctgaagggccattggtgcaagggatgggggtggggtgagatgaaggtaggaaaattggcatggtatagctgatgcaagacctcattctcagtgctgttgaaaggttttgagtaggagaaagctctgctcctgattttaagcagatcacccctgctgcagtgtggagaatggatttgggtgagagggtgggatgggtaaaggggaggcatggagatcagttgggaagctcttgcaggaggcctggactaaatggtggtagtggatatgtctgaggctggggatcaggctctggtgtttgtctcagcaagctcttctggccttcaccttagtacctttgtttttctttatcatcatatgtatcatgttacccctctctgtttatccttgccccttttaga

SEQ ID NO: 89276 - DNA, 1034 bp, Homo sapiens
gaaatgaccctgagagccaagagaagaggctttatttatagcctgcctattctaaaaataatttaagatggctaagatatcaagtagaatgaagctgagaaagagacttgtgttgctaggtaggacattacagttacttgattaacagatggtttcattgaagtgaagacttgccttagggatagagaaaaagacttcttgtgcagaagatggtaaaggaagaacaaatagaatgataattggagaggttggtgttgtagcaaaaacatgtagaaaatcttagagatttgggggattccatgaccagaaaataacatgagcccctggcctggaggaagttcctgctggatcctttacttcccagaaactgctcccctggtaggcggtgtattttcctgtgtctgagttcatagtgggcagaaagatgcatattttgctgaaactccaacgcagtgttctcttgtaatgatctggcattaatcttcgtgtgattaaaaattaaagtatgagaagaaattagtaacttacctggcctttgcttttcagactctttagcatgatagttaagatttcctctgttctgaacacacccctttactcctgtctcccaattaattcttctgtttgctgttccccagacattccctgcaatttcttgcctccctattttaactcacactgttttgtccacttgagatattgttttgccttttcctaactcataccaattctctagtcattctccccaccagtttctcttttttgtgcgctatagcccgtcacaactctcggcatcttttgcaaagacttaaactgtgaaatgacatgcaaactcactttgttgtctctccttctatattgcaagctcgttgaggatagggactgaacatttttcatgtttgtgtgcatcagactgcttagtgtagtgttttgcacatatttgagaaagtttgagtgaattagggatatgtgattctgtgatagactaagtaacgccgtgtctaagatgagcaggtcatatactaggttctagt

SEQ ID NO: 89277 - DNA, 1418 bp, Homo sapiens
tcaggatgcttttcactgtagtagcagaatacccagttaaatcagtgagggctttatcatcttgcataacaagaagttcagacattgggaggtctggtcttagggttggtctggctccatgaaatcatgagggtcctgcgtgctctccatgttttcaatttgttatcctcagcatgtcattgatggcatgttgatgatggcttcccccatggcctcaagatggttacattacttctaagcatacactacttctgtactctccaacaatagccaaaggttgaaaagtgtagtttctccttcaacatctctatgagggatataactgtttctgaatgcttcccagcagacctccctttcagtaccattagtcaggatttggtcacttctattagctagaggaatagaatgaccgtggttggcttggaccagtcaggaataggtggcctagcagagaatggtcacttgaattcagttggaggtcaaatgcaatgaaaaatgtcaaggttggataaggaacaaacagtgtctcccacagtgctgtgtaggtgtctttggccttcccacctggaaagttaagatcctcacagtttcctaagagggagagagataattttgtatttccactgagcttggcattggatctcagtaatagtttattaactcactaattcatgtaatagacattaacggaacacattttgtgccacgtactgtgctcagtattggggaagaagctgaataaggcatgatcctggcactcaggtggtagctgcctacagttaagtggaacagggtggctgactaaggggggagaatagagttattctaaaataaactgattttaggacattcatttttcaacaggagatgtgggacatgtggatttgggatatgaattcatttgaaaaaccactttgggtaagttgatagttgggagtgaatgactttagggctctacttctcttacattggggtttgatcttacagctagcttcttaggttttaaaaattatgttgattgggggggcggttccaagatggccgaataggagcagctccagtctacagctcccagtgtgagcgacacagaagacgggtgatttttgcatttccaactgaggtaccgggttcatatcactggggattgtcggacagtgggtgcaggacagtgggtgtagcacaccgagctgaagcagggcgaggcatcacctcactcgggaagcacaaggggtcagggaattccctttcctagccaagggaaggagggacaaacggcacctggaacatcgggtcactcccaccctaatactgcgcttttctgatggtcttagcaaacggcacaccaggagattatatcccgtgcctggctcggagggtcctacgcccacggagcctcgctcattgctagcatagcagtc

SEQ ID NO: 89278 - DNA, 1112 bp, Homo sapiens
aacccagtaatcctgtcatgtgatctagaaatcattcccagagccattgctgaagatacaggatgaaagtttgtctgtgagctttgctttgcagtgttccaaatgaccatttgagttcttgttgtgtaagtatacatgagaaaggctctccattgtttatttaatctgagaaggtgcctctagaaataataccatttaaaatttaccaagtgtttactgtcatgtatgagtgtgttgttcattttctcatttagtttagtgcaatggggctataaggaaaatatgtttttctcatttaaaggaacaaagaggctcaggtttttgcaaatacagtaacattgctaggggtcacataactcataagtgttgctgcaactgaaatttgaactcatttgaatttcagcatttggcttaatagacactgatttctgtcttaatatgctgattgtgtgggggttcccaagacccacccgtaggttcagtgattggctagaaggactcacatgatccagcatcagttgtactaacagccaggatttattacagcacaggaaaaaggtgcacggggtgaagttcagaggcaaacagacacaagcttccaagagtcctctccctatggagtcacacaggatgtacataattcttccagcaatgaatcgtgacaacatgtgtgaaatgttgtgtactagggaacctcattagagagtcagtgcccgagatttttattgagtctggtcatgtaggcatctcctgcctaacacataccaaaattccagattcccggaaggaaagcagatgtttatacaaacaatacaatgttgtttgtaaagtttaggcacagtgaatcacgcttatcatttaggaaaagttttatatcaatgtagggaactgttcaccattaaagtttccacatgccagccaagggccaatctcgacaaccaagtccttctaaggatagcaatcttaggcctgttaacttttttcctgtacactgatttattcatttgaagcagttgtgattattatcattcagcttttgacaagtaatgagaaaagtacatattatggcaaactaaattatttaatggaatctgttttgtggagggtggaga

SEQ ID NO: 89279 - DNA, 1967 bp, Homo sapiens
tttataagtatcacttagtgttttctcaggttgctctctagcaaccttgtgaagtaggcaagaactgctgtatatatttcatggataaactacaggcctgccctgaattgttcaggtaagtgcatctctgttggccaccatggaacttgttgcataaagttgcccttgtaagaagctgttatcttgcccacattctggtccttccagggcatctgcatttgtagctttcagcatagacacagtgcagactctgtttcctcactccacttcataggaatgcacttggtttatatttctcctggtcttcagtgacacaggctttgagccttagagtcagctgctgagcaggagattctctacctctctgaggtctctcaggctgcttcatcatgctccaagatgaattccttacgcttaagacacctatgctcaaactatcccaaatgacttttcaaaattggtaaccattcctctagtcattttctcatcatggtataacataataaagggaggtagtagggtgggaaatggaaactaaaaatcagggaagtgtataaaattattgtcagagccaagactaaatgtcagatcttatgacatatacttttcttttccattatactttccacgaatctgtttcctgaatgattggtgactgttgcagttttagaatgggattcagtgtgaaagaggaacgagagttaactcaggaagctgctgtagtgcaggctacaaggagaactctattaattcttgagcctgggtactgaatgtggacagttgaaatgcactgggaatcactagttgcctaaccccctatggtaattaatagcttgacttttaccttaacgtataatacagcagttgagtaggaaggtagttaagacccaggtgtttgatgggtgtgaaatagtagctcactgttgttttaatttgcatttcctaattgtagggaattgagcacttttctacatgtttattggctatttaggtttccattctacaaagtacctgtttatgtcctttacctattttcctattggattgttgtatattgatttgtaggaattatttatatagtcctgatactctttatatattttataagcatttttccaagtctgattttcaaacatagtcttcatagtgaaatttcttattcttaatgaaattaataattcatattacttaatgtttataatattaaattaattttataattcacttttgatgttctgaatttttaagttaatcttttttcctttctttctctatagggtatgaacgtgatttctgatgaaactggattggaataattttcatgatctttgtatatttatatatatatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatggtgagtgacattttataatagagctgttttaactactatatcactggtttttactaactaatttggataatataaaattttaacttttttagattaactgtagtctgtgacttcctgtgggagatatgaggatcatattgatagttctccaatgggttcatccagcagttaaaagcatgaaagtatcatatatagaattgctgaattcgatttttgtgttcaatatttagtgtagttaatttcctgtaagttactttatgttactaaataatgtgggtatctcatagttgggatatcaaaattgtacagaagattagtctaatgccaaaatgctgagtggagcattaaaattgcattataaggtatcaaaagagattactcctcccctcccatctcattcctaaggggaagaaatttttatagatagatgtgatctgtagaagttgtt

SEQ ID NO: 89280 - DNA, 1040 bp, Homo sapiens
tagaagcccagccaagggtggcatttgctcagaggttttacctaaaataaagtgtttctgatagtttggtatggggcttcttgtgaccctggcaagtgtcatttcagggaatggtaactgtggaagtcagtggattctggattcaatatactggagaaacagtagggatgtggctgttctttaggaagcttcagcatgaagggaagcatgtagtatacggtagttacaagagagaaatggagccgaagttggttttctatgtatttattattatttatgtatgttcaggaagaggtttaaactataggggaaaggaggaatacttgaaagaacaaattctcagcagatgagacagtggggtatcagaaacgtgaaaaggattctcctcaaagagcatccacaggttattatagttttgacaaccactagtggcataagtttcaaagaaaaagactgggttttgtacaaaagtacaagctaaaggagcaaaagtctgaaagtaacggaggtatgagatggcctccttgcctctggaggaaaggagaacgaatcattctcccagaaacagttgtgaggttaaatggactctggaggagagctagacttcagttaagtctgtagatggagcctgtgtattgtggagaccagacagtggagaggctttacaacagcctgggggtgtcagggtgttcaggggacagactgagaaggacctccaagcgtgagggaagggctgagccgtaggctggaggggaagtacatagctaaggggagataatctttgaggtccctggtagtcttaagggaagaaatgattaggggaagagcacagttgatgctaataagcaacagtttgaaaaatctgctttgatatgaagtttcagtgcagtaggtgctgagaggtcttaagtcttttcagagcccagaggttgttaaggttctgctagtgacaaatttctgtggtgcatttgaagagatgtttactaaagaggatcagggagagggaatgggtaatggcaccaaggatgccaactttctag

SEQ ID NO: 89281 - DNA, 1035 bp, Homo sapiens
aatcacacaagacatttaaatagtataatacattatataattacatgtcagaaggaatgagagcagttaagaataccacacgtaaagaaataattgttgacaacagaagtataaaccttatgtggataatctatttgctaggacttaatccctctgtaagaaaattaacctaagttaatataaggaggaatatatacaaacatttatcctgcaaatgacttgtgcttggtttacttacgtgtcaatatttgctagattaaatatattcttccagaagagatacttaacctgagataaaatgaattattttttcatttcctcctttgtttttctctctcgttctgtgaatgcccaagaaggctgtgtagaataataagtttttgtagaatatggcctaatttaaaaggtgcagggtcccacaacaagtgacagagaaactcacctatagcagttctctctttcctttccctcatgcagccctcacccaacaccccaatctgtgtacatctgtgagaggaaactggtgtgagcagatgtctacctcactgctccacctgaggcttagtctctaggcagggtcctggagtgccgctccagagtccctgctcaggggtctgattctcctttatcttcctgccttggaagcctcaaatatccgggttaccatttccggtatctgggagacagtagatctttgtttttgtggttataatttgcagtcttgctttccaggttgagaatcatctaatgtatttttctttggctccattgtttaagtcgtaattgttagacccagaaaccagagcaagctgtttgcttttatgtaactctttacatctgctttttttcctattcatgagacacatctaaggcaccatcatttctcacctggatatggaaatagactaactagtcaaactaatgtccccacatactcttaccccctcccatctgttcaccatggtgcctccagagtgagcttttttaaagcatgcaaatttgatcatttcgcttccatgcttaaaacccctccac

SEQ ID NO: 89282 - DNA, 1901 bp, Homo sapiens
atggcagtggtatattgatgcaggaattcacaaatagactagtgaaacagggtagggtctagaaaccagctcatttttgtatgtaatcttgatttatgacagagcagtcactcatagttacagcagaagaaaaagggaccattacataaatagtggtggaacaactggttatccatagaagaaataaatgaagttggatacttactgtatatcatagttaaaatcagtcccttgaagattaaagtcttaaatataaaaaacaaaaaaaaaatttttttaattagttgagtgtggtgttatgtgatcccagccgtggtcccagctactcaggaagctgaggtgggaagatcacttgaggaggtcgaggctgcagtggcccctgattgcactactgcattccagcctgggtggtgacagagtagtgataccctgtttcaagggaaaaaataaaaaataaaaacacttactatacaattgttctgtagttggcattaaacaggaatgttttgaaagatttcttaacttgcttttatgacatcaggagaacagtggtgtgtcccatcatcgatgtgatcagtgatgatacttttgagtacatggcaggctctgatatgacctatggtgggttcaactggaagctcaattttcgctggtatcctgttccccaaagagaaatggacagaaggaaaggtgatcggactcttcctgtcaggtaattaatttgtcagacattttgcctaaagtgttattggcagaaggttgtggagctttgggaatcatatcaaatggataagtgtattttgagaaacgtgaagcattcgtataccttatggtagttaacagccatctttcacatatgtgagtgttttaaagaaggatttctcctctaataaaattagaaatttttgcttattctataaatctagtgcacatgagaaatgatgacatgcgtgttttttcattcctttatgaacattttgcaaatgcgtcagatctgtactttaattcagttattaaggataataatacttagcttaattaattgtgtcagtatgtgaagatactacctaaaactgggtccttgcattaaaatgtacaattttaaattcagacttgtaccatctggatgacagttattgactggtaaagttagaaaagcttgtgtaaaacataaaaatagctagaattgacacaaaatataaaaaaattcattaatccatttattctctgattttttttctctacttggtcatatatagatttttttttcaggatggaataaaaatcttcatgctctttttagaacatgaaattgagacctttgagctcttctgagccatcctagaatttagccccattgtaccgacctgctacttctgtattaagagttccttcagaaccaggcttcagcttttctgtttttgggcctcctgcgtctgccttcccttgaattcaagttcagttctggcaacactgaagagattttccactgactgtgtgcttttttccttagcctgagttcttagtagtagtagtgcaagggacttttcttctctttagctgttagtgcaattcactatctaaatcaggggttcctaaacatttcaaaaatgacaaaattttttgaaaatctggtgaaagctatgggtcttctctaatggagaaaaatgcacatgtacatgcagaagatttagcacacaaaaaactcaggtcaagaaaaccctgtattaaatgataattctgaattttggctgtttcttttaaatccttttctcattctttttttcttctaaaatcaaaataagtccaaaccttttttggaaacaactgtttcctctggaaaggcaatgagtacattttagggttcatcttaaaatataatcttcgtggtatctttggtc

SEQ ID NO: 89283 - DNA, 1046 bp, Homo sapiens
gaaactttgctattcagagttttgtaggaacagttgttccatcagctataagtcggcctgacattgttactagtccatccttattttttagttactgcaagactgtcaagtggcagggtgcacagttcagtgagttgtgtgagagaagcctgactgcaaacaattgctctgtttaatatttgagcaaaatagaccttgatttttttgtttgtgccttaacatatattgaagtttactgatcccatatcacttatatttcattctcacataaatgtcatttttctctgaaaaattaaaacacattttaatgtattttccttgctttatacttttggtggattcatggtgtctccacttgtatagtcacatatcacccagctgataccactgttctgattcatctggcttattagattcaatatataaacatgtgttacctaaaacaacactaataattcagagtcaattatttctttcaacaggtgttacaaaggtagattatggagatatatcgtcaagagttggtctaagacacaaactacaatgcaaacctttttcctggtacctagagaatatatatcctgattctcaaattccacgtcactatttctcattgggagaggtaagaaatatatatatatatattctatgtggttattatgttcttacttttttattaaaaaaaaataggagttagttaaacttccaataaggaaagtaccttcatgttaacatttaacttctcttgcttccttcctccttcttaccacgtaagtctaaactatattctttttttcccattcctcctccctgaaagttgatttccactgagttgatgcgcctggagataagctgtgtactgtggggtctgtttttccctattctgtctatagtgatgtgtttcctaaacagactgcaccatctgcaattgtggatctgtaaaatctgtatatatattaaaaaaaaaaagacttctttgcaggtctttgtgaacttgtaattataagatggcttttagaaaaaaatatgaagccaagtagggaaag

SEQ ID NO: 89284 - DNA, 1049 bp, Homo sapiens
gtttaggaaactgaagcacaaaaaagagaagcttctcatagtgttacagagcttatgccagaattaggacttagaatttaggtcatcttgcagcaagtcaagtgtaccctactggaccccagtgcctttctccctccctcatacctctttatcgacctacatatctacctacttctctctctctctctctctctctctgtttctccatccatccacctacctaccttttctccgttgtcttttaaataatgtatattaccaaaaaaaacaccttttctgcagaggaacttaatcaccaaaactgatgcttgaggtgttttgttttcttccactctcatgttaagattttttctatttcagaaattaaccctgcagcatgtgaacagtaatcagtgcctggataaagccacagaagaggatagccaggtgcccagcattagagactgcaatggaagtcggtcccagcagtggcttcttcgaaacgtcaccctgccagaaatattctgagaccaaatttacaaaaaaacgaaaaaaataaggattgactgggctacctcagcatacatttctgccacattcttaagtagcaaaaaaggaaaagtgctttcctcctctgcaggatgtaaggtttatcagccattaaaacttagacttctctagcttttcactagctgtgaaccagccttcctgtccatggacgtgaaactgcatagtaatgagactgtgcacactgatgtttacaagattgaaagagtctttctccgaaaatcatggtaaagaatactgagacaatgaaaaaaaatcaacaaaatatgctttctggagaactgtaccttttatggtttgcttgcacatcagtagtttctgctgaacgtgctgtcataatgaagagatttccaagattttttttcctgattagaactggtagccagtatattaaatattgatataaaaataaaagaactggaaccagattcagaatcatgaaaacaacatttttacaacaacaaaaaaactatattaaacagggtttaaaggaaattaaaaca

SEQ ID NO: 89285 - DNA, 1050 bp, Homo sapiens
ttttaatgacttagccaaagaagtgcagctattattccatattaataggcttgcatttcttttcctaaatcttatttaggctaaatcagttttatttttctctgattttttttaataccacagaatcacctgagtgtcaattgaaagttgtcaattaaaaggtaaccttttaatctcgtaggaggaatctcattaagacatttttcctgatatgtagagcagtctgttggcaaaaatgcatatattttctttcatatttgtaaaattatatttaatggaattcttttctttgattatcaaggactttcactgcaggcagtgctatttcttgtgcctaagaatgtttccaaaagtcgcatcgctaatgatatttgccaagttgagtgtacacaaagtttctcatatcctgttcaagttaatcaacatcaagcacatggggatgctttagggtgagtctatagtacaaaatgcataaaccatgtccccaggaaatttgaaaggaagcaggtgctgaatggaatttttttccttttccatgagctgtgttaattctatctccagtaggcctaatgcttgaataagcaagatgtctaatcaataaattattttcatgctcagaatttcaggtttttgtactccagcatagcttggtcttatttcttactgtatgaaagcttaacagcaatgtgatttaaggttttgttttaaatgggagatgtaagtgatttaattcatgggtacttttagaacctgatagataatcccattgcctttatttttctaattaaagaattcctaaatactttgaaaatacaaaatattcctgaatagttgtgccttacattggttttatttgaagttagagtggatccctgtttatcataattacttgtaattaggcagatgcttatcactctattataactcaaattgggaagaaaagaatgaaaaagaaaacaatggctgggtactggctcatacctgtaattttagcattttgggaaggtgagacgataggaccacttgagggcaggagtttgaggttgcagt

SEQ ID NO: 89286 - DNA, 1004 bp, Homo sapiens
tggattttgaatataaaaccaacagacttgaggatgcgtgggatgtaggatgcgagagaaacaaaggagtcaaggacagtgtttcaccttttggcctgaggaacaggtagtgatcattgcagtcagagaaccatggtggaggaggccgtaaggtcaggaggtctgtgcaccttatcatgccaaatggcacatgatgttaaaataaaatgttttgagtaatcagaacgtagttaattgtgctccaggatggatcatacacagagccgtacccatatctgatttacatgttgaaatttgagaattttgagatgatgagacttagatgagatttttcaacttgatgagaccttgaggaaccttgggatgggatgaatgtattttgtatgtgggatagttgcaaatcttcaggagtcagagggcaaattattgtaggtagaataatgatttccaaagatggccagtttccaatccttggaaatagtatattagcacaggtgaattaaggttacagatggaaattcggttgctaatcacctgaccttcagatgggaatattatcctggattatcccaggattatcccttggttccaatgtaatcccaatgcccttaaatgtgaaggagggaggcaacatctctctgtcagtgtcagagagttgtgatgtaagaaagactccactggcctttgctggctttgaagatggaaagagaccaccagccaaaggaagtaagcagcttagaagctggaaaagtcgagaaaacagattatcctcttaaacttccagaaaggaaaacagctacactgacaccttgattttagcctagtaaaacccaatttgaacttctgacctccagaattgtaagataatagggttttgtctttaagccactagtttgtgctactttgttacagcagcattaggaaactaatactaagggaggagaccacccctcatattgtcttatgcccaatttctgcctccaaagaaagaaaatgtaaaaact

SEQ ID NO: 89287 - DNA, 1033 bp, Homo sapiens
gagggcaggctggactggggacgctcctcccggccgcctcgttgctggcagcgcttccgcccgccggcgcaccagtcagtaccgcgcccggcgaatgtggagggcgaagctgcggcagggcaatcacaaaagggctgtcagagaggaggcgaggcgggaggaagatggagaggcgggtgggagcctcacctttggactctatcgccacagcccggtctagccgctacgcccgagctcaagtctgactcgaaactccgctgggtgcctgagaggacccggcaggccaaggggtggaactgagggggcggggacgcggcgggcgggtggggccgcctcccggctgggcacgcctccaagccagactggacgcgaaggaaaccggaacctgtctgcctacggtgcctgtttccggaagcagcttgagtccggacaccaacgacggggacgctgggaagccgacttccggcgccctattttctcacctggttcccgcggcgagccagcggcagcggcggcggcgatgagacagaagcactaccttgaggctgcagcgcggggactgcacgacagctgcccgggccaagcccgctacctcctgtaagaggactggaggggaagcgggaggcgagcgggtaggtgttcctttgctcctcacaagtctctttctcttttacagctgggcctacacttcgtcgcacggtaagaagaacgcctgtctcttgtgctttgggctcttgtcgccccgctttcctctgttccgcacaacgctcaaataaggccgatggactcacttccctccataaaaacaacaacaacaaagcccgcatgtgtctcggtttcgtgaaaaatccaaattctttaatgtgccttgtcttgctttgttagcggcatttgacacattgatcagtcttgaaatagtttcctcccttggcttctaggtcattacgtagttcacctcttcatttattacttctcgatttgctttgctggttcctcctaatctccccaagctttaagtattgtcgtggcccag

SEQ ID NO: 89288 - DNA, 1003 bp, Homo sapiens
cctgttcagttagatttcctcaggaatttctgacagagaaaagggcaagaacaaatgtttagggcaagaaagtgtattatgaatggttcagtatttttttttttggagacggagtctcgctctgtcgcccaggctggagtgcagtggcgccatctcagctcactgcaacctctgcctcccaggttcaagcagttctcccgcctcagcctcccaaatagctgggactacaggcgcacgccgctacgcctggctaatcttttgtattttagtagagatgggatttcaccgtgttgcacaggctggtcttgaactcctgagccgcccacctcagcctcccaaagtgctgggattacaggtgtgagccaccatgcccggccgtgaatggttcagttttgttggcacataggatgatttaaggcaaagaaagacaggcagacagactggtgccagatagggctggaaagccatgctagagcatttatccatatgctacacagtgatgcttctaatcagagctatgctccagaaagatgatcacactaaaagagtttgatcctagaagcagggagacccatgaggaaaatcactgcagtagtcctgacaaatggtgcataaggacctgaaccagaatatagcagcactatggagaaaaaggagcaaaaagatgaaaacagggaagtaggatatatagaaatcggtgacaaggaccaagggaatagggatttttgaatgtacctgtcattttaggtcaaaatgtccagaaaggtgtgttcattcacagaataaggaactcaggaggatggacaggtttgagtggttagctgtggggcaatgatgaactaagttttgaacatgtaggggactgaagtggttatatttagcaggcagctggaaataggcacaggagatgttggaagtagagtaacatacctagaagtcaaatgcattgaaatgagcattgaagatatgggagtatgtgacattagaaaagggtatggaggaa

SEQ ID NO: 89289 - DNA, 1034 bp, Homo sapiens
tacagtgaagattgatggaccagcctctttccaggtcccaggactttgcaagagatggagacaggttaggtggatagtcctgtagtgttatttttgtatattgttgagaaagaaacactaacaaaaggaacaacgagtaatttataaaattgtttaaaatgttggtttgtttactattttattggtaaattaacatgacttaatttgaacaaagtgatgatttgtgtgtattaataagctcacaaatagtgattattttcaaaagatctttttgtaaattttttttttgatccaaggccttgtgagaaatctcttgtttgtatttcttcaggtattttcaattgtttttctttattttcttcagcatttaatcactgtatactatgtaattcctgaaggggaagaactaattaggagttgattgagactttattatggtatagttaggacttgattgtagaagggactaaatgttccaacataatctttacccttctccccaaacaaaatatcaattctgtgtctctacatgcctttgattccttagaggtcggtaatttaacataaaacagggatgtcactttgaggggcagatgaaagtctagagaactgttccttaatagcattgtaaaagttccattccaactgccagtgtagattttaaaagtgttaaatagtgactcccttgattaaactgtttgtaattatttgagtagattaataatgaaaatactttggaaataatatacattttgacattctaccaagaggacaactttggttctggaactggtttctatttgtcaaatcagtttccttttaacataattaatccctttaacaaaaagccgtctatgggattaaaagacacgtgaaatgatacttttattattcccttgctcatataactttaaaaataatacttttagctctaatagctcaagaacacaatattcgttaatgttcagtaaagtagcctgagacattttcaatgtttccttaaggtttttgaatgactgtatatttggcagtta

SEQ ID NO: 89290 - DNA, 1073 bp, Homo sapiens
atatcataggaagttagcttgaggccagagtcagaaaagattctattgcagtgtttggtcttaatgtaggacttgaaaaatatataaaatttggatcctcaatatatacttagtattagctgtaaagaaatctgtaatggtggttcagatttcaagaagctgtagcccacttgcagtgcacacaaggcaagtcacacctcctagttcactagtgttgaagtattatagcagtgtaaagaaggcttctgcccttggaaagacaagacagacttaacatggattacaaccaaacagcgcagagatagtttcagctaggagcctagagtaaggatgctaagaacaggggaagagttttaggcaaagtgaaaatttgcctggattatgacagatgggcaaaattttggaagactggaggggcttggatatgatcagtggaattgagccttggtatgaagctggaactgcagaaactgacatgagggttgctcatgactgaggtgataacaagctttagggtggtagtggtgatacttgtggcaagtaaagggtaaattaaggacagaaaggtgggccttgttgaatgaggaaaacggaggagaagaagtaaagtggcttcggtcaacagagtaagaagaatgaggtaaagcattggttcccaaatgcacccatgccatggtgccacctgagaacatttattttaatagttacatttttttttttagtttttgagacagtttcattcttgttgcccatgcttgagtgcaacggtgcaatctcagctcactgtaacctctgtcccaggttcaagttgttctcctgcctcagcctcccaagtagctgggattacaggtgccgccaccacacccagctaatttttgtatttttagtagaaacagggtttcaccatgttggccaggctggtcttgaactcgtgacctcaggtgatccgcccgccttggcctcccgaagtgctgggattacaggcgtgagccactgcgcccagccctagttacgtttattttgatgtgtgaatcaaaacgaaaatgagcacaaccaacctgtgattgcatgga

SEQ ID NO: 89291 - DNA, 3330 bp, Homo sapiens
attgaatggagatcactgtgaaacactgcatttatttctttatacctttctttgcctaaacatttctagtataaattcccttattttgattttccaaagttaattgcatcagtattgtctggacctggcttggcattatttaatgggagaaagcactgaacaagtatagctattagcatggtgacacagctagtttagtgttaaactacactaataaaccaagtgatcagaatgtggaagataagttctgtttcatcagatgctggttaaaccacagcgggatttctgtcttcaactctggattccatattaccaaaatgaattaacttgccacagtgtatccagaggcagagacaagaacaaagggaaatggaactaacattccttggagaacagttgagggaactggggagatcagagctggggagggatataaattatgtgaatacctatcttcagaacctttgaaagctattagaaaagaggatttgggtttacttctgagagcagaactaggaccattggatgtgttacaggtgacaagaccactctgccatttaaaacttcctaatgtgtaagggctatttaataaagagtgagtcagtctctggcatctacctctatagcagatcttatacacagtctaacgcctaactagattaataacaccttaaactattgacttgtttacctcactattacctgatgtttgggtttcaataagaaattacaaggcctgctaaaagtcaagaaacagcctgaagagagaaagcaagtgtcagaaccagacttacatatggcacaaattttgaagtgatgagactaagaatttaaaataattgaaatgttaaggggtctaacagaaaaagtaggtacaatgcaagaacagatgggtaatataagtagagaggtggaaatgcccagaaaaaatccaaagcaaatgctaggggaaaaaaaattaccgacactgggaggcttaggtgggaggatcacttgagcccaagaggttaaggctgcaatgtgctgtgattgtgccactgcactccagcctgggtgacagagtgagactgtaaaaaaaataataagaatgtgtttgatgggcagttcagcagactgggcactgccaaggaaggaagtggtgaacttgaagactaggtctatagaaacttcccaaactgaaatgcaaagtgaaaacagaatggaaaagaagtccccacaaatagaacagccaagaattttggtaccatttggaaaggtataatgtacatgggcttggaatactggaaagcaagagaatgaagccaaataaatatttgaggtaaaaatagccaagaattttaaaaattagtgacagacacccaaccactgatccaggaaactcaagagaacaccaagcaggataccaaaatgcctacaatctctacttaggcatgccatattcaaagtacagaaaatcaaagtaaaaccttgaaagaagccagagggggaatcaccttaccttacctgtagcgtaacaaagataaattatggacttctcagcagaaccatgcaagcaagaagataagtgttgaaagaaaaaacccaccaacttagaattatatatccaatgaaattattcttcaaaagtgaaagacaaactagtgagtttgctagtgctggaggtggtcaaaaagaggtcgaataacaaggacgagaaatgttgggttcaatgtttgcctaactatattcggtacataagctgttagctctggaagatggtagtatgtgttcagcaaaaatgtatttcagtgattttgaggaatgtcgcaaaccagattgtacttttggaacttcactctgctcagatatggaggatctgagcaggcctgtagcaaagaaccctatttttgcttacaaacataagcccagaatctctgacttttggcctgcttgtgaaaaccttatggaatgatgtttcatggaacacccaatttgggaaacaccagattagatgacatttatgacaaatgagaaatgggattctttattaactggataatatatgtactaagtgagtgaggctaaaatgttagaagataaaggtaacagtattaacttcctcatttgaatttgagtacatgtggaaagactgattatggagggtcatttctttaaattccttctctctgcttgatttgaaatttcaaaaacagaaataaccaaagttaaatgctgcttatcagctcctggcttactctctctgctccatccttccaccctcaaggtcaaaacatcattattaggaggttcagctttcctggcattgggcaccttttctggttgaactagcctgtttctgccttttccctagtatgtttatgttgctgctattactcttgtttaagaaaatttatcacggggcctatatgctgttattcatgggaaaatgacaactctgcttcactagtaggaatgccagagatgttttaaggacagaagtagactacctgatacaagtcagtgtttccttattggattttgagttttaggaacataactagttgtcctgtcactgttctgaacccttagttgaactttcatttggataacatcttcagaatacccacccccaaaataattccaggatatgagagggaggttagcataatggtaaagcatgaggactctgaagacagattatcttaagttggagcccccttttgcccctgtctgttgactttgggtgaagtttcttaatggttaaatgtggtttagtttcatcatctataatacatggttagtaataatctctaccagtgaagattaaatggagcacttggaacaatgtttggcatatagtaagcagatgagaagtgtagtagctatttggttagggtcacagtgtggtataatgaaatcttggaatacataaagtttctttgtaacatctaccctaataatttaacattaccggtttttcaaaacctagttgacaggcattgggttccttgcagaaaacttgataaaatatctttttccacatgttgttaacaatctggaagattaatgaaactctgcaatagtggatttcttaagagaaggaactaaaggaagtgagacagttcgttagatgatacttacttacattaaagtaattcccaccaaaaggtaaaacttctgcagtcaagggggaaaaaatgacagctccatctgagatgtataggataacctgtgaaaagaaatgagaaaggattggctatattggagtttatatttttaaaattgtcaattccaggattagataccaagccaaatttgagcatttgtttcccagaaggtgagggcaaacca

SEQ ID NO: 89292 - DNA, 1033 bp, Homo sapiens
acctatctcggatattggtctttcattaattttgcttgatatttgatgtgcccttatattgggaagacccaagttgtcttttatttttgcttctcagtttatagtttttttcttaaatcttattataggtatattgaatgttctgaatcttcacgctgctcatcttttgttttgcctcacttttctcattttccttcactatttcctatggttttgttgttgccattttttgttatactaattcttccttactgcatgagaactctgcttgtctaatgttgggaacttagatttttttgtcagatttttgtggtctctgttgaagaaagggatttatcattgtgtttgcttggctagttcacagattgtacaactcaggtcaagtcaagaaggaatcaggagttgtagatgttagtgccagaatttgctgagtcagcccagatctgactgggaccttgcctctatttttgccagcacaccaaccccgccatccaattattctggtattgtactccctgaatcctccctgtacctctggaaaccacagcagtcacagctgtccttgttaaaatgatttggagtgatgactaaaatattcacaccttcagagtttggcaaagtcttgtaggaatgttcggacctatataatgtaaatgcaaaatactgtttaattagcctactaataaacattaatgaatttttacatctttaattattcttttgaatagagactatttaaacaaacttcagtaaatgcagtagtcccctgcttatcctcagggcatgttttccaagacccatagtgaatgcctgaaacttctggtggtactgaaccttatacactgtatatattcatgtgtcacttaacgatgggatacattctgagaagtgcatagttaggcattttttcattgtgtgaacattgtagcatgcacttacacaaacctagatggtatacctactacccactgaggctttatggtatagcctattgcttctaggctacaaacctctatagcatgttactgttgtg

SEQ ID NO: 89293 - DNA, 1035 bp, Homo sapiens
ttgtagagctgcagttgagcattttgaacaaaggagtaaattatcgtcttgaaattgtaaaattattttaccagcttgcattttttccccttctgtaggagaataacactaacaatatgtgagaataacgtgaataagaaatgaacagtagtaatccttagcattgtataagtactgaatttgtaaagagtaatagtgccatctagtggaagagcgggagctacagatgaaaccagagtccttaagccagtgttcattcttttacgttaaagtatgtaacagagaggaatttacactctattgccctttgtgcctgttcactcattcatggaatggaaatgtaatatcaatactaatgctaattactgtcaagagaggcattcatagaactctgatggttaaaacaatgatgcatataggcagttacgctttcttgagacgaagtccttaataaactgctaacaaagattacattttgttgttactgtatcagttcttagaagtgagatgagattgaaaagtagtttggagccacattgtggagggcacttgaatgtcaggcccagtagaggttgataacaggccaaagggaagaaaggagtggtggtgttggcagtgtctgaaaatggttatagttgttgagtggattagattggagagagattagcagtagggagaccagatgcaacttaattagaaaaatgtgctcagcagtaaaagcctgaactacagtgggtggtagcagtgaagtgtgtgtgtgtgtgttttgagacaaggtctcactctgttacccaggttggagctcagtggcacaatcatgactgactgcaccctcgacctcccagggctcaggtgatcagcctcccgagtagctgggactacaggcgagtgccacgactcccgactaatttttgtgctttttgtagagacagtgtttcaccgtgttgcccaggctggtctcgaactgctgggctcaggtaggtgatccacctgccctcgcctcccagagtgttgggattacaggtgtgagccact

SEQ ID NO: 89294 - DNA, 2972 bp, Homo sapiens
gtataatattttattatcccgtgcttttcttagataaagaatctggagaaaggctttccaaaatggtagaggatgcgtgtatgttgctggcagattacaatggcagattggcggcagaaatagatgatagaaagcaactcactcgaatgttagcagattttcttcgttgtcaaaaggaagcccttgcagagaaagagcataaattggaagtgcgtaacctttttcttctttagtgcttatttatttaattctctttttgttaggaattttaaaatattttaatctatgtgcacattttgcattttttaacatagacctttttaagcagtagcccaggtaagcttctccttgtattaatggtttttcttctacttgaaccaaattaatcttgcaagtaaacttagaaatttggaattagcaaaattgattgcatttaaaaattattcttgtgaaattccatgcaactataatttatcttaccagtttaaccctaatgtatcacagaaataataggaaaatagcaggtggcagtcacttgtagtaggatttatttagtttctgttttgagaagatgtagtcttttaggtataccattaagtctttaaattactcccttaattccacccgccaattctaatgcttacatgttccagccccactcccggctcacactcttaggcagaaattcattgctcctgtaaattaagtaataattaataccgctaatgagaaatctgggagtacaggaggtgattttaaaaaatgctcgtatttcctttgattagagtagcaattgttagggatacatgagccagatttggttttatgtaaaaaaaatctttcagttgatgagttcttgtttaaattgtattgctgtggcaatttcttattgtaataatatgtaggagaatttctaatttgaatccctttatttacagaaagctcactgtaaatttgtaggaatgtcatggtactaccccattaagttatttttattagtgtttagttattgattcagcagtctctaattgtgccaaaaatggtgcttagattagattgccattgctacccatgggagctgctacttaattattcccacctcaaattcccagctctcaagttagcactactcctttgcaatttactccttctctgctcgtataaataccctcagatgatgatagttggtggccactatacctttgaagaggttgcccacttctacatggaaaggaaaagatggtttttttttttaaaagatgaatttgataattaacttgccactatttcaccttgtgatgaaacctcaattttaaacatagtgttaattgttttattgtccacagaattaagggtaagtaatgtcatacaatttttgtctttagtcttttagtatggtttctttaacttctattgagcttctgttgcagatattggacatgggcgtatcttctaacgatgtcgtcaccattagtatattcttcctgctaaaaataaatatcaaaccctgaagcctgtattgtctcatgtttttgaaaattgaagagaagactgtaactttattctgctttatactttctcacttatgatgatggtcatttgtcactgtttacaaaaacagaatttatatttgaagtgtaactgtagaaaatagatcagatgccactccccacaacccccttttcccccagtgccttccagccacatttcatagttgacagtcatagattatgaggctgatgataataataatgttaacattcatgtgtcaggtactattctaggcacttcacataagcaactcatttaatcttacacagcaggatgtattatccacatttgatagatacagaactgaggcacaggaagattaagtaacttgcctaaggtcacaaagagctagtgagttgtttggaacgcagagaatctgcctccagagccagtgcacttcatcaaaaagacacattgcttcctgtttttacttaaatctaagattaaagcaaatgctaaagtcctattttttccaactttttctgctccctctcttctcagaggtaatcactgtcttgaaataaagccttctaggaactttttttgttgttcttctgcataactggattttatattataaagaagaaatcacctcaattatgttcagctgttttttaacaagtaaatactctttacaagtacagaaataaacttgaaagttattccacagaactctttgtaaattatcacttagaactatgttattcctttgtagaagatgtggaaatgatttgagatatttagacttttttgtaccaagtaggtggcatcactttgaagttgagactgagaggtgaagatttatgttttctgaatcagctgtgatactatcaagtaattttcatctattgtgtatctttgaacattaacagtggttgaccagatactgatgtgtcatttgttgctgcatttttgataatggaacataaatttaaagtatcagttcgggaattggccatttcatatttcttaaggaagccattattaaagcatgtgtaatgaatgaaaacatgaagtggtttaaaatttgtgttttaagacaatcattatttttgaaacttctgactatagttggttactaagcagaagcagataactgttgggccgggtgtggtggttcacgcctgtaatctcagcactttgggaagctgagctgggtgaatcacttgaggtcaggagttcaagaccagcctggctgacatggtgaaaccccatctctacttaaaaaaaaaaaaaaaaaaaaattaaccaggtgtggtggtgggtgcctgtagtcccagctacttgggaggctgaggcagcaggatcacttgaacctgggaggtggaggttgcagtgagctgagatcacaccactgccctccagactgggcgacagaccgagactccatcacgcgcgtgcgcgtgcacacacacacacga

SEQ ID NO: 89295 - DNA, 1016 bp, Homo sapiens
aggccccattaggataggaaatccctagcagccagtactaaaacttttacagtttaaactttttttggttgtgtaataatatgtttataaaatgtttactagaagcaagcagtgtgtctagatcacttcacttttgagctgctggccacatagtgatgctaagtagacatttggacagttttttccagggaatgaatgtctgattatatttaaagttaccgttaaccttttcaataacactatgcattgttactgttaacatttttctttttttctttttttttttttttagtgaaactgatgaaagttgtaagaagcaccttggaagagtgttatctatttgggaagaaaggtctgtttatgaaaatgatgtattagaacaacttaaacaagctctgtgtaagtgtagaatcctgatctcttaccttgatctcttcattaaaatgtattctttcattaatacttaaatgttctttcatttcagatggtgataagaagcctaggaagcgaacttatgaacagataaaggtggatgaaaatgaaaactgttcctctctgggatctccaagtgaaccaccacaggtagaaattttaccctgttaaaagagttacaaacttttacttcatgttgccaccaagctttattaatttcgtttcacttctgtaaattgatttctattatacttttaggtacaagaaagaagccacatgaatatctcttcctcattaacaaattgcttatgttaaatgtagtatgttgtatattgtatattttgcatagaaatcatgttttgtatagaaagaggatttttaattgccaaatatggttagatgtgagatgttagctatttaaactttttaaaataaaacaaaacatgcctattttgttatgtgattttttttttttgagacggagtttcactctgtccccagggctggagttcagtggcactatcttggctcactgcaacctctgcctcctgggttcaagcgattctcctgccttagccttccaa

SEQ ID NO: 89296 - DNA, 1048 bp, Homo sapiens
ataaacaaaaaatagtaattgattgaagggacatctctttcaacctgttttacatttcatgctcttctgttgtttcacaatagcttaataatgatttcgaattaacatgtctattaaaacaatcctaaattcaatgtaggatttagggtgccatcttaataacatgagcaatcaccatcttattttaaatgactatatttcatatagtttgtaatggttttactaaaatttaatacaggatagagtcaccgagatgcatttttacatagacattagttctggcgattttagcagcagtgactggttagtttggtagtaaaatgagagactagggttgaaatgatacataaaggttagtagggttattttagttctcaaaatgcttaatttaggtattgagaaagtttgtccaagtaaagatgttttaagtagatttttaactttttcttatttttcagccaaaccaaacaggaagcttacttttctctacctagccaatgatgtcatacagaacagcaagaggaaggggccagagtttacaaaagattttgcaccagttatagtggaggcttttaagcatgtttcaaggtatgatcatagttttgggtattaggtaatctgttttaaatgtaccatatgtccttttgctaaaatttgccttaaactattaaaataaaaagtagggaatatagttttttgatgcttttatttgaaaagacttccctctacatggcatttataaatgtattaaatgccttctctgaaggaaaaatattttttgaactgttgctaaggtgggcctttggagtacttgaattacagctttcctttaagagaccagaaccaactgctatattggaatgaacttcattaaaaatgaatgaaggtattgaagtaaaaatttgtgtgtttataaagctatcagtcttgtaacaaatatttccatatacacttagtactgtttctattcttttttttttttttttttttttttttgagacagagtctcactctcacccaggctggagtacagtggtgcgatcttggc

SEQ ID NO: 89297 - DNA, 1048 bp, Homo sapiens
aagcctgggtgacagactgtatctcaaaaaaaaaaagatttttaaaattacaaatggacacattgtaattgtatgtatttatgggatacagtttgatgttttgatagatgtatatgttggtctaatgatcaaataagggtagttagtatccattacctcatgcaattatcgtaacataacatttttaatgaaaaccaattatatttgctaaaaaataccagggaaaggagtgattattttacatttttccagatctttataagatctctcttaatagaagcctgctgaattctcgtgtctttttctgcattcagtcttgctgtatcacatgacctctgcaaaacaacactgtacgcttgtgagagaatgagagtgaaaaaaggcaaataatagatgagcattcttgtgaaagtagttctgacttaattgaccccatgaaagtgtcttgaccccctggaatccacagactgttggctgagaagtggaccattttctgaatattgataattagatcaagagactaggatacattgctttgccttaagcagacatatccctctaaaatattaattccccagaaaagcagaaactgaatttataaaatttccctttggcccgtaacgtaattttatttaggttctctttcctgtgacgttaaggttttttaaaaaaagttgttgatttgatgtttttacatctgattcaacaaattatctctacatttcttataaaaataaaagtgtgttcctacattaaacaaacaatctgtaattttacaggctttttttcttgataaaataaatttttcattcaaaatgtacaagtagaagtttcttctgttggttttctggccgggcgcagtggctcatgcctgtaatcccagccagcactttgggaggctgaggcgggtggattgtttgaggccaggagtttgagaccagcctgggtaacgtggcaaaaccctgtctctactaaaaatacaaaaattaacagggtgtggtggtgcatgactgtagtcccagctacccaggaggctgaggtaggagga

SEQ ID NO: 89298 - DNA, 1087 bp, Homo sapiens
ttgaatattgctgtctgttacaaagtcagttaaaggtacgttttaatatttaagttattctatcttggagataaaatctgtatgtgcaattcaccggtattaccagtttattatgtaaacaagagatttggcatgacatgttctgtatgtttcagggaaaaatgtctttaatgctttttcaagaactaacacagttattcctatactggattttaggtctctgaagaactgctggtgtttaggaataagaatgtgcatgaagcctaaaataccaagaaagcttatactgaatttaagcaaagaaataaaggagaaaagagaagaatctgagaattggggaggcatagattcttataaaaatcacaaaatttgttgtaaattagaggggagaaatttagaattaagtataaaaaggcagaattagtatagagtacattcattaaacatttttgtcaggattatttcccgtaaaaacgtagtgagcacttttcatatactaatttagttgtacatttaactttgtataatacagaaatctaaatatatttaatgaattcaagcaatatatcacttgaccaagaaattggaatttcaaaatgttcgtgcgggtatataccagatgagtacagtgagtagttttatgtatcaccagactgggttattgccaagttatatatcaccaaaagctgtatgactggatgttctggttacctggtttacaaaattatcagagtagtaaaactttgatatatatgaggatattaaaactacactaagtatcatttgattcgattcagaaagtactttgatatctctcagtgcttcagtgctatcattgtgagcaattgtcttttatatacggtactgtagccatactaggcctgtctgtggcattctctagatgtttcttttttacacaataaattccttatatcagcttgacgtcagatgtctggttttctttttaaaaaaaaattttttttaccattggaaccatttttaactgtagagttcagtagttttaagtatattcatgttgtgcaatgaatctccagaacttcttcatcctgcaacactgaaactctat

SEQ ID NO: 89299 - DNA, 1042 bp, Homo sapiens
ggaggccggggcaaggggatcacctgaggtcagaagttcaaaaccaccctggtcaacatggtgaaaccccgtctctactaaaagtaaaaaaattatccaggtgtggtggcatgcacttgtagtcctagctacccaggaggctgaggcacaggaatggcttgaacccaggaagcagaggttgcaatgagccaagatcggtgccactgcactccagcctgggtgacagagcaagatactgtctcaaaaaaaagaaaaaaaaaaaaagtttgtacatcaagttgaatgatgaagaataaaaaggaaaaacaatagtttctacagctgttagggtgatttactaacactgctttaaccctaggtcattcttaattttgttttcttttccccctctcaaaaacactggaaaattttcttaaatctgggaagtatcttggtatgtgtcttaaaaatgatttctcaatgactttttcctccttttttgttttctgttaaaggtgactttgctgttctactaaaggctggcatgaccgttaagcaggctgtcctttataatgcattgtcagccatgctggcgtatcttggaatggcaacaggaattttcattggtcattatgctgaaaatgtttctatgtggatatttgcacttactgctggcttattcatgtatgttgctctggttgatatggtaagtttttaagaagtcttattacattattgaccaacaataaaatagagaaaatattcggtaaagcctcattttttttctctctttttgggggagcaggaagtggaatcttgctatgtcgtccaggctggtctcaaattcctgagcccaaatgatccttccatctcagcctcctgagtagctaggactataggctcaataaaatatctttttttttggctgggcacggtggctcatgcctgttagtccaacattttgggagaccaaaccaggcagatcacgtgaggtcaggagttcgagaccaggctggccaacatggtgaaaccctgtctcaactaaaaactacaaaaaaattaa

SEQ ID NO: 89300 - DNA, 1050 bp, Homo sapiens
atgccaggacccaacacacacacacactaggcttcttacaatgctagtgtgatgacattggtatgggcttttcagttgggaaaataagcagtagaaactgtgcacattaagtctagtattcctgttatttgtggccatggtaattcgtcaagcattgaaaatgctcactatttatatattatgggggtcactgggaatgtatctgaagtacatgacatgcattaagttctagatagctagctgctcattggtcattttatttttaatgtcctaaacttcacctcatctctgaagtatctgaataattgcataactgaatgatttcaattttgaccttacctagccaactttctgactcggtgtgtgaaactgatgaatttataaataacaaattattttgccttcagtctcatgcaagtcaccaccatagtcatagccatgaagaaccagcaatggaaatgaaaagaggaccacttttcagtcatctgtcttctcaaaacatagaagaaagtgcctattttgattccacgtggaagggtctaacagctctaggaggcctgtatttcatgtttcttgttgaacatgtcctcacattgatcaaacaatttaaagataagaagaaaaaggtaagaaaaagtataccgagtacttactatgcttcagatatttatttatagtagtactctaactagattgttagaatagcatgcccaggttgtatgagctttatttgagagggagttcagtacccttgaagtactttttggtcccagagatatttatgaggagcatttctatatcttaatagctctgaagttttctgtctttgctattcttttgaaactcatgacaggataagaaaagcaaggatgaacatctgtataagtgaccagacaaggtaccagcagggccttgaagaccagaagcatcgtgtatacatggatacactatcaatatttattagtagttacgattaactaatgtcattaatttccagtcacccagtagctaaatgttctgttttcttttaaagggtatgtgacttttaca

SEQ ID NO: 89301 - DNA, 1118 bp, Homo sapiens
aggagcgagtccggcaggtccactggagactccgagcccaaaccccgctcccctgagccgacccgactcgcctcctaggtctggggcggcaactaacagcgcgcccggagcacgtccacaggttcaacccgaaaagcacaagggtcggccgtccagcgacctctcttaccagggggtcatagagcaccacggagcaggacgtgccaaaggccagaagtcctctgggcccagagctccagttcaggactccccgcacccggtttgggcagcaaaacacgtgagaagtctccagcacgggtgccaccatgtcgccaactggtcagccgcacaaacaagagacgcgcacttccgccctcggagcggaactactagggtggtttctcctgaggcatcacccagtccacgtttcgcagccagccgagggccagacggaggcagccccgcccccctgagactctccgttcccaccgcaggctggaacccctgtgcaaggccgccgctttgctagctctgctcttggaccgtggccccgctccgcgaacgagccaggcctttgtctcaagagcgaaatccgacccgagtggctcgggaccctcccgaaggacccggggctcatgtgcctggggcagcgtcagaaacatctcgctgccccttacgacccggctcccagcagcagccagggctggccccgggggcgctggctagcgagtagggcctcgaggaaatgacccccaactgcttacaatgcgctagggccgcgccacgcccccgcggcgtcggcgaacacacggaaaagcggatccgtctgcggagccgggttccggggtcgcactgcgcatgccctgcagtcctgggcgaagggggcggtggttccccgcggcgctgcgcgcggcggtaattagtgattgtcttccagcttcgcgaaggctaggggcgcggctgccgggtggctgcgcggcgctgcccccggaccgaggggcagccaacccaatgaaaccaccgcgtgttcgcgcctggtagagatttctcgaagacaccagtgggcccgttccgagccctctggaccgcccgtgtggaaccaaacctgcgcgcgtggccgggccgtgggacaacgaggc

SEQ ID NO: 89302 - DNA, 1061 bp, Homo sapiens
ggggcgtggcgcggccctagcgcattgtaagcagttgggggtcatttcctcgaggccctactcgctagccagcgcccccggggccagccctggctgctgctgggagccgggtcgtaaggggcagcgagatgtttctgacgctgccccaggcacatgagccccgggtccttcgggagggtcccgagccactcgggtcggatttcgctcttgagacaaaggcctggctcgttcgcggagcggggccacggtccaagagcagagctagcaaagcggcggccttgcacaggggttccagcctgcggtgggaacggagagtctcaggggggcggggctgcctccgtctggccctcggctggctgcgaaacgtggactgggtgatgcctcaggagaaaccaccctagtagttccgctccgagggcggaagtgcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctggtaagagaggtcgctggacggccgacccttgtgcttttcgggttgaacctgtggacgtgctccgggcgcgctgttagttgccgccccagacctaggaggcgagtcgggtcggctcaggggagcggggtttgggctcggagtctccagtggacctgccggactcgctcctcacccctcaccctttgccgtctcacgcgtggcgtcatcctagggtcattgctgcccatgagctgctagtaacctgttagtcccacgcagaaacccgaatgataagcatcttacctgaagccttccttgggaactgtagtaccgttaatcaatttgggttttaaaacaattgaaatttatatgtagattaaaaccatcatcccacaggtgcaatctcatttcagtatttccttcagttttggttaatgaacttttgttgtattgaatttcaaggaaatgttacctgtgtttta

SEQ ID NO: 89303 - DNA, 1034 bp, Homo sapiens
ttcccaatggctaagttggtctatacagttagtcttgcatctcaaaaggaggctcagtgtaaaaagtaaaatgttgaaaattcaaatacaacgcaggagatggctatatgtatttctgttcatacggctttattaatttggttaaaaatttcattattggccaggagcgtgtctcatgtctgtaatcccggcactttgggaggcagaggtgggagcatcgcttgagtccaggagttggagaccagtttaggcaacagagcgagaccccagtctctacaaaaagtttaaaaaaaaaaatagctggttgtggtggcgtgcgcctgtagtcccagctactcgggaggtagaggtgggaggatcgcttgagctcagaagtttgaggctgcagtggacgggggtcgcaccactggactccagcctgggcaacagagccagaccctatctcaaaaaaacattattctcacaccctttggagattcaaatatatatatgaaatatttgtaaccacattaccccatcttgagcttgcttgcctcttcctggtttttgtttcttgttatttgcattcttgaatggcaagagaaagtgcaaaaaacaagggtaaactttaaagggaccatgaggcaaggaccgactgtagaatgggagagaccacagcaggctctccatcatctcccacagcgtctcctcatccagcgccgtgagcgcggagccttgcggcattgcggcaccgttccgccatggctgggcactgggaggaccctaagaggggcggccataggggtggagttgtcagggaagcaggagcccgggagagccagggtgacacccttttaaaatcaactccgtcgtaaaattagcaaggcacactctttgccagtcaacccacggtcctgagatgtttacggcagaggaagcatcttggtaaagtctgcaaggacaaacttgccgctatatcacaggacaagatctgcttttaagatgattatactcatgctttgatgtacttaacacactgaaatgaaattctgatt

SEQ ID NO: 89304 - DNA, 1052 bp, Homo sapiens
aaatttctggacaagattatctccaggtctcttcatctctaagattctgactccagaattttcagttaaaatattagttgcctttagatggtgctcccaaaatcctatgatatttctttagttatcttaaatatatctactgtagttttgatatgggttctgaattagttttatttttcattacacactcatttgagggcattttgagccaggcacaaatgcaaaattttctgaattattaagactttgctatgattttataaatgatgtttaaaaaagttttaataagctacttatttgcttctgtaggattagtcacatgttaggtcaataaaaatcattaaatggtacaagggatgcctgttagtatggataataaaacataattgcaattatattaattgccaccagataacatcaaagactgactttcagtataggagtttgttataaaatgttaatttaggcttgtatgttttatcttccgtttaaaagtgaggttacataaaatggattgcttgtgtattactgtaatctataactattatgattgatttcctttcattgaactgccagataatgcagatagcctttccaaccctttatcggtgatatataaaattttaatatcattttgtatttttaatatgtctgaattttaacattacttttatgtatagacattcttaaaatcatatagttagttaagtggctcaattgctgtgacacatgaagttgaagcccatgatcacagttggctggcagcagagttaggacatgaacctgggccttctgagttcaaatctaatgctctttagtccagctgcttccctgaaacaaataaaaagaaaatccaaacccaaattaggttatttgccccttttttggtactactttttcttttgttatcactgagaagttgcaagtatttaaaagatctattttgaagtgtgtctctaatttcaacaataagtcatattcttggtagtagcacctgactacaatgtttcatataatgttcctgccaagagtgtttagcctgcatctaatca

SEQ ID NO: 89305 - DNA, 1068 bp, Homo sapiens
cctgggtttaagtgattttcctgcttcagcctcctgagtaactgggattataggcatatgccaccacgcccagataatttttgtatttttagtagagacaaggttttgtcatgttggccaggctggtctcaaattcctgacctcaggtgatctgcccacctcagcctcccaaaggataacgccctaggattacaggcatgagccaccacacccagccttttattttgttttaaacaaaataaaacataaggttttcaaacaaaacataaagtcctcaaattaacaaacatacccttaaatctgtgtgcattagccatgttggtagggctcatagtagctgttcattatttagttgtcttaacaacttttcatcttggtctttgggctgacatggtgaaaatgctctctagttgctcttgagcttatttttcacttctatcataaatgtcatagaatggagagaaggactggattctcatttaatagtcattatatttaccaagtaaccactgaatagaacgttttagagtgttcattgtattcctgcagacatttattgagcattttcaattattcgtgtagtggtgtgggaaattgaagtcaggattctttacttagagcttacaatccagtacagttgataaatcataacgtggtggaatagagaactcacagtgaagcctgttttttcttcccccagtaccaatattagcatgtggcaatgatgattgcagaattcacatatttgctcaacaaaatgatcaggtaataatgtttatattaagaggctggaattatattctgcttagttatatctcaatacagactatatccagattatagaattttagggaatgttctaatctaaaccaaaataatccaatagaatctttttttgacagtcctctgttaagatggttgtctactctgaacaccaagtaaccgctgccttgaccatcaggctcagagttgttagggggaaacaggtcattaggtgggggaggagagatggaagatgctgtggtagttgtttttctcttaaagatttaaacgagatataacatacct

SEQ ID NO: 89306 - DNA, 1568 bp, Homo sapiens
ccacaggcgtgtatcaccatgcctgactactttttaaattttttgtagacacagggtctcactttattgccccggctggtctcagtttcctggcctcaagtgatagtcccacctcctcagcctcgcaaggtattaggattataggtgtgagccactgcccaacccacctttttttctatattatatgtatagtatgtatcattttatatcttaaacatttaaaatatttgagattacaaatattatattatctactcagaggtgctccagttagtgatttagatattacgtgatgggtttttcattcccaaaggaatgctttttcttgtctaatcaaatagtgttctcagtaaaagagcaacgcagtaggactgtctgagaccaaatgatgtcactggtatacatgaagatgttaaattcttacatcaagcccaatgatttttatcttactagtttcagaaagtgctttctctctgtggacatgaggattggattagaggagtggaatgggcagcctttggtcagtatgaaattttgctaatgcacatacaatgggaacaaatatgtgttacttccaagaaagcagccttttttgttttaatttttaagttttctttgtatgttatgtttttctattgtcccaattagaaaggaggatgcttatctcttctgttgttagttggatggtagatgattaaataaattggtatttatcagatgacattagctgtcttgttcacatgcagaccttcttgaaaagttctttgtagaacttagtagactatatactacatgttgtaaacatgtattagcattgtatgcatatttgtcaatgttattaaaaatgaatatagatcaaatgaattggagggtaaggaaacaaagtattgttttttttctggaaaatctggaaatatatatattatagacaaaaaagtcttatacataaacttcacaatataatgttttaaaattaatacaacttattttttaattaggtagagatcttttcctagcaagctgttcacaagattgcctgataagaatatggaagctgtatataaagtcaacatctttagaaactcaggatgacgataacataagactgaaagaaaatacttttaccatagaaaatgaaagtgagtaataatgaaaatatccaatataacgatacttaggtctcctagttggttgatttttttttcaccacccacctatgtgaaggatagtttttcacaattgtcagattcctacctgaaatttcttttttctttctttttttttttgagacagagttttgcttcttcacctcggctggagtgcagtggcgtgagcttggctcactgcaacctccgtctcccaggttcaagtgattctcctgcctcaggttcaagtgattctcctgcctcagccttccaagtagctgggattacaggcacgcaccaccacgcctggctaacttttttgtatttttagtagaaatggggtttcaccatgttagccaggctggtctcgaactcctgacctcaggtgatctgcccgcctcggcctcccaaagtgctgggatt

SEQ ID NO: 89307 - DNA, 1028 bp, Homo sapiens
ggagtgcagtggcataatcacagctcactgcagccttgaactccttggctcaagtggcttagcttcctgagtagctaggactacgccatcacacccagctaatttttaaaattttctgtaaagatagggtcttgctatgttgtccaggctgtttttcaactactggcctcaaatgatccttccaccttggtatcctaaagtgttgggattacaggtgtgggccaccatgcttggcctgatactttgtattttcctatttttatgtgagaatgagtcatttttcatatgtgaaatatttttcttctaaaccatattagtaagatttttaaaattgctgaggataatgtttagtgcttctcattaaagtaatttgtaaaatattactaaatttgcagttttagcataggaagacctaaaggaataatgtgaattacttacacattttattggcctatgataaaagacaagctaaatctcaccatttgagtagtatatttaattctgattttcctattgtctagccttagaacagtatccctggatggtagatcctgttgggatgttgtatttgaaagagatatttttggatgtgacagttataaaggtagttcagtgaacattgttcacctaggtgtattctgttttttgttactattcttggtggtaaagtccatcagagttgagattttggtaacagttttatggggagaacgaaaaaatgatataaccagcatattaggagtagctatacccaaatatgaatttttttctattttcattatattgtttgaaaggtcaaaatactgatttcattatctttatttctgcatttatccttttaaaaaatgggatttgtatttgtccattcttacgcttctataaagaacttcccaagactgggtaatttgtaagagaaagaggtttagttgactcacagttctgcaaagctgaggaggcctcaggaaacttaaattaatagcagaaggggaagcagacaccttcttcacagggcatctcccaccagatcc

SEQ ID NO: 89308 - DNA, 1040 bp, Homo sapiens
tgaagctctagttatttgtttttattgcacggtagtagtctgttgtctgaatataccacaacccatttatctcttcttctaatggtagacatttgtggtgtttgcaattttttgctattacaaataatgtgcagtgaacatccttgcagtacccatgttgtttgttgtttttttctggtcatctacaaacatgatgattgttgatcacctaaagggattaggttttattttttagatggtgtcctacagcagccagtgagattattatctgcttccatggataaaaccatgattctctgggctccagatgaagagtcaggagtttggctagaacaggtaaaaatgttggatatttaaggaacagaaaattaagttttgaactctgtatttaaatcccaagtctatattgatagacctgcaaattttcactgtgtacattaaaatagtgggaatttaacagtctctggaatcagcgatttctgttgtgagaaacatagactattgattaagaattgttttctgtctgttattgtacaggttcgagtaggtgaagtaggtgggaatactttgggattttatgattgccagttcaatgaagatggctccatgatcattgctcatgctttccacggagcgttgcacctttggaaacagaatacagttaacccagtaagaaaagagtgtttaaataaagcatttctaatcaaatagagtacattctaggtaaatagtattttgcttataacactctacagaaacatagtagaggcacttgaagttcaagtgacataacttttttctgtagacattgttaaggtattgaaatttgcatgtaggtaaatttgctacgtaagtgcactgtattcctttaagctatagaattttttaatgataatttttctgaaatgtgtagctttcctgtcttcttaaaaagttaacataattggatatcttgttggactgctagatccctattattgaatgaatgtcagtcatttattgtgactgacgttcaacacctgggcatggtggctcttctc

SEQ ID NO: 89309 - DNA, 1439 bp, Homo sapiens
gagcagttttaggttaacagcaaaattgatctgaaggtacagagtttccacgtccctctacccccacacatcaacttgtagcctcccccactacattgttacagtcaaggacgattttttaaaagccaaacactgcccttcaggactgttactgtgggaaactgttagtccaaaagtgctgtccattgctcaaaactttttgtaaactcccattagtgctaactttagaatcagtttttgttcacagagggagtaacattttttgtcacaggcttttttttttttttttttggccagacataatatagtttagtcacagacttatccatcagattaggttttgaatgacctattagctatttatacacatttaattttcctctaaaggttaagttttagtcccacttgaggttgttcaaaaaggtgctctgtggaccaggcatatgacattttctatattttgttgtcattatttgtttatatggttgttgttgcaggcttcttagtaggtgaaccaactaggtttgattcagttgtctgtcctctacacctgtaactctttttacttaataaagccatcaggtccacatgcagaacccactgactcgttttacacaatatttttacattttatacaatttttatttagtttaataaatacatagaacctagtgtatactagaattgtcctgtgtactttacaaaagtaactcatttaatcctcataataaccctagaaggtaggtgctgttataactgttttattctataattgagacacagaaaggttaagtagtatctggctgctcaataaatgatgaatggagggaaatttcccacagttactgatttaaaggatacaacacatatttgaatgcttaagctcttacatgattgattggaaaatggatcctattattctgtgatccgatcttgtatacttagcttttcaccttgccagagggctttagtcttctctgttatcagacgtgagtgctttactttggtggtagtctttgagtattttgatatgtgatatgagcacttccattgcagagagagtggactccagagattgtcatttcaggacactttgatggtgtccaagacctagtctgggatccagaaggagaatttattatcactgttggtactgatcagacaactagactttttgctccatggaagagaaaagaccaatcacaggtaaaatgtcttatttatttatttattttttcttgggacagagtttcacatcacccaggctgaagtgcaatggcacgatctcagctcactgcagcctccgccacccaggttcaagcgattctcctgtctcagcctcccgagtagctgggattataggtgcccaccaccacacccatcttctttttgtatttttagtagagatggggtttcaccatgttggccagactggtctc

SEQ ID NO: 89310 - DNA, 1113 bp, Homo sapiens
tgactgtggggtgctgttggaggctcctacacaaagagtgatgaaaaggattttggaagagagttatctggaagccaagagactctgaaagcagtgaaactagcaccagtgtgagtaagactggagaagaaaatggaattcattagaaatgaagtagccaactaaatttcctggaatgtatactcagcacctcatgctacaggctttcttgattatgtgaagaggatttaagattctgttatgcttgtttctaataataatggacaataggaacaagatcaaaagggaagccttaattgtggttattatgtagagctaagcgtatggaggtggagggacagctagtttcaggatctcttcagttctaggaattgaaatggggttttacgattccatgagaggcttagtcccagttgtacacttagttctgtgtcctaagatacagggatcctgtagagtagcgagctgcttgctctcgtttgggttttgctcccatactaagtgttgggataggtatgtaggaatgcctcttactgttcttttccatgttagtttttctttgtttctgagataaagcatactgtttcttgtgtcccaggtagccatttttgatggttttaaattcttactattcatgtttgtgtctagtttcagcttctgtgttaaagtctaagttgtacagaacactcttagcaaatgagcatgtgccagttttgatggttagcatatattttcacatgtaataatttgattgatataaattgcaaaatctaagcagatattgccttttcaaatgacactcatacgaagttttaaaatactcagttagttaggtatgtttaatgaaaatactatgactaatgctgtaactgttcccttctgggaagcatctgtgtttatatgagcatcatcaggggatgtgcctgtgagattatcttggaagtagagctctgggccttccattttcagctcactgcatttcctgtcagaccctgaaacccattgaaatgttatggttcgatgaggtccctttatggatgagaggatgcccgactttatggattgcatgggagttggaggcctggtagggcttgtctgttggagagtgattgc

SEQ ID NO: 89311 - DNA, 1102 bp, Homo sapiens
aatgtgggtaacctgaagagttggttgtgtagttttaaaagtttggagactgttagatcaaagaaaatggaaagaacctttatggagttgattaatgctgccaggagcatgtttggaaaatactggagtaatggaaatactcttgcctttggaatcacatggacacagctgtgaattgcaccactttgaattaccactgctttctatgtggtggccttaatattgagacaagtgaaggagatataaaaatagtgactatattcttgatgtgtttcttcaaactaggagatatagcttctcagccttctgatgaagaggagctgttaactagtactggttttgagtatcagcaggtggcctttcagccctccatacttactggtaagatgtgacaaagacaatttaataaatcgctagaacacacagtatgttatctattgctgctgacctaaataagtgctatagaattcacttttacatagaaaaaaatagcttcaatttattctagagcctcccactgaggatcatcttctgcagaatactttgtggcctgaagttcaaaaactgtaagttaaactgtatttagctctttggtctgattctgtcgtaacttctgacttttcctccccaccccacaatctgatgtctcctttttcttccttctacctacctttttcctcctcttctatatatctcttagtggctcttcataaggaatgagaattaaaccttaacgtttatttttatattactgtttattatgttcattagttttgtttattcatcttatttttaaagtagagaagcataacaatatatattttttctttattaagaagacttggctgggtacagtggctcacacctgtaatcatagcactttgggaggccgtagcaggaggatcacttgaggccaggagtttgagaccagccttgacaacatagcgagaccccatctctacaaaaaattttaaaaaattagccaggcatgatgatgcatgcctgtagtcccaagctacttgagagactgaggctggaggattgcttctgcccaggaattggaggctgcagtgagccatgattgcaccactgcaccccagcc

SEQ ID NO: 89312 - DNA, 1048 bp, Homo sapiens
attgagtattttgacatatgaatgcaatatgcctgtcattcattcaggtctttaatttctctcaggattgatctttttaaaagtaaaccctttattttgggataattttcatttttttcccccttcatgtcacagtttttcattttatttttccccctccatgtcacagttttgatcatggaataatttttcaagatctgagagctacagtgaaaaggaaaaaaagaaagaaagaaaacatgatactatagtccctgatgattgattttttttaatcccaatcatctgtaattcttcccagagataagaaatggttgtagtatgttatctcctaggaattttttttggaattcaaacagataaataaaatatactcatagaaacaatgtgttgtttttaaaatgttttctcttcagtttatttttacttactagcttcattgtttcatctctgtcctataggcagctaagaaagagcatgcagctatcattctttggaacactacatcttggaaacaggtgcagaatttagttttccacagtttgacagtcacgcagatggccttctcacctaatgagaagttcttactagctgtttccagagatcgaacctggtcattgtggaaaaagcaggatacaatctcacctgagttcggtaaaacagcttctgattgggaaagttattagtgaaacagttatgttcattttatctacattaagcagctttagttaagagaaagataacagagtgaagggtagagcctcatgtctttgaagcctttcaaagttcttggataactgaggaagacttgaccttccttgtaagatttaaatggagatgatctttatttgggttgacctacttgtgattatgtagtcaagatggcatgcattcagatatctcagttcaagaaacataaacatctgtatgtaggaagttaggttttgcaaatggtgatagaatgctaccacaaagcctaatggataacttatcctaagctaggattttatgggacaggaataatgaagatacaactaagaaaactcat

SEQ ID NO: 89313 - DNA, 1177 bp, Homo sapiens
aaaaaaattgtattaataacatatttattaatttgttatatctttatggattatggagtaataatagatacgctcttattccctcctcataaacagttatgtggtttttgttttttagggttttttttttttttttttttttttttttcagacggagtttccctcttgttccccaggctggagtgcagtggtatgatctcagctcactgcagcctccgcctcctgggttcaagtgattctcctgcctcagcctcctgagtagctgggattaaaggcacctgctaccacacctggctaattttttgtatttttagtagagacggggtttcatcatgttgggcaggctggtcttgaactcctgacctcaggtgatccacccgcctctgcctcccaaaagtgtggggattacaggcgtgagccaccatgccttgccaacagttaggtgtgttaggtttagtccatataagggctagaacttcccttacacttaaatcttaaaaggaaaatattttcttaagatttctttttttaaacattaagtggtgcattaatcttttttctatagcctaatatgcaaatctgcctactttgagtaaggctaaatagcttcaggcttcttctgtaggcgtgagttgaacttcagttgagtgtttggaagatgtttgtcatcagtcactagagagtgaccagtcagtacaaaagcattccctactagaaaaatagctgtgtccacagccttctggtgaggggttggttgcctggcttcagtctatttcaaaagtcagtgcatataaattgaatattaagtcatatggtgtatatggcacttaaacatcacttcctaacaggtaaaaacccagctttctctgctttgtgaatagtgtatacatatttctttcagagccagtttttagtctttttgccttcaccaacaaaattacttctgtgcacagtagaattatttggtcttgtgattggagtcctgacagcaagtatttcttcactgggagtcgagacaaaaaggtaattatttaaaaatttaatattttttcaaatgtaaaaataatatttttataggtatgtttgaataaaaaatgcataatcctgcctttctgttacagcttttaaaaatcagctatgtattcctttctgtttttcgtatatgtacatataaaaa

SEQ ID NO: 89314 - DNA, 2295 bp, Homo sapiens
aggttttcctcatagctgagtagattccctgagcaatggacagtgtagaggaagagctagaaagctgataagttctttttttttttttttgagacggagtttcactcttgttgctcaggctggagtgcagtggcacgatctcggctcactgcaacctctgcctgctaggttcaagcgattctcctgccttagcctccctagcagctgggattacaggcacccgccaccacgcccagcttattttttgtatttttagtagagacggggtttcactatgttggccaggctggtcttgaactcctgacctcaggtgatccacccacctcggcctcccagaatgctgggattacaggcatgagccaccgcgcccagcccaaaagctgattagttcttaagcattttgtggtagcttcttggggaagtgcatgagcctactgatgggactccactggatcagaaccaatttgtgagtatagaaggcatgttagacacctctctgtggtctctgggcaggaacgctttgtctttggaccaaggtgagctctcggagacgcatgtctgctgtaccgtgccttctttctgatgcttgaaatgctctcaagtcctggcacaccatacacgaatgtaatgatgcattttttaaaataccagagcaaatactttgttttatctttgccgatgaaactgtagtacatggctagaaaccttgcaaagagaaggctttacagtgtgtgatctgtctgtattaggtggttgtctggggtgagtgcgactccactgatgactgtattgagcacaacattggcccctgctcctcagtcctggacgtgggtggggctgtgacagctgtcagcgtctgcccagtgctccacccttctcaacggtcagtctctgtgtggggcttagttttaagaggaccacttggtttcttaatatgtagccctcatgtcatttcatttgtgaattctcctagcctctgagttactgtcttttttttctttttttttttttgttttgagatggagtctcactctgtcgcccaggctggaatgcagtggcgtgatctctgctcactgcaacctctgccttctgagtttaagcgattctcctgcctcagcctcccaagtaggtgggattacaggcatgcgccgtcacgcctggctcctttttttatatttttaatagagatggggtttcaccatgttggtcaggcaggtcttaatctcctgacctcaagtgatccatctgcctcgtcctcccaaagtgctgggattacaggcgtatgccaccgtgcctggcctgagttactgtcttttgcaaaatgcttatgtttctcataataatttttaaattgatagaacctaatgattcagaatgtaaaatacaggttaggaatggggctcaaagattcttacttcaccaaatctaggactataatactttctctgtaacaagcatcttcagtggaacaagggtccctacagccagctggggaaacactggctcatgggccttgccagcagaggacacagataaatctgtgtgcagcccctgtaaagaggaggctccttgaggacacaggagagcagtgcagcatgtcctgggctgatgcctgcagagtcttttgtaaggcagggacagttgggacactgtgaagaactactttagagcaatgacgaagataacaatttcatgctaagttaatcactgttgtccccctcccttaaaaacagatacgtggttgcagtaggattggagtgtggaaagatttgcttatatacctggaaaaagactgatcaagttccagaaataaatgactggacccactgtgtagaaacaagtcaaaggtatttctttcctatttttgtttccatcagattaactagaaattgtggggtctttcatggcaaattttatgccacattttcatggagagggacatatatctgtattcgtcgtgtctaccactttgttttgtggtaatctgaaattgatacatgtggtaatctgaaattgatatattgcacttgatttttaaaagtttgcttgaccaaattgcttgcatgcataatattatttttataaacaaccatttgagatgaaagtgatttccataatggtgtgttgtagaatttgactacagtagattcttaatttgattcaaaatgtttgtgatttttaaaaatattctggattgcactttggtagtcgtatccttatgattgagccctttacctcaaaagatcctatagtggagctttcaggcatagcaaggctcatgccctgggcctcatg

SEQ ID NO: 89315 - DNA, 1555 bp, Homo sapiens
tagtaatgttatctaaaagactaacttgaatatccatttcatgaaattccattgatcattaaaacaacattcatttaaaaaaattttattttttgtttttttttaaacaacatttgacagagattcattgtctgtgtcttgctcattttggtgatgttattgccagtgagtaagattaaaatttagtcttgcagttttaagtaaatatagtaaaatattttccaggttaaaataaaatggctaaaatgttaatgatgcgattttaaaacctgtacatttcaattttcaggttttaacttccattcatgtttacaccattaattggaaaaacatttcatgatttctctatctttgttttagccaaagtcatacactggctatcagaaaattatgctggaagaattgcagtggaaaaactgaacagaaggaagcagaaggtgctgagtggttacactttgcaagctgtggtgaagatcacactgtgaagatacacagagtcaataaatgtgcactgtaatggacttaataactacatgcttgcagtcactggtatcttaaaatattatcatgtaaacaggtcatctttaccttcataactgaattgagtttctgggttttttttttttttgagatggagtcttgctttgtcacaacctccacctcccaggttcaagcgattctctttcttcagcctcctgagtagctgggactagaggcacaccaccaattccggctaatttttgtatttttagtagagactgggtttcaccgttggccaggcgggtctcaaactcctcgtctcaggtgatctgcttgcctcggcctcccaaagtgctgggattacaggcgtgagccactgcgcccagcctgagtttcattttttaagtcacatagcagtagtccttatttcagtgctagaccctttgaaatgcgatgaaagctatatggacccttcgctttgttatataacatatgcacacatacccagaattttgcacatatgttcagagattcctagacctgcagacctgcctctgtgtgtcccaatttaagaacctctgttctttcttcatgactggatttgcccaattttgtgttattttgggacttaatttgtccctctttgggacatttccttatttattgccctcttcagagagtagatgtagaaaataaagagaggaaacctagattacttaattttattttaacattttctatagatagcataccacgccaagtgtgctctgtcttgatccccttctttctagcatctgccagacattgtagagtttcgcaagcagttgtaggtttgagctgcagccagtcatttcttttattctttaaaagtacatagatttgtctttttagggctttactgaaagtaaaatatcctgacatttaaactgacagatgtaggaggtaaaaaatagagttctgaaacatttgaatttatgtgacagctgaagtcacgagatgagggatatatgtcccccagggaggatgcagaaagaagaaaagggtactggaaacagcatgtcagtggtgccagctg

SEQ ID NO: 89316 - DNA, 1049 bp, Homo sapiens
agacccctgcagtatatttagatgtctggcattgtttttcccatctacagcagagtgagcaaccgactttattgatgagggttctgtaaagcagaagtcagggcatttatgtgcctgggtatacattcatattgttaagatgatactaatttccatcagagaatcttaaaattggatgatccaccttgatagaaacagctggagtttcaagcacttggcatgtagtgtatgccccacccaggctctgaatgcatggtttcctttcatactacacagctccataaggtaggggctttgattgtccctattttagagatgaggaaagtgagggagagtgactaaatgacccactttttgtgctagaagtggggaactgagattcaaaccagccctgtgtgactcagggcgtcggtgctgttctgttctgggaaccaggtatatggctgtggacagaagccatgcctcccgggcttctcttccattaactggaggggttcacccggtcaccttcaagggccaagcacttttaggcctggggacaggtgaatgttataaatgagtaaaagccttgaggcagaattcctggcctgacacagagtgcatagtcagaagtggtaacatatagttatcaactctgctgtgaattagctattgaggggtctgttgacctgggtgagctatcataccaggaccctgccaccagtgaggctttttgggccacagggcgtgcttcttccgggtcccacagagcctggtattgacaagaagtggagttctgtgcagcgagcgcattctcagtggtacaaagaggggagaagcatgagcgtgggacaggcagacactcagagtgctctcagctctcctgcacattcaagcccctgagggagtcaactttttttttttctctttcttttttgtgacagggtctcactcttgtcacctaggctggagtgcagtggtgtgatcatggctcactgtaaccttgacctccctgggctcaggtgatccctcccacctcagcctcctgtgttgctgggactataggcatg

SEQ ID NO: 89317 - DNA, 1985 bp, Homo sapiens
agatcaggatcatgggattgaacccttcatgggtcagttggctttgtttcatgcatggccacagaccatatcggtaacctagccagacatccagcaggtgctgtcatggcctcttgcaacgatctgggttggaatagactggcatcaatctttgggaaggaaggggctgctatgtcatgaacttatgctggaggctgcactgtaggtctccatgtatagctttatttatcctcacaacaactctagcaggcaggcagatgaggaatccccaattaacagatggggaaactgaggcacaggaggttaagcaggttgcctagggctatactgcgtttaagtgaaggagctaagatttaaggtcatctttttttttcctccaaatcctattgttaactctgtcccattattagaaaatcagcaaagcccatgctctctgtgcagatgggggtggggtagggttgactgcattgcctttgcatgcggctgcctgtcacagtgctgtgatttaagtggttgtgctctggcaagtcctcccagggttgatgctctgtgtctatgcgttttgtcctcggactccaacctgagtccctctggaaaacaacaggactgccattgccctcccactctggactctgaaatgttagttcttaatagtgtcgactttaaaacagattaacatgctgaggccaactcaggaacagccctcccccaccctccttttctctccatattttatctctctctgacgatgatacttttgaacacttgggaacttttctgtcttcagaggacagcaatcacctgctccaggcaacctccacacctcatctctcaataacactgctgttgcctgtggctggcttagaggcatagctgggtcctcctctgctggccattttcagagtcttgggtttgtcagcatctgctccattagagagacaatcagaagatttttgggggtgaagggggagctgggggactgtttctgagctttgttctgaactaagttagaaagaatggggaaaattaagttacagtgaatgttaagctttgccaatcagcgcaatccagattgtgagaaattacagtttctccaacaaataaattgcaaaagaaagaaaaaggtggaaggaaaccttagatgaaaagagattaaagagatacatcaaccaaaggtaatatgtggctgtgattgaatgctgattcaaatacattataaaataaatatttgagatcacttgaacatgtgagcagtgatgtttaatattaaaattattaactttaaagtgtgataatagtattgtggttaggtttaagtaacagtttatggctttcagagatacatactgaaattatatgatgtctagaatttgcttcagaataattccagataagagacaagtaggtgagtcaatatatggatggaacaggatagactgtgagttaaagttggattataggtatgtggggagggctcatgatactactttctatacttgtgcatatactgaaatattttaataaaagagctaaaaaaattaggttacaattccaatagtccccttgggatcagagctctttcattaagtgttactgtatgatctgagtgtgttttctatggctgagatagctaaccatcagtggattttttttttcatacctccaatgatacttttcttcccaccctgattgttgtgttctccttagaatcttagaaaaacaagtgtagggcatctgtctttttatgttcagggtgtctttctaggctcaatcaattcccatgatgaagtaaacaattgtcagttacataaactattagcttagtaagcgaaatgctaaggtagagatattatacctgtggtttcagtatatgctcctaaatttttattactaaactgtgaagttgctaaggctataataagtgataacaatatataaaggcactcagtttcctaaggctgttgatgcccatgacatgcctgcat

SEQ ID NO: 89318 - DNA, 1117 bp, Homo sapiens
gggtttcaccatgttggccagggtggtctcgaattcctgacctcgtaatctgcccgcgtcagcctcccaaagtgctgggattacaggcatgagccactgcgcctggcctgagctttattttttagaagtccatttttccctaatttgtatttggagcgatggtcctcatatctccacagatggggatggacatggcccttgaaaattaattggttgtgcccaagaggatggaaatagggtggataagccacaagaaccatgaccccagggtttggtcatggagtgatctgtgacctacaacctgcagatagtgtctacgggggctgctggaagtgccacacctgttaccttcccctgtggtggcagaagtaaagagctgttttatgcccatgagaaagctgtgtaatgtggactgtttttattactcagatcagtatgtgtttattgatgtgcatgtgtcttgtactctaaagtatcttcacactgtagttccatgcagctgtccacttaaactgtgtgtgtgggtggacacaggatgactttgctggagagaggttactactgacaaagctagactcagggaaggaaagactaacaaacaaggatttctcccttatacaacaaagcatctgttcctgtcacagaatgaacacatggatacatttggagactacagaaaagcactttgaagaaatacaaatcacttttctcatcacccaaagggaaccactcttaacacttttgtgtcttgccagaattttaacatctattcataataatatctgaatactttcccaagtcattaaatattcttggagcacatcatctttaatgacagttaggtaatccagtctatgtatgtaccatgatccatgtaaccattgttcccaggttccatgagggaaagtgctctttcttcttgaatgttaaatttgtccatgcttggtacttaatacatatttgtaaaatgaatgcatgaatgattgaactattggaggtttaggtagttgccaataaggaaaatacagatagtgctataatacatacctgcagaaaaataaatattttttctcatatttgattacttccttaagacgaattctcaatgtttagttgc

SEQ ID NO: 89319 - DNA, 1056 bp, Homo sapiens
ctttctcggagagccattgctctcattaaaaaaaaaaaaaagttccttgacccacctggtccctaaagcagaacgtaccagctccattaaattaacatatgtagttctgcaaagtctaaacagtttaaatttcattattctaggcagtatttgtcaggttgccaaagcaggggaaatctgtgaggggacaaggagaagtttagccccatgcatgcccaggatggtactttgcttctgcctcctggggtgtgtaggggagaaaactggagctcctctagagggtctaccacatttcaccagcatttgttcaccagcaaaaagggcattgcccaaattctactgcatgagtcactggggtttaaaatccttcagatggatagcgaggtcacctcttgtccttttgagctgtctatatatattccaaaatatatcttggtcattttgattggtcattattgattgaagggcctttggtgttattaatgttttagtagtttccgatcagtttatttagggctcagagtaatctgtaacttgaggatggacccgataaggcaaactgtaagagcccaccccagcgcctgctgttctgcagctctgttccttttaggggtgggcttcattttttttttctttatattatactttaagttctggggtacatgtgcacaatgtgcaggtttgttacataggtatacatgtgccatgttggtttgctgcacccatcaactcatcatttacattaggtatttctcctaatgctatccctcccacagcccccccaccccctgacaggccccagtgtgtgatgttcccctccctgtgtccatgtgtactcattgttcagctcccacttatgagtgagaacatgcagtgtttggttttctgtccttgtgatagtttgctgagaatgatggtttccagcttcatccatgtccctgcaaaggacatgaactcatccttttttatggctgcatagtattccattgtgtatatgtgccacattttctttatctagtctattattgatggacatttgggttggttccaagtctt

SEQ ID NO: 89320 - DNA, 1053 bp, Homo sapiens
agaatgcagtgattgatgagtcaggtctaccagggaaggtgtggggccaagtgttggccattgtgaactgactgacagctgtccctactgagtttaggagggcttagcataccccctgtacacccaggagggaatcatgttgtgtgaattacacacctagcttgaaattaaccaacttaaccagacctattagtttttctaaaatggagtagggcaaaagtcacaggttttctcctcattctttggcagtgacccctaacattacgtctatgtcttacatcatggagtgaataacatgtaagcttcttgacatgtgaaaacaaagcatctgagagaaaagatacccaaagtagcaggagatttcaccaaaaggaaataacatttgtgaaagcattctgagcactgtcgagtgctctataaatataaggacttattgtgcattgcctgaggagaaccagctcagccataatgctcacagttacaggagagacttgccttgttacttttccttcctacagttaagtttcttctcttggaatgtgaagagagcctctggggatgggctttgccggaatgggtagctccttgctgcaggctgaaggcaggggactgtggcgtgcagggctgaccatccgtcattttgctggctggtgtatccaggagggatcaagcctgtgaaaagctggctgctgccaccagaggtaggcagggtgacttggcttcatgcagggaggccaagatagtcactttcctgctgtgcagcctgctgtttatgggcacggtcttttcccaggaggaagaacttcttgggaaaccacatcagggttagggggtcttggtgaatgcagcatcagagctggaatctttttctgatgagtgagtgagtgagtgagtgagtgagtgagcaagcatggcatcagatcagtggaaggcacatggacctctgtggcccagagtgagcatgctcatttgggagctggcctgccctgcccctgcctttagatgagacattccttgctgctccccaggcgctctcctgccattcctgttctg

SEQ ID NO: 89321 - DNA, 1058 bp, Homo sapiens
tggcttagggcccagaggatgctgtcgatgtcactctgttaagagatgcctcatccatccacttggtacacagattgttcccgatctatttgcactaacatactagctcttcaagttatgatccacatttcagaacattgcttgattttacaaaacacaggagggcaacatgatgtgatttctccatatgtagtctccatctgaggagcaggttgggtataacaggctctttctcttgcagctggatgactgtactctgcagctctctcacaatggcgcctacctggatttggaggccaccctggcagagcagcgggatgagttggaaggcttccaggatgacgccgggtaagagcaactgttcaccctgctgactggtccccacctaccaggaaatgggggtacattgaggccttaaagtatttaggaggaactaccatggctttgaccttctcttaattctcaatcacacacgagggagatgcaagtgactcatcagtggtgactgcagacccgtttccattttgagtaacttttcttgatgggtgctcgggagtagcctttcctaggaacatttgtggtaatcaagcacatggtatttatatgctaagttattttaaaatcatatgtcacaattaaatcgatattttccagccagctgtggtggctcacacctgtagtcccagctactcgggaggctgaggtgggaggatcgcttgagtctgggaggccgaggctgcagtaagtcatgattgtgccactgcactccagcttggataaaagggcaagaccttgtctctaaaagtgaataaataaatggatattttccagattttagtggatttgcaactattttagatattgtattcaatgataatttactggatagtttcttagcagatgctatagtagatagttttatacggtatcatcttttaaactcattactgtggaaaaaataattattaattatgttaatgtcaacttactttttgcctatacctagaattgcttaatacttttgctgaataaagaaatactgtgagtctgaataaagt

SEQ ID NO: 89322 - DNA, 1147 bp, Homo sapiens
ttggacttcataaaaattaaagccttttgcatccccaaaagacataattggtaaagtgaaaacacaagccacagaatgggagaaaatgtttgtaaatcatatatctgatatctgatgacctggaagacaggccatgtgaaagaagccagacacaaaaggtgaagtactgtttaatttcatttgtatgagatggccagaaaagacacatctctagagggacagagtagattggtggttgcctcttgctgagtgtggggacacagagcgattgcagatgggtatgaaggtttgggggtgtttttgcattgatgaaaaagttaaaaaagttagattgtaatgactgtataactctatgaagatactaataatcagtggattatatccataaaacaggtgggttttatggtacctaaattatacctcattaaagcttacaaaaaacgtgtaagggaatgactatggaagagagacactgagctggtgacggccgggctaggtgtggggagaaattccagcttctgtgatgagaggacactagctgagcggaagttgactgagaaagttcattccgtctgcctcatgtcttgttgaagtgagggtgaaggaaactggaagatgagagaaccagactggcctctctgagaaggtatctagagagttgacctgttttggtaggtcccttttccccaagtgcacaaacttcacactttggttgtagcacatgttgcccagggtgcttccacctgggtcccctgtgtgtctcggactcctcacaccttccagttaaagtagatgactcattcctcagaggctgacgcacttagagttgcacacacaggaggcacagacattagtatagtcccttgagaaaattaaaatgctacatcatgggaactttaatgaagaacaggaaaaagcatcaaatagtaacaaatggattattattgtcgattcttgaatgggcagtgaagagagaacgagaaaaaggtatgatgaggagagaggtgggaggaatgagaagaggcagacaaaaatgaagcaagagacatacagaaagtgagaatattcagacattaagacaaatggaacgagggagagaaagtggctgaaagaacagtaatatcaacaagggtattacctaacatta

SEQ ID NO: 89323 - DNA, 2751 bp, Homo sapiens
ctctgtggatggaatgaatcgatggagcttggcagtgagatgcatgtgccaaaccaacaaagtcagacttctttattttatttttgtgaaagtcctgtgatgtcaacattatttcaggatagattcttattcagtgtgggtctctgcttctctggatccccacttaagtgggtatgtcagaaccttcacgtggattgacagcatgtgaggtgtctctgctgactcctctgatgcccctgttttgtctcctgtctcgttaggcggggcaagaagcacagcatcatcctaaggacgcagctgtctgtgagggtccatgcctgcatcggtgagtgacacctgccctcaggaactaaacatatgatgaaagacgcgacttatgggaataaaataaagattcactgttatgctgtctgtttgcactagcccctatcatgagttcttagagttttagtgaaacaatttccagcaatgatttttgaaggcctgtttcattccagcttcctctgctgtttggttagtgactggagcgtgaggtaagacagcttgctggtgaggtgccttttggcagtgctggggtagatgaggttcttctggggactgtgccattgtgagcctctagcacattgacctgatcttcacgtgcctcctggtggctctgtgaggcatgcctgtgggcaagtggagtctggggctccaggttgttatcaggtgactaaaaggaaaatcttgggtcagtgcaggatgagggtacgtgtggatacagggcaagatgctcttaagcaagcaaacatatttgtggttcagaatggcttgctgcgggaagcccagtttcctcctggtaatgggccaagttgcggcaagaatataatgtcataagaaggaaaaaaaaggaactaaatttcactttatgcctagaagtttttagtatctgagtaattttgcttttgtttaatgtatggtgtggtcttcatttaatcctctaatcaaaagagcgtagatcatcctgttgagtcctagtctatacccgaaaacatattcatgggtggagtgaaggaaattatttctggtccttccttcactctgcttccctattggagacccagggatggggagacccagggctggagatggagggaaatccatgtgatttcacttcatttggtgtggagggtggtgaggttgcaagtgtcttgagtaacaacctttgcctcactctgcagctaaagaataattgttcaggtgactcaaacttcagggactgaaaggtcagggtgtcaggaggattggtaatcttgttggaaacaaagtaagatctgtaggacctccagccaatattgactattctgcttctcaactgcttgtagcactgagtaactgtacaatgtatatgggcacttatattaaatcgtggcttttttattacctgcttcgtgttttcccagtgatttcatatgtataaatcatgtctctctaaaggaaaggtctgtgacacgactttggataaacttcccccttaccctcatcccagatctagaacaaatccaggcacgtaacatgtactgaacagtgttgaagttaaatgttgaaacacagttgataactacaagaaatttgggacatgaatatgaattgttttttcccaggaatagtaaggtggcagaaagcagacttgcatgaaaatgagctcaatccaaatccaaatgagctaactccttttaaggaaactcactcctttgcagtatgtagtcaaatatttcaggtacaggattttttaaaaacaacttctgtgttattgacttgtcttatgaacttctgtatcctatcgtcccatgtgatagatgtaagatgtgtgacatcttatcctgtggcatgctgagcaccgacagcctctgaagcccacactcaaccaggacacacatgctccctgctcttggggttgacctggggtttatggagtcagtgtgcttgctcacaaacctctttatgccaattgcactggttatcagaattatgtaatttaatgaaatagtaccaaatatttcataaactaattaaatatgactacataaaggtcactgcttctttgaaagttcactattttggaaaagactcaaaattagtcactacagaagcatttctgtcaatgtaaatgtgttatgataactataaaaggcgagggggaatattataaaatctaagaggattctactcttcataagcatcttcagctccgctggacttcaaagaaactagactggaaatcagaccttgttattggagtgagttgtaaaagaaagtctacatggaattccaatgggtagatccttattcagagaactatttgtgcctcatcacaggtagaccggcatgttttgccacaatagctgcgagttcaaaatgttgtaaggtcttgtttatgtttatgtatttttttatgtattgttttcaaaaggattttctgctttaatcagcttttaccattaattgccttaggcctgattatgtcagatgagaggatttggccgtataaactaacagcaacacctaaaaaaggaaaagtttttcctttgtattaaaagccttttttaaaattccatttcctactattagcaagatctggaataggtttattagcactaaatattatactttggttatgtatagaaaatggaatgtgtgcaatcatgttgatgaagtaccttcccctattgtgacatattctttccctttccaaatggcagtgttagatga

SEQ ID NO: 89324 - DNA, 1048 bp, Homo sapiens
agatgcatctaattactcagatggtcaagtcacagggacaaaggcaacttttaaaggcaagaaaatgatatgagagaaggccactccattaatgccagtttccagcaacagaaacatcaacagcaaaagccatcaatgtataatttgcaaggcatttttctcttgcaggccctatcatgcagccgtgtgctttgcactacattgttatagcaaagagatgaattataaacagtgcaacatttcctcaagaagaacctcctagtgcaagagtaacaaaggggattcatctcacagccagccgatttaggagcattggctccctggggcgctgtgttgagcaaggtcctgaggctgtgtgcagtcttaatgggaaaggatcctgcatcggtaccctcttacactggtggtgatggaggtggtgtacatatgtgtgccatgaggtggcagctcaggtgaggtgcaggttttgtccagtgcttgagcctcctgtagctacagtataggggtccctgggcttctgtattcgaagggtggggaatggcactgtaattcatgacccccaaccactgtcccctctcctttcttcccagaccctttccaggttctgcccttcttcttcagcctgtgaatctgagcatgacttctctcccacttcactgtgttttctgaccagaccgagtaccaccttcctccacctctgggtgtctttccctctaatcaatttgagctggtttctcatggctgagccctcctggcttgcagggaggcccccctctagcttccttttctgacatttcacttgcccctagggtggcctttggaaaattagctggattcccatgtggtccttactgcttcttggctctgtgtcagtttggaatttccataaaaactagaggtttcctatgggaagcagcaaattgtctttttgacactcttgttctgacagcacctgagtgctgtttctgtgctagctagtaaagatgaggcccatggagcactgtgtgctgagagacatgaggcctgaatggtgatgcgtgtgtgctcg

SEQ ID NO: 89325 - DNA, 1071 bp, Homo sapiens
ggatgcctgtagcatgtgttaccagataagtttaaatcacgtgctggcagttagactcctaagttcctatccagcaaaacatcagttatatgcagaaaacaacttctgatagggaaaccaccctggttttgactagagtgtctgcataaatactttcctttcacaagtctggcctgcttctggggtgtgatgtgagctctagtgaccagctctgagtgcctttggctgtccccatgaagagacaactttatttttggcactggacaatcaaaatttatgtcaggaaacaaaatgctttgtcttatttatagaaattttggtatccagagggtgtgggagttgaaaaggaggatggatggttcaaaaatgtcttgctgaagaaagttctttgaggagtgggtgcatgtcaatgtatttttcacatctcaacatttctgttgtattagaaatacctaatgggaagcattttaactcagaaaaaaaacatatagaaagcattcataattcagcgaaactgctaccagttcaagatttattttaaaggaggaaagaaaggcattggagaattgttacaagtgctgtcatctcaagcccatatactggagtaatagcaacagaataagaagaaaagttaaaaggttctgctcattattttaggataattgaaaaaaaggaaacagattctattaattgttcacagaagtaacatgacttatctgtaatcccagtaactggattatgggcatgtgggcaggaagaggcactatcttgctaggatgtagagagatcattggggcaagggatagagccacgttactggtcaatacttcggtcatctcccttcctccctccctccctccctcactcccttcctcccttcattcccctccctcccttccctctcttccctccctgcctcctttcctctctccctttttccctttctctctctttcttttgttttcttttcttttcttttcttttcttttcctttcctttcctttcctttcctttcctttcctttcctttcctttcctttcctttcctttctctgtatctctttctttcttt

SEQ ID NO: 89326 - DNA, 1834 bp, Homo sapiens
gattcaaatagggttgggagcttgcccagggacacagagctaaacagcagagctcagattaacgtccccatctgtctaattgttaaatggaaaagttctgttttattatgatgggcaatgtacttttaaaaatagtttctttttataaaagcagaaagggaaatttctactaaccacttaatgcttatacttcctaccaggcactgggcaaagcactcgacaagtgtatctcctttaatccaaacagtaacctatgaatcagaattactgttcccacttaatagaggagaaaactgaggcacgcagtggtctaatcacttggccaaggtcccatgaggagcatatgactgagttgagatttgcacccatatctgtttgcctgactgcagggtgttgtgttcaacctctgtgctctggtacctccaataacactagctgctctggagcacttactgtgctccaggtatctgaacccttgatgctatagcacaggtctgggctgatgagagaactcaggctctagaatcagacctgcccctgagaagcagtgtgaccttggaaaagtgacctcactgctctgacttcagtgtcctcatttatcaaaaggggatgataatatcgcctttaaaaattgtgaggattaggccgagtgtggtggctcacacctgtaaccccagcactttgggaggtcaggagatcaagaccatcctggctaacatggtgaaaacccatctctactaaaaatagaaaaaattagccgggcgtggtggtgggcgcctgtagtcctagctacttgggaggctgaggcaggagaatggtgtgaacccaggaggcggagattccagtgagctgagatcgcactactaaactccagcctgggcgacagagtgagactctgtctcaaaaaaacaaaaaaacaaacacaaaaaacacctcacacaaaattagtggagcatggtggtagatgcctataatcccagctacttgggaggccaaagaaagagaatcacttgaaccaggaggcagaggttgcagtgagttgatatcatgccattgcactccagcctaggcaacaagagcaaaactgcatctcaaaaaaaaaaaaaaaggattaaagaaatatttcattggtgttagatccaatttttaaaaataaagtcatatattgagtattgatttgtgtgctcaaacaatgggcagaataagccaatatgtgttttagaatcagacaaactgggttcaaatcctagacctgcctctgtgtgtccacgagaaagttactcaccccttggagacctgtttgttatttataacagtgagaacgggggacctagtgcctccctcctggtgatgatgcaaatggtcaaggagatagtgagtgtgcaggtccaggctaagcccttggcaagtggtggaagataccaccaccaccaccaccaccaccaccacaaagttttgtgttttgttgccttacaaaccattagaacaccatcaaaatttgattgtccagttcctctaaaggaatgtgactttagagtgtctgatctatttgtagagtcagagctgatctggactgaaatgtatatcttgcctccaattcttgaaggagcccatcttccataaccagaactggatcacagaattgtattaactattaaactggggaaatacattgtggaactcttaaatatgaaaaccaagtaacgcccaattaatgtgtttaaaatgtgttttagctactatccttttttaagcagccgacagatttgaaactaggtcaataaatttctattaaaattttacttgttcttacaaaatggagttggccaaccta

SEQ ID NO: 89327 - DNA, 2086 bp, Homo sapiens
gggctgttggcatggaggaggaagctcctgagtgcacatgaccaggcagtcaaacgcatgaaaaggaattaaaacaccacaacatgacaccaagtgcttagttatatctataataactttaaagttgaaacgttatgctctaagcattataaaaagtagtccaaatattctgtatgagttgatattcacaaaatgtccaaattaataagctattcaaattgcaccaaaaatacaatctgtatgtttgtctttccaacaagaaacatgctagtgatggcaaactttcactatacatatggcaatacatttctcagatgacccagtatctggacagctttttatgacttgtttggcctggggtaccttagaagctgtccgtcctctgcctcatctccctgcattgatgggtggctcagggcatcctgggtacatgggcatgggtgctggggttggcaagggtgatgtgggtggccaggggtgggctgaccgggcactcctctttaccaggtagcggctcaggggcctcagaggctgctgggaagaaataaagtgccacgtatcacttagcagaaagccgtaaaaacaacgagcaatttccgtgcccgttagagacactgaaaggagccccatggagctgtcttggcttggaattgcccaggccagtgtgagtcacctgtgtgtgctgtggcttgtcttggaagacagtggaatcttgaagagtgggatcagtgagggtgtgtgcattgagatggtgcacaaattgcctggaacagcccatgccaggctcctggagggcagcactgctgtggtggagatactcagagggcagctgggctgcaagttctaggtgtggccctgcctcccctcggctgtccccagggtttgaggttcagtcctttctggggtcttacttgaggcctggccttcatcaggactcatagggcctccaggctgtggggtctagcttggggggattggagaaggtggggttctgagtgcagcaccccattcatgggccaggcaagagacgactgacctgggccttgtgggtagaacttctgatgtcacctccaaatgatgttgtgtacctagaatctaagattaaatattcaaaatatagaagttcttaaggcagccttcctttggaatatctatttttctttcttaaacaaatggcttaggagccaaaaataccctccccaccccaaaaaaggcaagtgccctggactgtgtcctgggtgaggttttgctcagtcaggggcccagactgtgggcagaaggtgttggttccccctcaggggtgtcctgcttgaggggagatggtgggttagggagaagcagcattctaattctggagctagcatcatcaggttgctagatttgggacatgacacttttgtcaaaaatgggggactctcacacttcccttgtgagctgcggaaaggactgatgagccatgagggtgtcttaggtcaagaacctggcatctggtagccctgcaggttttcattaatgtgagctttgttgttattactgtcaaaatccagcaatttcttgtgggtaagcttgaaagcatcactatcatttatgttactgtaatgtgagacgttcccagatttcctcctgactcaaaataacacatcaatctttattcagtgtctgtgggtgtaactattatgttaagtgctgtaaaggaaatagacacataagtgaatgcagtacatatatgaagcagttccatccactttcgtgattctaactagcagctgcatacttgaagtttcccactttccctgagttctagacctgttgttgaaatgtgtgctagatacctgaacttcatcccacatccatctccctgctgctcctccaccccgcattggcagggcttggcccacccctctggatgtcccctgggcttctagtgctaccgtgtgctgtcattgccccttgctttgccagtggtgtgatgtgtctactcctgcttgccagtgagactgtgtgaccattacaggaaggggtagaggctgttcctctcttgtggagaggttggagggtaaaggggccttaaggaaggaatttgggg

SEQ ID NO: 89328 - DNA, 1395 bp, Homo sapiens
ttccatcactgcatttaggggtccagatcttctggacactttctctttccttgtattgttctctccaaggtttctccaccttgacacaattgacatttggggccaacacttcttttttggtggggttgtcctgtgaattgtaggattcttggtggcatccctggcttttacccactagatgccagttgcaatgcccctaattgtgacagcaaaagatactcctagacattgccgaatgtccctttgagggcaaaagtggttgcagttgagaactgctgctctagagctggccccaagacagtcacagagggactaagaagctgtccgtaatccccaccaattcagggtattgggctacacaaaggcaatcagtcattcatttccccaggaaaccattctcctggagtcccagttgtgtgcccaactagacctggagaatacaaaggggagtgaaatgagcctaattctctaagcagcttaaggaaatgggtgttgtgattggggccagaaggcttcctcttaaattatactgatcctactgcagggttgatattagggtcccaaacttcagaaaactctgggttctgatggtttcctatgtgagggcagggagctagttaatccacttggatccacaagcccggggactacagatatattagtcttaggaagggacttggaaagtgagtggcttgattaaaacttagaagggtttatttaaataacaagaaggggctgagggaaccatgggagaaaagacacacagatgagcgtgagcagaatcagagtgaatttgctaacaaagcaaatccaacctacttgggcagatcaaggaaggaaagaacactggtatgggagtaggggagtgagaaatatcaggctgagtgagggagacctggattttctgagccgtctcctggggagcatgctatctgtcttatggattcattgttatggtcaaacaagataatatcaatttaaatattgggcttcccagatgaaagtcattattaaggtcatcgtgtagacagtcttcacaagcagacattgagatttttactttacaaaatagaaaataaggaatcattgacatgagattttgagcaggggagaatattctggaaatggcatatagaattaattggatgggaaggagccaagaggaaagagcggtatagctggccaacaaccatccccaccccgcagcactagatggggaccacccaccatgcatgttttgaaaacctaggatttttactgtgaacttacagatctaagtgtatttgatgggtttcaatcagttgcacttaatgtacttgaagtttgagttgtcccatttttggccactggaacccaaggaggcttctgaatcatcacgggtgttctctttagctt

SEQ ID NO: 89329 - DNA, 1083 bp, Homo sapiens
atttatgctgttctgcaaatgaaaacaattcagtgctatgaattgaactatttgcaccatatcttgggatgctgatggcatctcagtgcagatctttagtctcttggcagtagcagtaggtggagagagatgtttctccttcctgcctttctagcaatacttcctaagatgctgtcttttaagtgtggtaataagctgctttcagttcttttggatatatacccaagcatggaattgctggatcatgttgtaattctataaccactgtttttttcagaaagaaaatgccggcactcagtactggttaggattccagttgcagtaggtgctcagagcctgaggggagtggagctgttgtgtagtctcaatgatttgttccattgtgatggtcagggcatatcaggaacaagccagggcaggtgggtgcctgctgtatggttggtgccctgtgcatgcctaggcagagctttaagcgagtggtcagtgtaatcccactcattcacatgtgctttgcgttcccttcaacctttgttccaagttccaatttaccaaaataggtaaaagtctgcctattttccatgatgcaggtacattgtatgtctgtgaccccctctaaagggatgtttttgggtacatttcagtgtgttgtgaggagggaggtataggacagggatgggggggatctgaggagaaatatgtgtggcatgtgggaaggctgggatcccctgtcttttggtctggctggtgttgagactagctctgaactcattcttctgggagacagtgtgagatttttgtgatctaggacttatttgtccaaagctgcctattttccaggattggaggagagtttgggtaccttgtatctgacatcaagcaagcagagatctacgccacccttccaggaaggggacactgctgttctgaaaacaggcccatcacattccttggtgttgataatggggcactggaaggtgtagctcaggtgcttctcctttccatggccccagattgctggcctggcccaatttcagtgtcctgttcgtttgtcccaaggagggcaagcatctggggcaggctatg

SEQ ID NO: 89330 - DNA, 1028 bp, Homo sapiens
gtctgtgagctgtctcacttgagtacgactagacatgtatttgagttttctgatgtggattaatcctaagtgtccacacacagatgttatatgtgtcttttgttttgcaatttgaaagctcccttaggagatcctgtagcagtctgtctttgaggtccccatcttgtcccagagctccactcttatcttggtgggtgaccctgaggaagtggctcctggaggcattttctccaccccaggctgcccttggggctcagggcatgcaccttgctggtttggctagccttgtgctcaggtgctctagggccttctagccccctccgcttttcttcttgctccacatttagtattgatgaccctgctgcagaaggctcatttggttttagaacattatagagagctattgctgggaatccaggatcaactgtttatagccaccgccaggaagatgctctgagctcccatcttgctgggaggaagaccaagtgagtacacagttagaggacagttttgagtttagaggcacgagatggctgctggcccaacaggccaggcctgagggttcaggcagaatttgactttgctccttctgaatcatagagttccttcattcactgggtgaaaataaaaatgtaagaatgttcccaaaagctggacaggaagagggtgtgaggtgtggatcctggccgcagacatctatcacccctcagctccccatgcatctttctgtgaactgaaatgtatttctccagctctgattctcaacagtagagtttatgggtaattttaattagttttcaaggtttatttttgtatgtttgtagagccatggaaaaaaatgaactggaaatgaaatatgctgttgaataaatgataattttacattctagaagagctcagtatttaagcaagaccttaaaaatagagtgaaaaaagtaattactccaataaattttaccaaaagaaaaatagaaacgttgttctttcctgttcctcttctaaatggagaggacaatggtcttgtaagt

SEQ ID NO: 89331 - DNA, 1050 bp, Homo sapiens
ttttagaggcaatgagaaatgggaccagttttcatggaatgctcatcatgctggtgctgggtcacctgtcacactgatatggcattgaataggcattgctgctacaaatacagctgctgaaatgtggcctgccacaaagatactgatttgagctgagtcagacagctcacaaatatactggtcctcttgccttgttttattactcttacgtttttgagagctagattttataccttgtaagagttttcctctcagcgtttatgggcctcaaaacagccttggcatgtgcgggaatgaggatggcgcatttgggtccggaccttctggcataggattaggagtggttgggggtggggagagagggatgcaaatgccttttacaggtgacatttaaacggggtgtgtttgggttagcaaactctttttgaaaatctgccccccgccctgagcctatcagtcatattcactttagaatgaatgaatttgatctgagatgagctgcccttggggactgggagctcttatatttggaaggttattgcggaattttggaattattgatagtgcatattctggcgggcagcttgagtcagaacagtctataaaccactttcatggactggtaaagagaagaggctgttggcaggagcccatattagtggcaggccccactagggtactctctgtgtgtgatcagaccatgtgtgtgttctcacctggcttaccacgtcacccatctgtccacctgcttacctacgcatccgccctccagtaaacgttgaccaggtgcacctgcttctgtgcctgctgtgggatgaagtcatgcctgagaccagtgctgtgcacagagaagggcttcagggtccattagtatacagtgtaatcgcatcatgtgtctggaccaactgatcagtggtaaagatatgcctgctgtcctctgctttccctgtcagtctttgctcacctctcagtttcctcctccaaggactactctagttcccctttccccaccacataggaatgtggtccagagtcacatgtgaagctttt

SEQ ID NO: 89332 - DNA, 2291 bp, Homo sapiens
taccactaatttaagaaatttagactgaaaatgttacttttaataaaaaggaaatgtcttagacatattaatgcatataatttttcatatcacgaggtgcaatcatagtgtttggtttttgcggcaaaaatgacacttgtcagttctcactttgatttgctgacactcttgccccttcagggtgggttgccatttggaatttggaaatgctgtggcttcaatccatttagacaaacatatccatttctgattagattcagagtggttgtggtgatctgagtatagatgtccataacagcttcacattttcatgtactctgaaaaggaattttttagaggttattatttagaatgtctaattccaagtgaagatttaggggtggaaagtttgaatacaatgctttattctctcattgaaattttgtaggaagctcatgggttgcttttgcaaaagcaatttgaagatattccacgttagtttgaaagctttgtatttaagaattagattgtttaaggtttgggagtacttctgtgaaattgaggtcatgggagtttaggtttatgatgatgaaagtgtgtgtggaaggcacatggcaaaacgttgacttttgctactcagtttttcttataggtcacaggttgaattctttttatcaaaatctgcatgttcttgccagttgtggtggctcacacctacaaccccagcactttgggaggctgagaggcaggagcatctcttgagcccaggtgtttgagaccaccgtgggcaatatggtgaaacctgtctctaataaaaatacaaaaaattagctgggcattgtggtgtgtgcctgtagctctaactacttaggaggctgaggtgggaggattcttgagcccgggaggcagaggttgcaatgagccgagatcgcgccattgcactccagcctgggcgacaaagtgagaccctgtctaaaaataaaattaataaaataaatctgcatgttctttctataaataggaattttattttcataaataagactaaaatagtggtctggggggaattaacacagtgggaggggaagagtaaaaaacgtgtatggttctaaaaagaacttacaaggttaaaatcatggtctattacttttatagtaggtctggctataaagatgttaaatttttaccaagtatcaaattcaaggaaaatgttgtgaaataacattggatgcattcaaaggaattttaaaataattataatttgccgtcttctccttggtcagagggtactttggaatcttactttgagctgtgcaggcaaaaggaattattccacttttctctatttggctttgctctgttgttgactattcctcttgagttcaagtggaggcctcctggacagctggtggccagggcagctgtagtgacccaactctagtgtgcccctcccaaggatggagctcccagtttagctgttgggtttgtacataaaatgccacagcacagcagtctgagctcttgctttctgtttaaataaaaaggcagatgcttcacacatgttttcatgaatttatataaaccatggaaggaaagaatgctgatattcaataggaaccctgtagcaacttgttacttgtaatttttaggtttactgtaagagcaaatgcagaaagcaaacctgcatctgtgctgacactgggttgggactaacccatgctcttttaagtgcctaagtagtgggtgaatggggcatctataaatagtgagttagtgtgtctgacagacctcagagactggagggattccttgggccagcattgtctcatgtggccacatgtggccagggaggaacacagctgaagggaaggaagtgcgctctcttttatccttctttccatatcaagaagagtagatccttgagtcagggagctagcctgctgaggagcgctagctctggagcatggtctactgggcagacctaaagtaggactgagaaaagctttgccacttccttgaggaagatactgtattggcttccatgacttccggaggcatctgatgcctcccaaccggctaccctgctaagttacacttgattaacttttctgtctcctcttggactcagtgttttatgaagctgagcttctcttggaatgcggagcctggaaagggaggaagtgtgccctgggcattccttacagttgtactggattcatactgatccgtccacactctctcgggcctctgtgacagcgccaggcacatgtcactgttgaattaattgatggtgtacacttgttagcagatga

SEQ ID NO: 89333 - DNA, 1061 bp, Homo sapiens
gtgaacacccaggaaatgaatcattccatctgagccaatctgcagtctcctctctcacttgccacctgacactgtagcaccccttctggtgtgattgaagaacttctaagtgccagcctgcccacacctggtgatgcaccagtgtctgtgtgctgcctcgggaggtgactgtgagatatgaggatcttatataagctagtagttttgcatatggctagcccttgttggctcgggacagctggtttaacaaccagcccttagatgacactgggtagaaatttgatgttaagtatttctcactcccttattataggattttttaagagcagtgtttgcctaaagtcagaaccatcttctaggagaggggtcaggtggtactgctagtttttggccagtttcttttagcttatctgtgattcacttagatggttgatacattccttgcccattctggtggctttctgaccatgggggactgtctggtggcagtgcaggataataagtaggaaggcttatgatctgaggagtgtaaatagtaaatggagacatctcttgttagtttttcatttcagctgttgactcctcagtagtgctggattttttatgtttatcactgtctctttcacccccaccctctcttacccagaagacaaatggtgaggttaaatttggccatgactcagccaaagtctggtggtggccatcaggaaagagtgtcagaggtcttagaattggcactcgggtgcttgaactgtttttagttttcactaaagttgaaactattctggttgaacttattctggtaataagctgaaaacaatgtgctcctgggcatgtttcaaaaactaaaacattttttaaaatggaaatatggattagggtagcttgccacaatgatagtcacgtgtagggaaatacacacaaattgaactaagtctaacttttatgcttagataacaaaaagatacttttgaatttaccaaatattcattcaagcagtcaccaatgaggcatctggatagcttcttttgtaagactgtccttattcttataaagttagt

SEQ ID NO: 89334 - DNA, 1036 bp, Homo sapiens
gtatttttgaaactgagcagaaaagtgttaacattttaccatgtcaccattttaatgtgagaaaggaaacctcccagcaagaggttgagaaatgacagaccagagtgctcctgttgtctccttcctaggtcattccccttcgtggcttcagtttctctgccattcctggagctctgcttcctggaggtacacatgtccccctcacccttgattcctccccggccctcgattcacaccccccccaaacttcatgttcaaatcctcattctgctatgctatgctattctgctatgaattcaaaatttttaagtaatgaaaacttcgataagagcaatatacacttacgatttttaaaaagctataatttttatgatttaatgccatgattacaattttaggatctcattggagatcagattgggtttgactagaaaatgagcaggtgtggaaaaggaggttggaaatggtctgaactgaatttgggtgaagatctcaaagtacatagaacagctgatgtcatctcagcatattgtttcaccacaaaagcaaggtcatctaacaacattttgtcatggtgaatctgatgagaattcctaagtacactctgagaatagaaagaaggtggatgctgcggagggggtctgcattggaaaacctctgctgccatttcaatgcatcgagccaccttgccttattatagtgaacaatagtagaagtacctggaggctccatagaggggctgtgtgcagtgagcatagtgtcgaagcaccatgtgtcaacagtacacacttctgaaggtggaagaagaatgacatgagaacaagaaagagaaatgattgcaggctcttacataaatgcaactgatacgtgggttttttactaacagtggcatagaatgaatacagtggtatagaataacatatttaaaaataaaacaagaatccctattctgtttccttatcctgctgctgtttttcacggcaatcatcaccttatacactcagttctgtataacacttgtttgtaaaacccgtat

SEQ ID NO: 89335 - DNA, 1014 bp, Homo sapiens
acagcagtgcttgtgttcatgtaactcttatctgacttcataatggccccaaagcacaagactagtaatgctggcaattcagataagccaaagagaagccataaagtgcgtcccctagggaaaaggtgaaaattcttgacttaataaggaaagaaaaaaattatatgctgaggttgctaagatgtacagtacataagatattttgagagagagactgcattcacataaccgttattacagtatattgttacaattgttgtcttttattagttattgttgctaatctcttattgtgcccgacttataaattaaactttatcataagtatgcatgtatacaaaaaatatagtatacatagtatccaaggattcaggcatctactggaggtcttggaatacattcccatggataaagagggaccgctatattatagttaagggacgtagaatggctaacgtagcttatcaatgaaggggagggatggaaatgtggaatgtaggtcacccagctttttaaaatttgtatttaagaaaagctttatgttctaacaacctttaattcaaagccaattaaaagtaagaacaatcagaataatagcaaaagtggccagatccatgaatataaggttatgttcatttagtaaagatagtggggaaaaaaagagaccccaacagtggcgcttgactccaaaataatttaatataggaaaaattaaaaagtgtataaacatgatgctttgatctgggtttgttttaatgaaaattcttgttattgaattgttgctttagcaccagtcatgcatatttaatatatgtatatggttaatgctcagtaaatgagggcatgtgttgagtgtgtacctataattggtagttggaataatagatatatatgtgtacatagacacatacttatatgcatgtgactttgtgctgcaactctgggaagcacttcacacactatttctttctttcttttttttttttttcgagacgaaatcttgctctgtagccc

SEQ ID NO: 89336 - DNA, 1105 bp, Homo sapiens
gggtgatacagctggtaattggtgaacctgggactgtggtgcagagcccatgccttcatgggtgctgacagcatttagctaggtcttggtgataccagttaagaagatttgtcccttgccttccaggaagaagccatggagttgtcagtggaaaatcaccatgagattggtgcacaagtgagcagagcctgaggaattgtggggactgggggagcaggtgcctaagtgccttgtgtggtgggctccccctccattaactagatgctttgaaagtgcccacatacattgaaatgagcccaaaataccccaaaagcagaaagcatagacatgtgcatgaaggaaggaactaatgttcattcaattcctaccttgttgtaagcactgggctagtcgcttctcatacactgtattagtaactgaagttgtcacatatgagtttagtgtaagtgtttttacttgttctgtctcatttagtctttacaatccttctgtgactggttctgttattatcttcattttccataaaacccaaagagtgtgccctaagtcacatagttataaatggttttgtttaatcatcaccaccaaccagtgagataggaattattcttagaagtaagcacacacaaccagggagtggtactgttaagatttgaatgcagggctgtcttcacagcctttgctttttccattttaaataaggcacacattgagtcgaggtgtgtttctaagaaaaatataagagaagatttgagacagtgattaagttcttccaagacttaaccaaaatatatatgtacttagaataatggagatcttatatttaaaagaaaagcagttagcaagttgaatagcaattagtcacagaagataggagccatagattttaaatatggtaactatgagacgagaaagatcacactgccagcagaggaattcatcttaaaactagaactgatcttgcttctctaaaaaaaaaaaaaaaaaaaaaaaaaaatccttcttggttcccactgtctgcagaatatgaatcttggcatgtcctctcttgtggccagtctctcatcacctctcaggccactcctacaggcggcccctctccatc

SEQ ID NO: 89337 - DNA, 1024 bp, Homo sapiens
cctcgtgatccatctgcctcagcctcccaaagtgctgggattacaggcatgagccaccgcgcctggccgagtttttggtttctttttgggagttttatttcagtggcatcccctgcactgccctcccacacactcctccagaggctgcctgcaggggatgcctctgaatctgttccaagcagtttccacagcaaggctgttaggaacctccatgaagacctcaaattgctccacagagaaaacttgacaatagagggtattatccagaaatattatttatcttagtctcaagctggctagcatggtggttgtttttagagactacttttaccttcacgctgaggagccagcaggcccctcagctctctgcatttctccgctgactctgccagctgtggagtgtgcttgcaggttacctgcaacctcctccttgccaaatgcagggagctttttcttgctgtgttctccccttctcttgggcactggagggcattcaccatcagtcgtttaaaaacttccctctcccaccggctcccctgctttctccctctctctttctggcagcttctctggctgtggcttcagtagcccttctgcccagatccctggccctcccctcctgcctgtacttctgtcagtccatgggatgtcaaatctagcagcccctcaaactcagcatgaccactgttatgtgtgtctgttgtcagcaaaacctgtgggcagtcacccgacccagaggcctggccatctcccttccccacatattgctcaggtatggaggcctgtacctggtgtctgctgccccagtgctctccgtccatgccctgcctcggctcaggccctctcactctcctctgcaccactgtaagacactgctcttcatcctgtcttcaggctcactcctctagctcatcttccacattggcacttgagttttcactcagaaaaccagttctgatcctggactgacatccgtgtggcctcagggtgaggcctagacactttgcagcctgtcctgaacaac

SEQ ID NO: 89338 - DNA, 1136 bp, Homo sapiens
ctgtgactatctgctgagattatctccacccgccaccctcctgccctgctattgccttggataagcttttgcaattggcagggcacccagttacatggtcttagagcatgctatactttttgcttttttataatattttccccaattgcatggttgtgtgtgtaaggtcattctctcttatagattcctcagttccaggaggatagtctcttcctttctctctttgtctttgcaacattcttcgcagctagaatattgcccagcaagcaggagctcagtaaaaatgggtgaggtgagcaggtatatgccccagagctggatgttgaggtgtgcttcccacaggctgcacctgcccaccaatgcgaggtgaggacctgcatgagccaggcattgtcagaccctgggcaaattcagaagggtgggcatgaaccctgctttctgaggagaaaggggtggtcagtggccaattctactttaatgtggtaagtgccagaaaatgtggaagctcagagttgtacgggaacatagaggatgaggacgaggctgaagctggagtctacaggaagtgtgactggagacagggaggccagaattgggtccagaaggcttcaggaggttttctaggaggcctgctgcagactgctggacgtctctgtggctgttgtagtgggcagagtccctgctggcagaattcttagctttgtgtctgctggtaggctccttcttatttttaagcttatgatagagatgatatgctgggaaaccacatgttacagggaagcttcgcacaaacagctgtgctgtgtaattgccgtgatgctccttaattatagacatcacagccaagtgccatctcttcatcacattttagacgcagtgcctgccccgtggaacaaaatgtacctcctcatggaatcgtggactcactgaatttggttggtagtgctagaaggaaccttgctcaagttacagtgacacgttgcatgatttttttaaaaagccccaaaaacaaaattagaaaagtcaagtcaaattatgctaagttaggatttctgactttagttcatgaaagtccgtgaataaagctttggaatagaataataaattactgattacagactgtttcctctatgagt

SEQ ID NO: 89339 - DNA, 1061 bp, Homo sapiens
aacaaattgtaaatggagtggtaccctgtgaaagttatttcccttctctactccctaattctgttcaatttatttgaagtaggaagagatattctaaatcattccattgaccatgaggcagtgtttaaaattcctataaaaatgagctttgctttacctcaatatttgatggactggctaagggtaggattatgaaggtttgggcctctgtctcatcttgggtttttctttccattcgaggttgccccattggtgggttccagaaatcatgggcatgtccaggtagttgcagcgaggctccctcgctgcggtcagccacagccatcagggttatagtttcctggatctttaccataagtaaggttgaagcggaagttgccattttcttctaaataaattcattgagaaaccttgatcctactccaggattctccagggttttttgttgcatccaaatcagtagggcttccctccaggtctccgttgatgaatggattccctggcccctgtcctgggttaggctttggagacaggaacttgttgccaggacagcagatagaaaaggatttaaggtcacctgagaaatagtccacaattaattgtgctgtgaatacagggctcttccccaaggagcgagcaagtgtttgaaaaccagacctcgtggtaggctgtggtcctccacggctggcgctcagggatgctgagcactggcaatctggccttcctcagtgcataagggccctgggggctctcagaatgacaggtcatcattagtcgcggtgaaatcaccagcaacgtgaggagccagccacggagtcaggctggcttttaactgctttagatctatgtattaatttctcctactcagcagcccaagcctctgcggactttttttttttttttgcttttccagtgcgctgtctcgtcagcattggagactgctcccagagaggtcaggcctaattcctcattggcaagttttgccacactttaatccacatgtcccagattgaaccctttttgaatggaaaggctttgcaagtcagtaagggtctgcaagt

SEQ ID NO: 89340 - DNA, 2468 bp, Homo sapiens
gatcctagcaacagtctgttgtcctggattgtatgaatttgatcaataaaatagttaaatgtgttagggacgagttctgggatgggataggagcaacaagaagtgggaaacattttcattgtttcacagtagatttttcttttgctttaatcctatctatatattatggcaatctattatgattctttcaaaagagaactttttagcacaattttattaggagagatttattttccatttagacagatgtcggcaatgttcattaaacctttaattaaaaaaaaaaaaagctgtctagggatcacaggtaaataaatgtatttcatatgggaaagagccaaaaaaatttttcaaaaaaaatagttaaaaatataaaccgtgctatgggccctgccttcctcaggctctgaggtgagttaaccgtcattggagcatacatttcagtctttactgcacatgctttgattctggctgcagctaccctaagtggagaattcataaacaggttgggctgtggctttcagaagagtggcatattcatctatttttgttttcccctgaaatttggttcttccttcccttcctggtctttcagcgggtgccatgttaatggctggaaccacttggcagacatgaatctcttggatgccgccccctagtgcagaaggtctgcctgtagatactgtcaaggccatgtgcaccccgagttgtgcacctcaaatgtcccctgacatttacatctaccatcccctagggcttgtacttttccgatgttttccagaccccctgtgaagttaatggggcttctgttcctttgaacttcttttgtcctgcgcactgaacagtgacaggtaagccaggctctctgggcccctggtgcaattataattaaccatgggcctcaaacaaatcctttagctatgcatgattttccatctttgcatgacctttcatgatctgtgacaaatcaacttctgacattgattgtaagggagtagttttccaacaaatgcaaaagattgcctagagagctggggtccgggctgtagactttatcagcagcaccatcttaggggtttgtagcctggatatgctgatggtttttcttatcttcttgagagacagaggaaggaaaggacagttgattgtaatagattagaagattagtggaaaagaaatggtcatttcttataaaacagtatgtgttcctatgtcatgggtaagaatggaatagggggatggggctgtagaaatcatctacctgtagttttcaaactgctcatcaaggccctaggtgttcttggggtactactggatggggctggggaaggaggagttccagcctgtgtgtcccccacgggcaacagtgtcagtgatggggtcagagagggacccacttctactgccttcctggttgagctctggggactgcaccaagcttctggagagagccttgcttgtacacacctcagctcttgcctgcccatgtaaagcaggaccacacagctgagactgtcatcctccctctgtcatggggtgacttgccacagtgccatttagtgctgactaagtgtgagtctgagaagaaaaacattgatgtctaagtattcaccttttaaggaatctcccttttaattaaggaggattctgtgtttccctgtttagcacctgcatctttggttttgtgggaccatgaagatgaagcttgggaagatgtgagaaaggctctgtggagggtgtagctccagtcaggttccagcaggtgggaaggtgagaagtgagaggaaaagcccataatgttttgggaggaaagaggttttaagggagcagctgctgagatgcatgtgccttggctgagagggacaggtgaggagaaccttgaggatattttgctgtgtgttggtgcccactcagaagacttcaatatggatttaaaaatgccagtgaggagtgacttaatgctggacttgcgttttttaataaatgtaatatgctgaagcgcagctgggcacatcacttacctgggttaggatcatcctgtgatgggccaccaggcaccctggtgaaagtggcagccatcagcattggtggattgttcactgggaagaatgccttcagatatggtaccaagctctgtagcacacacaagcttccgtacagaacatctgacttttgcaaaaattttgttttacattcaaatacgaagggtgtctgaatccaacagtaaaaaggcagtcttcaaaaagaaaaaaagggaaaggagcagcttttgtagtttgcttttattggcagagctgaaactgattccataagagttgaccaatcttgcctgatggtattagagtgaaggcaaccacagcagcagctgtaacaggtgaagagttgtatgtccactcctgaagtgtttttttctctgagttggtacctgctctttcttgatttctctgagagagatccccagagcttag

SEQ ID NO: 89341 - DNA, 1897 bp, Homo sapiens
ccgcagcttcgcccctggactgatggtgccttccgtggggtctttgctcccagctgaactgggacatgatggcacctgtgtgggtggcctgctttactcctctagagcagagacctcagggctttcattcctggctttgaacgcccacaattactcccacatggctcagggatcgcagtgtcccagagttaatgatgcaaatgcagctgtgccctaaaacaaaaggcagcgggtatgcgctttggagagggcgtgcatttgggaagatgaggatgctcctcctggtactctgcccagcccacaaagcagaggagcatgagcccgtgccatgtgaatgctgataggagtgtcctgagctggtgaacaccatgctgccacctctctgaggtgcagtctctccctgaggccccacaccccagctctgggtcctgcctgacccgagccagcttgcatcctgctttactgtctgctttctcaaggtttcctgaggctacacctcctcccagaaggcttcaaaattgttatgcgtggatatcacccctttgttttccttggtcaccctgtgtccacagcaagtggttgtcgatcgactgccctgccctggtggcccctggacttctcctgagtactgggctcacttagaacaaagagaagtccaggcaattaggatcagaacaatggtctattcagcacttctccaagcaaagactccttttgtccagagtgctgacttcggaaagttcttcttgaggttttggtgtaggaaattagaatcaccagggcaaagacagtaaaagagaacttccctgtgggaaaatgaccctgtttaaaggtagttggttttctgctactcacacaaatgcttgtctgtctatccacagaataagtgatactttctttgcagcacgcggaaaggttttttgtttcagggaagcagcttccagggcacaattttgtttctatcccggggacgtttcacataaacgagatgatatgagtaatgattttcatagtgtttgtgggcaatgacaaaatacctgtgaaagaatccaatccagatggagaaccaattgttatttccaaccattttagttcccagggttaaagtcagcaaatactggctgagaggataaaatcctcaaactcagataatgatgttgcttgaaaaaatggaagtctctaaccaaaactgaaaagaatattaattgcaaattccacttctccatagtgcatactttgctgtaatcttaaatatataagttacttggcctacatgatttctattaagatgcagcttttataaactttcgagtatgaattagcatctggtggtgttttcgatgaatacttctgaaggctttgtgtgaggaagcctgttagggtaatggcaacctctctctcacaatagtcccttgtagaatactcctgtgtcatccctgttttatggatgagaaaaaaccaatttgtctaagatcaaatatttaacatgtgaaggagctagaatttttaaacagcttattgagatataatttacataccataaaattctcccttttaaagtgtgcaattcagtggtttttagtagattcaccaaattttgcagccattgccagtatctaattccagaacattttcatcaccccaaataaaaaccttatacccactagcagtcactcctcatccccatcttttcctccccagccctaggtagccactgatctacttctgtctctgtgcttttgcctgtgctggacaattcatatatacagaatcatataatatgtggtcttttgggaccggcttcttccacttaacatagtgttttttcagcttcatccatgttgtaacatgtatcaatacttctttttttctactgctgtgtaattttccagtgcat

SEQ ID NO: 89342 - DNA, 1726 bp, Homo sapiens
aaccttccttttctttatcaaccttattgacgagtaattcacatgcaataaaatgcacacattttaaatccagttcaccttttgacaactatatctcaaacaagacaaaaaatattttcccatagtttccttcatgtattttccctatcaatctccgctattcccaatccaggcaagcactggtctgctttgtcactatagatcagatttgtcttttctgaaactttatgtgaatggaatcatacagtatctggtattttgtgtctggcttatttcatttagcataatattgttagaattcatctaggctgcatgcgtcagtagtctatattgctgattagtgcacccttgtataatgtaccacagtttatctgtttgccaactgatggacagttgagttgtttccagtagggtgtttttaaaaatcattctgagtaaagcttctatgaaccttggtgaaatgtttttatgtgtgtaaattttcattttccttggggaaagtcctagaaatagaattgctgggttgaacagtaggtgtatatttcagttgataagcaactatcaaactgctttctagagaggttgcagcatctcacatcccaccagcagagcgtcaggttccagttgttccaggttctccataagcttatatgaccattctttttatggttagccattctaacattgtaacatgcaaaacgtagccaagagatattaaagttcttgcctaaaagcacacaggcagtaagtgcctgagctgtggtcaccctgctgggcccctgagcctgttgctggttgtcctcccactgcatcctgcccacttctctgtatggacccttctgtaactgtgttattccatgggagatgacagagggaaatggtcagtttcatcaggaaatatactctgattaggtattaggctcagaaatatttatttagctgaggttctaaccccaggttctctttctcttttctgcaattgaagtctggcagaactttgaagctatatccacattgtttcttagtgaggttctcaaatgtgttggactcacccagctgtcacaacaaaggggaagagaccttatgtttggtattttgcatttttttgttttcactgagacaacttgctggaactgcatggcactcttggcttagccctccttaccagaggacacacagcctggaaataaatacagaggaaagtgtcaggaggccacggaggatccacacacagcttgtccgtttaatgtgtacaaaccttaggctaggtgtgaatttgttatgagacaaaaccagtatttaagctgtactgaacttgtaaaaatgccagtatatattattttactgttgttcttctgttccccattcattactgaataaactcccatcaaaacagttgttttaaatatccattcttttttctgatgcaattttctttgctttatgtgatacttgccatagatttgtggctgtttccatcttgaagaatacttaaaggaagaaccctggccccatgggttggggcaggtgaactgctgagttttatcatctctgcacagtgacatgattgatgctgggttgttcccttttgaccccagctaatgatccttaacttctctccaaggagtagatactcatttcttttttctcaaagtgtttagggcagagagggtgaacatcttccctatcaactggcattgaccccgggaaggaagaggcaatctct

SEQ ID NO: 89343 - DNA, 1032 bp, Homo sapiens
tactacatattttcttactcagttttgtttgaaatagacaatttaaacaaatgactataaaggttttgttttgaaaattaaagatagttggaatgaaaagtacttctcaattagaaattgtagtttattttaattaaatgacatttggcaaaaaagaggagaggtttttggcaccactgggagatatctttggcatttgtagaaggatgctgtttatcaaagagtttgagatggcgtcagaacctgcctgaggtctttggttctagtgccactgaagagtaagttgtgatgtcgcagaggttaaaaatacagtgaatgcatagcaattagaagacaatggtcagattgcatgtaagcaagatgcaactatataagaaattctacatagatagtttaaaaataaaaggatagaaaaagatacaccattcactaacccaaagtgtccatattcatatcagaaaagtagactttaaaacagggaatattgacagggatgaagagaggtattacatagcaataaaagttcaatacaccaagaagccacaacaatcccaaatgtaagcacacctaccaacagaacttcaaagcacctaaagcaggaactcataaagatgaaagaagaaatacacaaatccactgtaatagttggagacttcaactctcctttcacactaatctatagaacaagtaaatggaaagtcagtaagaatatagaagatgtggacaccactattactcaatttgatatagtggatatttatagaacagccactcaataacagcagaatacatgttcttttaaagtgtacatgagacattcaccaggataagccatattccgggccataaaataagccttaataagtctaaaagatttgataaagtatatgttctgaccacaaagaaattaaattagaaattagtaacagatatctggaaaatctctaaatatttggaaattaaacaatacaccttaataaaccatgggtcaaaaaaatcacaaggttaagttattcccctctgaattcaata

SEQ ID NO: 89344 - DNA, 1029 bp, Homo sapiens
ttctctggtatattaatattagtgattagcttgagtggtttcttgagagcttgttctcactttttcaccatgaagtcatgtgtgaatctagttttagttaaagtaataaacatttgttacatgcttggaaaaactttctgactagacatgagctcatctaaatgttcacttttcacatatgctggtggaaaaggatatggagggagagagaattattttttatttcctttatacatatgagtgtaaagtaattttccaaaaactcatgatattgtcccattttctttcttccaaagccatgattatcttgaagtctgagttaacacagctgtctttcattacgttcagggcgcagacatcactcacccacccttccccccaggtcagctctgaccctgaagagctctttcctggttcaaagggagcctttgctgagcctggccacatttacctggtcccccatccatataattgaaaaatgccataaaaatcaaaataaggggctgatttcatgtaggaacaggagaattatgccagttcatctacattattttttctcttttggagataagccatggttgctgacttttcctataataataacctttcattattccattgagctttctaccatttacatcactgaggttttttatttttgccctgttgtgatcatttaagatgaatgtttcagctttatcctagatgcgtttgagacaaggcactgtccaattgaggaaatctcccaatctcagttgaggaaaacaatggtggaaaaatccctctcagcttggtactatgaaaaaaatgactgggtttgggtctggctagttaaatgatcttgccaatgtttttttttttcttttcttttctttttgccactcctgagtcttagtgtctttatctgtaaagaaaagctaccattaaatcagtggttcttgaacaggcaacccttgaggatttcctggggaatttaatagagcctgggccccaccccagaaatttggattaaatccatctgggtaaggt

SEQ ID NO: 89345 - DNA, 1056 bp, Homo sapiens
cccaagggctatctttggaacacattagtggctttgagttcctcacctgatagtctttgctgcaatcaaatgtttcctgcagtagaaaaccagcaagcttctccgtggccagtcccttgggaccgtgggggagtagagcctggtgtttcttgaagaatgaaaaacaaggcactgtaaatatttctggcagtgaggagattcatttgccttatctttattagattgcccagaaggcagcaataactggtgtttggcaaaggacaatgttaggactggttgtaaaattcttttggcaacagttgatatgcttcatttgaatacagcagagcaatctgtagggtccattctggctttaaaggcttgtacatagttttagcagcacagctgggatggaaggtggacagggacagtatttgaagtatttttgttttctttcctgccaggatgacaaggatttggtgcatgaatttgtagtggctgaaggtctgacatgtttgatcaaggtgggagctgaggctgatcagaactatcagaactacatcttaaggggtaagtcatgactgggcatgcagcagctgccccagctgcaggggggatctgggttcaccttcaggaacttaactactgagagctttttaaaagacttcgatttgagagtaaggtggtaaagacaccctttggcaaaaaaacatctgccataggtaaaacaggttttaccagttcctagtaattagcaactgtgctaatttttactgactttcacctggagttattttacacgcttactaggaaaactgtaccactcactgggttctttataatctgtcttatttgtccaggaaggagacatactaaatgggcttgggtaaagcctgcatctcagcagaaagccaccccaaaccaaagggggcaatttatttcttggaaaaaaacattttctcccaatttgagttatcacctggggcttttgtcaaagtgcatatttttcaccttgtcttcctgtttctgattcgatagttttgagcgggtccgggatttgccttttaaagagcgatt

SEQ ID NO: 89346 - DNA, 1041 bp, Homo sapiens
accaggaaagtaacttctgagggatggaaatgacacatttcttgggacgtgacatttgcgttttcctgcagggaagctatgattttccttagttcatacatggagtcactcctttgtgactttgaacaatttctcacgtaggcttttttttaaggttctgataactgctggcagccactggacatttgcgatcaagaacaacctttgaattacctctttatttgtccacccatgttttaactgtgctgtcttcggtggggactggtgagggcagatgcagatcaagagaagaggctgggaaaagttttgcagttattttattcacagttccctgaggagaagacacagcacccatgcagggccactcaggaagcacagaggtcggccatgaggtggggggagaggcagactgtgggcaaacacctgcattgtggcttccaagggacaggcaagccagctgaggattggccccgaagctcagagtggctctggagtggcgagggcctgtgtatagtagcccaaggtgtgagagccccgtgtgggagaaggttggggtgtagacttaatgggctgctggagaagacgaactggctggtcgctagccagggcctcaaaactgggttaagctggacacagtggcacatgcctgtcatctccgctacttggaggctgaggccggaggatcacttgagcctaggaatttgaggttacagtgagctatatttgcaccactgcactccagcctgattaacagagcaagaccctgtttttaaaaaagctgtgtcaagatagcattttaaaaaatgatattgcaaaccgtaagttgggttaattgtcctagtgtcttgagaagtgtgccctcatgaagccacctgaggagctctgctctgtgtggctacatgggagtcctacagccccaggggaaacaaaagcatgtggagaatccaggactttcccagatctgcttttagaactctttatttgtctttatttgcatacacagccccctctcagcattttttttttttaaggcccaggaat

SEQ ID NO: 89347 - DNA, 1011 bp, Homo sapiens
ggaaaaaatcctcaaatgccattcatattaggggatcccttaatgagaatcaggatgtatggtcagatggtgtttgttggcattgatggtaccagaaatggaaatatcatagatatcatggaaagagattttatgatgttagaaggcagtggcacaaaatgatcaagtggtaattaaactaacatcctccttgtcagaaaaactgaagtttatattttggcactttataaaatgccaaaaagagcagaggttgggtttagactacagggaaggcaccaaactagccccaaggtgaggaaatgggagcaaaggggaagaatttcttgcttcctgaactaaggttaggtctttggctactgtattttccacggaacaacctagcctgactctctgcaacctcatgacactggtcctgtgtcccatgcagctggcttggaggaagctctttcctgcctcttgccagaagggttttctgctttgggtctggacttcagagattatcatggtagctgtacagctaggctttgatgtggatgacccaggagtcttggaggtgtcttcagctccaggtgggttgaggccagtgttaagaatggagtccttcctcatttgatgtctctcctcttgctgagtggtacaacaggactatttccaataaaaaatcactgcagcgtaagcagactggcagcctgtggggctgaatggaacctgcaggtgttttgtgtgccctatctaacaggtttaaagattgtgaattatgaacatttaaaaacttggagatttggcataaaaatacagctttctggcttttcttgaagtactgaaaacttaagccgacccaggccctgtgggatgtggactggggagggctggagaaagtggcccttgaagcagaaagatgcaatcaccacgtggtgtttgctttttcttcctcctgtagttgaaacctctgctttaggtgtcttggggccctggctgggtctgacctccatctggcctctctttcacgtc

SEQ ID NO: 89348 - DNA, 1039 bp, Homo sapiens
acgaccaaatctcacttctgtgttcatcaggaatttttccactttattcataccaaagatgtgcctcctcactctgtccttctctccttgctcagtagacttttccagaggagctgctggctaggtgtgccttgaagcacaatcgttatttccttggctctaattttatctcacacatggtcttcttttacaaggtttctatttgtgaatccagctttatgatagaagaaaatgtcaacagcaagatttaaacctagccccaagcatggattaaaactttttttgtgggtggggtggtggagctaagactttctgaggaaatatcagttggtgtgttcatagatttctgcattttggaggcttgagggctcttggtagattgggccagcctcttggcagggtaccacgccttttctaaccctgtgatttcccctgccattaatgtgcccaagacctccagccctggctactctccaatgcctcaggcctgtggagccagctgtgccctggtatctccatctccattgcaccagtatctccatctccattgcaccatgcccaaacccaaaacccatgtttttataccccagtcagttcctccacagctctgttcatcatcccaacaaagcgtaatcattcatcacattcaattcagccaccctagggtcctcctaacccctttctctcattcattctttgtaatcatcacccaccaaattagggcttctctaaaccttgactccctttcaagtccttccatctctgtctatacccagtttttgagttcagatcatcatttgttccttcctaacctgctctaccagctgcctcatgggtctctctgcttttagtcctgcctccctttggcccattttgccctctgttgcatggatggaccatgcaccatgatctgttctccttagtccttggttcagcttctttagtggctcctctcatcctcagggtgaaatcccaggccttctgtgtgggtagagcccactttggtcctgccctcgtgtgtcggtgcagtccactgcag

SEQ ID NO: 89349 - DNA, 1030 bp, Homo sapiens
ctccaggagatcttccctggttcccgagtattttggccctctatgcataccctggtcttgactcactgataataaatatttgtgaacatacactatggaccaggaacccaaggctaattccctgcaccatattagccttcgtgcatgtcaggttccatccttgttctgtgagatccttgagagccaggcatgttttaagagctcagtgaaaatgagctgacagaaggaatagaagaatgatagactatctgcagagaaagagaagtcactacttgtgagaaagctgctgatttgtactagtaattggagagccggaatttgcttatttgaagctttagtccacctgctcttgtttctgaagcagtatagcacaaggtgatttggttttggtacttttcaaaaaatgccgatgtactaaactttctttttgataattttactagttcagtaggtggatatatatctactagggtgtatatcttgattttaaataagacatgatttatacagataaaatacatgcaaatatggattatactgtacagcctgttttgtatgtggaggaattatttacctgcctctgaaatagatggactgtggatttcttggagatgggagtagtatcatcacaacctttgcagctgcaccagcctgctcctgagtgcctcataaatattcaacaaatagttgaggaagacaattgaatgaatgcctgggagaggagtccccagagccatgccatggctgtgttgatcttgttgagtgttttatgggtgattccgggtaagcacaaagtttataccaagaaatgtgtgtgcatgatcaggagatgtgaaatgagaagacagcaattatatgacacatgttcaagtgtgatgtggagggcttttacttgatttgattttcagtatcctcactatttcaacctcattatcttgtcgtctttgctttctttaccctgcctcttctatccctagctgcttaaaactggacctttccaaaaccactcacatgggagtttggcctgact

SEQ ID NO: 89350 - DNA, 1568 bp, Homo sapiens
gtcccaaatctttggattttggaatcagtcagaggggagattattctaggtaggatgggcctaaatagatgaatccctgaaaagaaagtctagaagtcaaagacttctgctgaccttgaagaagcaagttgccatgagttctacagctgcaaggaaatgaattctgccaacaaccacatgagcttggaagaggaccccaagcctcagatcagaccacaactgacaccttgattgcagcctggtgagacacccccagcagaagacccagtcgggccatgcctggatttctgcaccatggaaactgtgagatgataaatgtatgttgttttaagctgccaagcaatttgttatacagagttagaaaatgaatatagttacatacaaagaatcacaacacgaagccatctggacttgctaaatttggtacagaatactctgacctcagaggtcttttgtaggggaatcagggaagatatcatgagggcagcaaccttttactgtctttctgggcttcttaggcaactacatgccatccattcaagctgaattccccttgatcccctgcctcttcttgcatgatcttctcacacggtctgtgcagacctctcatgtgggtctcccaactgttgacaatgtccaggaccactgcaataaaggactctcttccacacacaaaagagtgactaatggagaaggcaatttataagaaaatttggtgtttcctaatatgccagcatcatgagagaacatggtagctttatcaagattgggctgagttttaggaaaagatgatcacttgggtgatcttgggatgatctcacctatgaagacaagcatgggcactgggccacccttgctcttcttcagagatgctcttatctcagtgttctttgcatctcctgtttactcattgattaatccaggagatgatttgcagatgactgcagtgggagatccaagggctcggccaaggcccctcgtcgtaaggaacttggcagtggcttagcataggagccatctaagtaaaagtggatagacacaaaaacactgtatttgttaggcatggaatgaaaatcctgaaatcattctttttttcccccctcaattttgtttgcatcagcattatgtttctaaagatggttgataaattttaagtagttcaatcctgtatcatttatttcaaagatagttattctttgcttagtcactcaagatgtttgctttttcataattcagcttttttttttcttttgagactgaatcttgctctgttgccccaactggagtgcagtggcacaatctttgctcactgcaacctccgcctcctgcgttccagcgattctcctgcctcagcctcaccaccatgtctggctaatttttatatttattttattagaaatggagtttcaccatgttggccaggctggtctcaaactcctgacctcaggtaatccacctgcctcagcctcccgaagtgctgagattacagatgtgagccaccatgcctggcccataattcagctttctaaaaaatagaatcagcttaatatatagtgtttcatgggaat

SEQ ID NO: 89351 - DNA, 1052 bp, Homo sapiens
gaagagtacctgggatctcaccatactacctttgtaatttcctgtatatttatatttcaacataaaaagtaaaaaatcagtacgcatcttatgttgcttagcttctataagaccactatccatactcaacccaagaaaacaccacacaattagcataggctggattattacatttgttatgttcaacgaagtgatatcatagtctttgtgttttttatgatgatcagacccacttttgaattcattctgtattcagtactacatactatattctatagactgagttggctgaaatccaggacataataagtaggtaggggaacttgggcaagatttgctaggcagggcatgctgtgactttaactatttgaataattcacgtgtatagaagacatggagttattctgggtgaaggtgcagatgccaaaaccaaggccattgcgtagaaagtgtctagagtgagatgggggcccagtcaccgtccagagaggaaagcaggccacagttcttccattgctcagacgtgcctggagtggtgagcagagactgagtgaacacctgctgtggaggtgggcactgcagtggcaaaaatggggactcagtggcacctttcaatggcagacccaggctcttggccaagttgtgatgaaagaaattcagcagcaggtgggcgaatcagaggtgacaaaaccctgtttggggctgtttatcaccattttgagaaaattaaaaccaaagcaatgttttctgagactatttttgaacccattatgagtatgatttctagagtaggaagtacaggattggaggatgatgtgctcattaaagtccccaagaatggacagcagtgatgattcagaacaggcaagtcctggaagaggcctggttccgatgtggcaataggggagtagcttgaggaaacacactgcacatcccttgaagccttggactcaacaaagagaggccctgaagaattaagtgggctctctgctgcctctggcttcatgtcgcctgtatttaaatcatgatccctttcatcatgttgttccaac

SEQ ID NO: 89352 - DNA, 1075 bp, Homo sapiens
tcaggctgcgtctccagggagctcacagtgtgaggtgcctgggcacgtgagtcactgggctgggtggctgcagactcccgtcacggcagtcggctccctcactgcctctggacttgccaaagttttgttgaggtggagaggtcgccacaggctgaaagcattaaggagaaccaccctggcatgcggagcagtcggtgtgctttggaggaaaacatacaaaccaggtgagtgtgtgtggacaagctggggcttggctgccagatgccgccctcccctttctggtgggactgctcagggacatctcctcctcctctcttaacatcttcccaggtgtttctttgaacagagcaatgggtacttttccagcaatataaaaagctttgaacagagaaattttacagatggtattaacttttcaaaaattagacaaacaacctaacttcagaagttggtatttcttacattaaaatcctgggaaaattaaatattttgccactagtttttacatctctaaaactagggtaatactgactacctggtgttggccatgaagagtcaatgaggcaatgcttgtagattaacttcttgtagattggtagtgtaaacttcagaatttaaaatttatccatgctcaccctccctccctctccttctttatctctccccctctctccctgtctcctcacctttgatttaagtcaacaaaaattcattttgtgccccgtgtgccaggactgggcatacagtggtgaacaagacacacatggctctgcctcatggaactttccattctggccaagatgatagacaaggaacaataaaggatatatgtaataatgacagctggtgataactgctgtgaagaaaagtaaagcaggtgtgaggcttctagagggtggcatgtataaggtgggcagacactatttatacagggtggacgaggaagacctctttgaagacgtaatgtttcacccaaagaatggagccagctggaggtaaatctgcatccaaaatgtaaaaagcaatggattaaggcattcgaagcagtttctgaatcgtcaggaacactgttgat

SEQ ID NO: 89353 - DNA, 1069 bp, Homo sapiens
cattccactctgcttgggcttaattactcgtctctacaccttgtgttcattgtctctgtcacctggtaagcagggatgtcagtcagggacagatgccctaagtgtatgtgtcctgcatgggccgtcactaagctaggaggagctgcttttcccgggttcattggccaagcccttgtcactgactcggtgtcaccccaggtgacaccccaggtgaacacatgagcgcgaatgagacagtccagccactgctgaccctgctgcagagtccatttctggttcattccacctgtggctgtgacctgttttggagaggctgtgtgcttccactggtatttcattggatgtaagtcttagaagatcattatagaatagatcattaaaatgactgttttactttccatagagaacctagaagtctgccaaaaatttttagaggttcaaaacttgctaatctgttatactttccttcattcctttggtgtctccttatctaaaatatgggggactgtagaacgggaaagactgggagagggtgaggagcataggtgtaactgaggctgctacagcccagcagtaatgaagcacctgtttctgtacaggtggctgatgagggctccttttaaatctttagcatgggaatcttggatataaactttgctgctgttgggaagatgaatgaataggccagaaacaaaccagtcttctgtgtgtattagatgggagaagatgcagagagcttagctacataatgtcctgctgggaagaaaggtctatcagaaagaagcacatcagtgtcagtgtttctgtttggaaggcctggggaggagggaggggagacgggccctccctcctttgagagttactaagagttaagcttgtaagtgttaggggagaatattaggtctgatttttttaacaacttttttgggggaccttttttagaaaatggtcattctaaggtagagagagggtagtaatttaagactgctttagaaaaatttgcattgcaaatgctgctaaatgtcagcaagggactcaaaactttgacaccttgttggagctctttgtg

SEQ ID NO: 89354 - DNA, 1009 bp, Homo sapiens
gttgaggaattctcaatggaagttagcaaacgttttgtactaaatgaaaatacaacacatcagatttgtgggatgtggttgaagcaatgcatgagggaaatttctagcattacctgcatatattagaaaagagggaaataataatgtaagcacctaccttaagaaactagagtaagaaaagtaaaataaaaccaaataagtagaaggaagaaaataataaaagtagaaattgatgaagttgaaagcggagaaaaaaatagagaaaatcaatgaaacaaaaagctgattctgtgaaaagaaaaataaaattgaccaacaagaatgacaaatgaaaaaagagaagatatgcattgctaacattaagaatgaaaggggattaaacttcacttcaatgaattatgacagaatactatgaacaactctcagcacataaaattgatacattagatgaaatggatcaattccttaaatggatcatttccttaaaaaccacaaactaccaaaacccacccaagatgaaatgataacctgactagccccattactgtaactattaaagaaatttaatttgcagttaaccttcttaacaaaatatctccagccccaaacagttgcctggtgaattccaccaaacatttaaagataaaataaaaccaattttacaaaatctcttccagaaaacagaagaggaggaaacacttcccaattcattttatgaggtcagtattaccatggtatgaaaaccagacataaaatacactgaacaatatttattatgaacaaagatgcaaaaaatcctcaacaaatattagtaaatcaaatccagcaatatatgaaaagagtaatatgccatggtcaaaaaggatgcaagactcattgagtatttgaaattcagttagtataacctactgcattaacaatctgaagaagaaaaaacacaatcatatcagttgatgtagaagaagcatttgacaaaattcattcattcatgatttacaaaaagctctta

SEQ ID NO: 89355 - DNA, 1037 bp, Homo sapiens
gagttgctgaaagttaacaaaggcagtagctgccaagtttatttccagtctacatagttctaatgagatcacctcttatttacaaaaccaatagagtgtctgctgatactcttccctcacccccatctgaataatgagaaattgaaaagaacaacagatacatcaacccaagacccttagattttgagaaggaggcctcagtctcctccttaaacatacagtttggtcaatacagctgcaatgggttttccccaattcaaattaagaaatcagcaaagccaggggccctagcatttccttttgacaaagagtcagatttatcttaacctggaaaggttaccttgacatccagttgcctttgccttatacagtcacagagttgataaaggaagtactggagcagaaacatcttgtcactgtgttttcataattcatcatttttcttccatgaaaggcaacaagatgtgattttgcagcctgccagaggctcattatgcaatgcatatttgcagatatttgagactcatagccaggggagaaaataatgcattcgtagccaaataatgactttttaaaagaaagaaaaaagtgttttcaataaagtgtttctttctatttacaagagccaatctttaaactctccagtcagaggtaagaggcagatgccaggcccatgacttatcacaggatgtggatttttttctcttcatacatctggaattctaattaattggagtaagatgattcagtctatacagcatggccctttgtcacccagcacagagagtctgtctctttatctctatggatcctcttttggcccaaggggaaggcctcagggccctgagcctggcaaactctcacctccttgctgcctcttaggggtgcctcagggcgctggcatggaagcttccctgtctgcattgctctccaggttagcttgccttgctctgtctaagttcccatcagccccattggatctcatccttccatctgtgccccatattgctgatcacaggtctccagacttcctttct

SEQ ID NO: 89356 - DNA, 1046 bp, Homo sapiens
tggatcatctgaggtcgggagtttgagaccagcctgaccaatatggagaaaccccatgtctactaaaaatacaaaattagctgggcttggtggtgcatgcctgtaatcctagctactcaggaggctgaggcaggagaattgcttgaaccctcgaggtggaggttgctgtgagctgagatcgcgccattgcactccagcctggtgctggaaaaaaaaatagaagaagaaaatgccaatttgtagcactatttattgttatttttaattattttgagttgtctgctatattttacattctgtaagatttcctgttcgctagcaaaatcctaagggctacccagccttacacttggttactataccttctgcaaattgcattgtgtcataagcaggttggccatcaggccctgaggctggaccacatgggttcggtgctcatgacttcctgttctggtggatgtgccaaccatagtctccacactctcccttgaaggacacctgcaaaacaagacccagagttctgtacttagttaatatgtttgggcctatactttatttctggtaatatacacctcatgttacagataacctgttagaggtcgggaaggttgagatttggagtctgggatgtctgttggattgtttgataaccagttacgaaggctttagggcacactctgagctgcttgctcagaaattctgagcttaagtatatggcattgagatacaatgtttaaataaagagtttgtatcctaagtcacttgagatctttttttctttatagtaatacttgtatattctaaagtgctgatgagcttgtaaacaatgtggtaaaactttatagatcaagttatcttaccactttcgaattcagttttaataaccagcatccatttatataacatatatttatgatgttttagtggaaaatgaaacaaataaaatgaagcatggttttccaaccccctttgtaatttcaatcttgaggtttggaaattgttttcttttttggctgttgaatttttagaagagaaattaggaattt

SEQ ID NO: 89357 - DNA, 1084 bp, Homo sapiens
aagcttagggccggaatggggtttgataatgaaagaaaagtgctcatgagcttacctgggagaggtcagatcctgagcttgtctttgcctctacccagctcctgccactgaaacacagaagtctagctcctcctcctgttcttcctgtcttgttcagggtttccctggctccttcctcccctcccctctacgcttcattgcttatgacccccagatgtttctagaaccttctcccttcctctcctccatcccctgccctgccttactcaggccctcactaggtttaacctatgctcctggccaccctcccaaacagttcggtcacatccaaaacctgccagtggcttcccagtgcttatagcataaagtcagtcccctggctaaggggacccttcacccttcaactcctgcccagctgccacccccttctcccacctcggctgtacccccacccccttaccttgggcatgtgcttttaaagcccatgtatgcacctcttctctgctgtggtggtgttgcccatccctgtctctccaagtcggggttgcctgctcaaggatggggtctctgtctcccagagtgatgtcccagcactccagctggcccagagccagcaggcatgctgcaaacacgtggcgaagaacgagcttctgctctggtttactgtgtaacgtgctgtggaccccgtgatattgggaagcctggaattaaaatgcttcccaattaaaatgatttttctccttttgtcttttgttgtttgttttcttccccagtaggactcaggtattattatcatcatccccacaaagactcaagaacaaaaacttgacaatactttttctttttatgattataactgtaatactactgttacaatcataaaaacttgggaaaagtttaaagaagacaataaaaattcacctctagtttcaacaaagataatcactgttaacctgttggtatatttccttatagttgtgtgtgtgtgtgcgtgcacactatgcataaaccagccaggatgtgtcgggaagaaacgaggggcctaaattgcacttttgattcaaaccatttgtgtctgtgattt

SEQ ID NO: 89358 - DNA, 1045 bp, Homo sapiens
atctttggctccagagtaagcaaccaaaagtagttctgggtccattagcaccactagaaagtcttagtttcgatactttctcccctgcacattcttcctttgagccatgcatgggtaactcactacaacatgtgttctatgccaaggttttatacaaaatgtgaatgttagaagctgcccctgttacaaacacaaatggcggcatccagatatcttaaactggacagtgagacccaaggcctgctgatcagattgattgactgtcttgagagctgagatggttactttgcagtggttggaagaacaactacaccgtggtgtggacttcaaagtagtttgatgatcaatatcagcaaggagataattcagtagtcagcaggtgaaaggagaaagaacatgtctttgtgctcagttagcaagggtcatagaagattgcccagttctgactggctgggcaacttagccaaagcaaaaggctttctattcacttaggaaagccaggagatctccatattgagctacatttgtgccttttacgtcttgtagtaagtaggtacctattctttgtttaatcctcttaaacaaatccccttaaatcctgtcttctctgcttttcttactgtgtgcatctgcttcctggttcttttaaaattgcttcagcttaacccacttcctgccttctcagagatctccattcactattcagcagacattttactgagcatgtactatatgccaggcactgtcctaagggcatggagatcaacaagacagatactatcatggtccttgggaaacttttgttctcaaggccaaaatcagctctgacatagcccatccaaggaccagcatttggaaactactgtatttaggttatttccaagtttacttttctcaagtaaaaataagcaatatccctttgagatctttatagagaaagcacgaaagagcttcatgtcgcaaaccaccaagccaagagcaaggcaattcttatttcacttcacttcaaatattcatcttgggcctagaaaaccatgtcaaggtg

SEQ ID NO: 89359 - DNA, 1036 bp, Homo sapiens
gaggaaattgtacacaatcctctgaaaaaggcctgtatataaagccaccgaagatgctgagggtaggagttaggtggaccttgtcagtagtacttggtgttctcctgcttcatcatgtttgttccttgtctgtttcttgctgttacacttttcgaggattcctgtgttgtgagttcaggtgacaatgctttgcaataggctggtaaggatgatgatacggaagtggaccatcctgggcacggttcacagtcttgaagtgctgggctcggtaggatctgaaacaggaggccagagatgccactctgaatgctgtttgcttcattctttttggaatttcactttactggaattattacttcaacattaatttagtagcatttgagcaaaatatactttgcagcttgtaaagataggtgatgttttatctatctagattgatgattatgaagtgacttcatttacgaagcctgttggagggattttgcctgtggccccaaagtgacggcatgattttgatgaggtgggagtgcgatagtgggaatgcagtggtgaaatgctgattgggaaatgatttcttcctgcatagcttagtcacctgctcaacatctgtgcctcaaacagtacctcagagtcaagtggctcattgtgttctgtcccctgcagaccttgaaagacacagaagctgcctcatgtacatatatgcacattgctcttcatccctgcaaacgccctggccgcacctaacgctagcttatagcaacatgccttcagatgccacatatgaaggatttggggctagattttataactcagtcacccaagtgatgccaacttttgtaaagaagggagaaatatgttttagaaaggggttcatattgttctaaaaaaatatagggcagtctccactcagatggtccttttgcatcatttgaatttaactctcacgatcatcctctgtaagattcagacaggacaggttttattaacctcattgtacaagtgagaaaacagatggggctaagtgcctattccaaat

SEQ ID NO: 89360 - DNA, 1414 bp, Homo sapiens
attgttaaatgaatatggacgtgaattggagaaaatattttgtgcacccgcataaacatgctagaggatttcacaacaaccagattaacaaccattggtactatgagtggcaagtagctacttgggaagatttatctgatggtaagtgacttgttataaatgggattcactgacaagtgtggtgacctcctgacaaaagtatgattggaatacagccagtgattcagcagtgtccaagagattcatgctgagtgttgaatagcaaagggtggcctggagagaagaggtctgggaaggctgggagagtgggcttggaaatgggaggaactgtattgaataaaggcagaggcactgggacatgaggaagaagttactttgcaatgctcctggtatctggggcgggattggcttctcaaatattcgttgtgaccagattgcaaatttgttgtgggtttgaacttccctgaattgaatctgaggatctttctaggttctgaagaaattggcaaaattttatccttaaggccaagtggagctactgatgaatttcaaatgattaagtgaaaatcagtgtagtgtttctgcaggagcattctgggcacagcatggggaactcactgggggagagcaggctgcacaaagagattggtgcagggctttcgctggtccaggaaggagtggagggggcctgactgaagcaggggaagagagaagggaaagtacagggaggtgctgagaatgcaggaggctgtggtttgtaggacaatgactggattgcatggtgacaaagacaaaggggcctgaggtgattctctggcaatcagtaacctggggccagtcagtaagctcctggatgtatctatgggtcaggcagatggaaattcccatagtcagttggataggcacttctggaactccaatacctgtaggtgatggttgaagctctagtttagaggccctaacccaggaaaaataaactgcatgggcagagaactggctggggaaaaccagcaagagaatgtacagaactttcatctcatgaaatgaagaaactgagaacatcacccacatttcaagtcaatgaaccttgacatcagttatcatcaagtgtgactgtttctcaggctagagtggacttaggtggtatgagggctctggaagaaacaagctgtttactatgggaatggaagcgaacatacctcagatggaaaggttcaagttcctagttgaatcttttacttgctttgggaattttctttcagggccaagtttccctttgacctgtccaaaccccacatctcctgtaagatgcaccttctcctctgtgttctgaatgttcacagcactttctaaggctcgatttttgctggcagtccacgcaggcatgggtgtgggtcatccagctagagaataa

SEQ ID NO: 89361 - DNA, 1046 bp, Homo sapiens
gaggcaggagaatggtgtgaacctgggaggcggagcttgcagtgagccgagatcgtgccagcaacgaatatctgtggcttagaataaagtgttttttttttttttaaacacaaagtcaaggtatacacaaaaactggtgagaagcctcatagtctgtagttatcactagatccatttgttttacacctgaataaatctgtaaccccagttactaattgtgctttttttctgttgatgtttgtactctgcagacttgaattccattatgttaaattactccatgtttcagcagaaataatatgcttgaccctttaatatttatttgattctaaaacaaaatagcaaaataatggcttatgtattaaggtactagcccatagtccagcttcttgggtatattagggatccatgagctatactttatactcctcctaaactttgcatgctacagggacaataaatactttcctgtctaactttgggttctcaccatggaaacatcagagcaacagctgggctctgttagatgtcttttcattctcttggctggtaaaatcttttgcagaaactttaaaaaacttgatggctaacaaaactctacttttaagtgaaatcactgattcaagttggccagatatttgtcttaactgattacgattgctaattggaagttttcaaatgttaccttgggcccttggtgacctagaaacagccttaaagttaacagaaagtgtgagtcactgtgaggccaagatcaaactgcaatttaaggattcagtaacacagaaggctgcagaccaagactggagggccatgttctttaccataaatgtaacaaaatatttctatgaatatcttatatgtcctatgcattttatggaactaaatgggacagtttaaatgtctgcattttatctaaaccttaagacggctttttgactagttgccacaaatgggtcataaggcactgctcctccaggctttcaggacagcaggcaagtctggggtgactgggctctgggctggtcttctgggagctgtacgca

SEQ ID NO: 89362 - DNA, 1047 bp, Homo sapiens
cattgtgctgtctgcccttggttctgccctgccacttatgatagcaaagctacaacacatacatcatatgaagatttattgtgggatctgaggatgttgagcccaaagagaagacagcttgggatgtaggttcagatagctgtctttaaatatctgtgagacagccatttggaaaagagttggatcaaaaagacaaagtgcttttacatattaatgcattcctcctaggggataggtactgttagtgccccatgtagggatgagtaaagtggggtccaaggtcacagggctcaaaagtggtgactctgaagaccagacccaggcagtctggctccagaacctctccagctctacctgggagagtaaatggaatcaaggaattttggagggaggggctcagtgttttgttttaaagaggagaggcccatcggttggcaaggtggagggcattttgtgtggaccagaagtaataacacctgcaaactcctgatcaagctgagggaaggtggcctcatgatggagcttgtaggtatagtttggcagctgtgggagcacatggaggaaaagaagactgaggctggtagggggtggtgtgtatgagggtatactatgccaagctcagaaggatggctgagtccgggcatggtggctttgggaggctgaggtgggtggatcacttgaggttaggagttcaagaccagcctggcaaacatggtaaaaactcatctctactaaaaatacaaaaatattcatccatggtggcatatgcctgtagtcccagctattcggaaggctgaggcacgagaatcacttgaactcaggaatcagaggctgcagtgaaccaagatggtgagattgtgccactgcacctcagcctgggtgacagagtgagactctgtctcaaaaaaaaaggaaggatggcttagatgtgcttgtttgtggcttctgccatgacaggagggatgctatctcactgctctccttgtttctgctagaggcaccccgagtccagatccatctctcccttcttagttacataattctcaa

SEQ ID NO: 89363 - DNA, 1008 bp, Homo sapiens
cagtaaagatgtgaggactctggttgctgcagcagctggtcatcaccaaaaacctttactggatgattctgtgtggaggagaaaaaccacagaggaggtctgcccatggccagaagcttctgtgaattgcatgtagggggtgcagggtagtggcatctagccagcttgacaaagaaatttggccttttctgctttcttacatctccacccgacgtttaaagtcccacatttcagaactgtctcttgtctcctaacagactgagtgtgcttttcttcatttcagccagctgggtggttttttttttttaattattattatttcgttgttgttgttgttgttgtttttgcttcatcttcctgtttgtctgtaatgctcatctcacttttccatgttgtctgtgtgcatttctcttttcctggctttgtctcagggaggaggaggaggaagaggagcagccaatcacggagcccagttccgaagaagagagagaggatgatgcttcctgtcagggcaaggacaggtacctaggactggagcctcccaagctcacactaaaagtgggagactccttcctaatgatagttcactgccttctagtggccacctcccttcctcattgactcccacttgcaaactcttacttaccctgttcacagagccacagaaccactggttttgtagaaatacctgagcatgttttcattagagaactgcactttttattgaaatcctaccttcctaaccacactttatggaaaaaatcactggttttctcctcacctttccctccctcattgaatgctttagctcaaccagattgatggtgactaaaaaggctcatctcccctaagaagattcttgccctttcagcattgcagtaagaagaattccatatgttcctttcttcctgattttaccagcacaatattagctaaaatgtgtggataactactatattaatgattcaggtttgttttatatccaaacaggaaaattttcaccccatg

SEQ ID NO: 89364 - DNA, 1033 bp, Homo sapiens
gcatgagaccttgcttctagtttttccctggataaataaagctccgtcttctccctccagcatacttcttaaggaattccctcaggagtgatattttcctttgcttggtaccatggagatcttatagcacaaagcagtgccccacactgattccacctgctcaagagttttttttctttctaaaaatggaaggtgattttggaaggagaagctggaaaggactgggagaccctaggagcagcatgggaagatccatttttaaaaagagcagatatggaacttcaggatctgaaaattaatttcctctgatttccagaatggctttgtatacctccaggagttgtgaactgagcttctttttttttccttcttttttttttttttttttgtaccccaatcatactatcccagtgaaccaaatttgaattccttgaaactacaagttctctgcaggtctcttccaggtctacagttccaggattgttgttatctttcacacagtttttgcggaatgaatccaacatgactcttacaccttccaagaacaatatctatgtgcaagttaggagctgaacatttgactggaacaaaaatatgttggtgatctcatctttcccagagagtgtgttagcccacggtggtgatgctggtctttctggtgatggtctcggccctagttggggctttcctgggccccagacccttcccgtttggtctgcaagcttcaccgctatttatagtcgtgggggtgggagcaatagaaacacataagctgtccagttgaagatacacgtaagttgtgggggaaaaaaaaagctgcttgcttgtgaatgaaggttgactttgatttaactgagcaaagtttgtaaacttttaaaatcacttctccagcaggaacttggatactgtacaagtattgttcctattgatttttctgatgttcactttttgtggttttcatgggtctgtgtgaccacagatggactactcagtggttgactgcgattgaatgggttataataaagaccgacca

SEQ ID NO: 89365 - DNA, 1987 bp, Homo sapiens
gtgatcctgttaaaacattctgcaggatgtccacttgtggtgggaagggaattgttttagctgctggagtaggatgacaagctgagcatccaggcagctgctgacacaggcatggagcctgtgtggatcaggctgcatcagggtctcgtcacggagagtgctaggtgtcgtgcggggcagcctccttcccctccctcattgcagtgcttgctgcctggtttctttccctctttgctcattggctttctctcccttctctatttctgcctttgtaggttcctttcatcctttgcttttgtgcttcctatgtggcctgtggtttgggaaccctgttgaaaaattaaaccaacactcacttggagaagcaattaacctgtttgacatgtagagtgttgggtttttaaagagaaaatgagtactcagaaaccaagtcccacaaagatgatgtgttcacagaggataatggaatagagtggtatgctctgagcctctctctgtctggcactgagaatatgccagccatgtgacactaaataaataaggacagcaacagccaaactgaccagaattagcagcacaggatagatgcgggtcgtatcaatattttattttccattataataatgaaatttcttattgaaaactgaaatttcatctctctattcttttttaaaaaatagcccatttttatagtttttcctacacttagtttttgacttttgagtatatttttgcacagttgtgatcaaactgtgtatattatatcctgatgttttcatttagcctatattatcatttttcgtgttgtcacttataaaattggtaatcatttttaagggttgcataatagtccattgacaaataatatatcatactttcgtagccatttccacatttctacctggttaagtagtttttagttttctaccatgatctaaataatgttccactatttgcaggagctttctggaaagaaaaagaaaaaagataaataatgctccaataagtatcttcctgtatgacattttcagtatataaataactataaggttatttccttatgttatcttcccaaaagttgacttactctgtcgaaggatacactcattttgaaatcagtttgctttccagaagggattccaatttctgttgatgggcgtttggactggattctccatgtgcaagaagctctttgtgtccttatagtgactgttggggtcccacacattctaatacagtgtccctaaccagttcggtggacggggtgggtcctgctctgtggctgggtagatttgcgaggcaaagctctctgagcctcattatttgtaagtaatcctgagtgtctgagcccatgcaagggcatcaaataatgatttgttttctgggagtgctctgagtgatgatacctaaatatggtctgctaaaggacgtctagtctgaaaaacagaaatctagaattttacagatcttgaaatttaacttgtcagacatgtctggaaaatcatcaaatctcatgtaaacctcatggctgtaattttggttcaggggaaatgttggatgaaaacatgaatacatgcacctctaaggagcaggccagtccagaaagcctggggacagtttctcctcaatcactgaacatgtgatgggattacatttaatcagtgaaattgatatggaaatactaaagtggaattttaaataagatgtttctttagccaaccatatggtatttcttacagacctgtgatggaattaacactaattgtgccaccatgtgaggcaagaaaaatcttcatggttcaagtgaaattgatttggatttttaatttatgttagcaaataattttaacgtacattttaaaaaacaggaaatgttagggttttatttaaaccctttgtcataaatcttgctgcctaatggttttagactttgggaaactcctcttatgagaaattatcagaaaaaaacagggaacaaacctcttta

SEQ ID NO: 89366 - DNA, 1048 bp, Homo sapiens
tttaagcttctaatgatcctgttacccaaataatgaatgtattacctgatagataggtagaaaatagttttagattgaaagctgattctagctcatctacgtcttaacatagaccaactgtaaaatatatatagaatgtatatacattcctggaatacttctataactcccattcttgagggctgcttacatgtcaagcatgttgcttgctattttctgtctgttaccaccttttctcctgcgagcacactcacagtatgatacttttccccaatttacagacaaaaatctgaaacaagaagacccgaggcattcagtgattttccccaagcattgcctaggtaccggcagaccctcaattctaaccaaggtctgactggtgcttacttcagtacttttaatcacaggccaagcaactgaaacattaactcattgtatctccaggtcatcaccgagtggtcttctcacatcatccttcaggcagcaccaagagtcactggcagcagagagagagaggcggcggcaggagagagaagaaaggttgcagagaatagagcgggaagaaagaaacaaattcaggtaagaaggatcttaagattttttttaaatagtgagttaaaaattaaaggcatgtgactttacaactgtatacatttaatattggcattaaaggaagtaatgaaaattctgtctgtatttttaaggaagagaaagacatacctgaaataggctggatctggtttgttatggcttttgtttctctaaccatatggcaggaagcacagtcagccaaatacaattagggactcatgtattcttgggccctccattacctacctcgtcctatccaggccctccggatgacagagagtgtaattatcttaacttaatttgccatctcttcctaatggtcctcatgttttattcatattctatcagatgcccaaaaagaaatgcttttcccactttctggtttgctttttgatccctgtaacaatcttcaatattttttgtaaacaataatctcttgctatgtggggggaaaagt

SEQ ID NO: 89367 - DNA, 1021 bp, Homo sapiens
tgactttgcactgttaacctagcatgcagagagactgtcgattaaaatataactgcttcacctaaaaccttacatagctggcattttgcagaacagagtgtactagttacctaaattttccaataaaagtatggagttgtcatttggtgccatcatggttaagtgtgtctattccttcaaatgagcacgtttatgttagcataatgacatagggcatatatttgaaataccctgcaccaccactgctgagcctggactacatgttcctaatgcatgcttttatgtcacatggtcagcactccttcaagaaatattttagtatccacactgtgccaggcagcagctgggggcactagatatatctgagactctttctggatgtgcctggtcacttacctgtctccctactgaactgtactcagctcctcgatggcaggaacaatgcctagatttcctttatttccccagtacccaccacagtgcttggcatgtagttgggacttaggaataatatatggaatcagtaaatgagtaaatgaaccaacagctttatttaaaatattcaagctgtaaactactttatttctttttttcattttaaaaactacttcatttatggtacgaatctttgtggtttgtgatgctaactagaaaatgcatgaatacatttttaaatttctatccacagaatatttgtatacaattttgtaagaaaaacatatatgagatacattactttataagattaagaagtatgttattaaaatgttgctgtaatattcgaaccagcctaggtcatataacagagcagctcaaaactctggtgttgatcagtagtatatttcaatggcaacatgctttgaatctcaataaaagatacaaagatgttcagtgtctaataaatgcagagaaacagtggaaactggttttacaagtagactggcaaaagacaagttttcacccccagctctttatagcctgcagttgtcccctctaccaccaggtggggtgactgcatgga

SEQ ID NO: 89368 - DNA, 1056 bp, Homo sapiens
taactttcagatacaaatacttggaacagttggcagctgaggagcacgagaaggagctgagaagccggagtgtgagccggggcagagccgacctctccttggacctgacctcgccagcagccccagcctgcctggctcctctgagccatagcccctcatcttcagactctcaagaggctctcacggtgtctgcctcctccccaggaacccctcaccatccccaaggtgagtacagggagagtagagggaaaatgaacaggttaacatcagacaggcttcctcagggcagtagtgatgatttcaacctgcaggctaatactgagacagcaactatgggtacactttgttgggggaggggggttgtgactgcaactgcctggtcactaacaaactagacgtcttcagagccacttatattaaagcaaaatgattcatcaaagttgtcaatgtatggccatggaaaaaggagaatatggaaaataagctttactttaacatttaatcctaaatactggaatattcatttaatactttatcattttgagatgtgggtctgcccaatcaagtgaccaacattcgaatgttcttacccgaggaactgttagtctggtttaaattaaactgaaggagaataaaattaattacagcaagcaaagaaaaatgtggacctagtgaaaatagaaggtaaatatggaagaaggaaaataattcaaattgtaaaaattactggcacatggttggatgtgggtgtgtgtgtgtacgtccttatgtacagacaggcaagctctcctgggagatattctgtcttcttcactttatttggagaggcgcgatgatattgtacactgcagccttgagcatcagctgttttcctgcctgctctgcatactgtgggtccgttttctttcacattaacacagggatggttctcagcagcgtttacacagtgtgtgttgactaaccctcctgctagcactgtttgctttagtcaagtgttatggcttacagcctgatgtagacttagccaattgaagacagcagaggcattaagctttt

SEQ ID NO: 89369 - DNA, 1039 bp, Homo sapiens
atattgcacacagaaataatacatcacagatacatttgaaaatgatgccacactatattatttttatttatgtcaaggaaaaatacgtttgacagtgatttttttctctacctgtaattggattccagggtatttccaaatgtctgattgtttggccctggggatatatacggcctatatggccatggcctactcaccagcagacattattgacaaaggttaatgatacttcctgtcacagatgcaggcatttaaagtatgggtaaatatggcgattcctgtagcctcctgatcctcaaacctggaaataaaatttagacatagagtatcatgaaatgtttagtttgtctaaatgatttttcctgtgggcatccatttgtccttttggctgtcatcattgttagcgttgactgtctttgtcatcttcgttgtggaagatgttctgagtctccttcaggtgtagggactctctgaggttatctaatccacacagcagaaatcagaaacatctggtatcctatttccaactggcacggtagcaatggaatattgtccatcatcagcctaacactgcatgctagttctcttgcataaaccttttggatgcctccagttcagtgtttcatgaattggcaggaaactagattccttgtggttctatgactcagggctgcctccctccctgcctcacctgactgctgctacttgataccattttgtcaattggacaaaatctttcagcaactctacccaaggctgaggtcctacctgctacacctgctgtgggcagcctttgcaaatcatcgagtttttctgccttgccatttctcagtctctaaaaatttccctttttctcctcatagaaatgacagttgtctgaagtgtgtcttcttgcatcatatttggaaacattaattgggattgagtccttctgaagtagacaaagtatataccttaagtaaagataggcatagaatggcactggaaaagttggtaaagaagagcattatttctaaggcaagagaatagcttgaaccca

SEQ ID NO: 89370 - DNA, 1023 bp, Homo sapiens
aaaaagaaagtgcctcaggagctacaagacctcgcctggagcaggcacttgggatgaacaagtttgctgcatctggagacactcacagagaatctggcttgttggctgggtgagacatctgcacctttcatcccaggtgggagccttgggtcagtgctttcaggtgcagtcaggaggctccacatgtcaggacaatgagggttcttgagccacagtggtactttgaatttccagacaatgactgagactggggaaattagcaaaggagaataactctggggctccttctagcatccttgtccatgctcaagatcttaatcactactctgctatctccaccactccccctttcccttcagcagccctgctttcccccatccatctttggaacacatttgttcaaaatgatacaacacctgcagtatggcaagacacactcacgttgactttctggtacctgaaatacactttttcaggagaacctctgggttcagtgaccatgcagtgtgtttcatctgcctctgggcatgatatgcatctttggagccttttgaatttgtaacttctgtgagaaggctgcctctgccagatacatcgggaagttcaagtcgctttttgttgactttctggatccatccccctctggatgcctctttgtcctctagatcatctccaggctaaacaggatagttgccttttgagtcgcgtgcatttctcattgttttctcaacatttgtcttagtcttttctcattgtttggttgcaatcctctcactgactcctcttctgccttttcactacgtggtgggtttttctgaagttcctctccagctcctctctatcttcatacacatcctctcactgggccctcgcattccacctgtgatttttacctacctcccatatgccttgaatccctgaggtctgtactgccagccttggcctccctgagctcagggcgtgtgtattgcacttccccagccatctccactaaatgcccctccaactcttcagacccaccaa

SEQ ID NO: 89371 - DNA, 2051 bp, Homo sapiens
cccacctttgttattcccagtgcttggagcagaacaagcattcagtacatgggttatgagttggcgaatggtcaagcatgacaaaagaaagcagactcatgaatctgcagagacagctgtttcctctctacccaggaagaaatttattacatgagccatgggtggaggacacatctttgactatgcaggccactccataaggactgaataaatgatgttggtataattaatagagaggaaacttttacagagagttgacatatctgggccatttctttctgaggatctgactctaatagaatagtcaccctatatgttatcaatatgagaataattgaacctgaaattgcttcttttttatcctgtatgatactacagtagcattatatacatatttaagcaagtgaacttaatcagaagcgtaatctgaggggcaagagtgggaagtggaaattctaatttaaatagcgcttttaatcctgtctaacattcatattaagtgcatgtccctgagggagcatgaccacaaggagcatagatcttttcttcttttccttgaaccattcctgattccaacgtgccccttgtcgtatgaacaatttgctgcttcaaatgtgagtttagagtttacagatttgtatttgggggtaacacagcccatgaatgcaatcccagcacttaaggagttccactgacgctaaattaaaaccgtgattgtcaaaaccatggagaagttatgggatctataaggtagcactgtccaaagggacttttgaaggtaattttgactatacatggtcaaaattgttcgggtcaagcaggttcaggcctaagccatctctgaagtcatcttcagtggggcttaggtctgaacctctggaaaatcaaactctgaaacttgaggacaaagcatggcttaacttttaaggcataaaaattaggctattgaatcagtattttgcaagtgataagctgtctcttttgtgaggcttgagtagaatttcttttgtgaagctgagtttgtgcccatcctcatgcaactattcctgtagagcagtgattctcaaccaggggtgagtttgctctcctgggggacatttggcagtgtctggagacattttcagttgccacaatagcagaggagaagtggaaggttggtgctgaagcctctagtgagtagaaaccagggattctgctaaacatcctgcagctcatgagacagtctcccagaagaaggaattattcaacctagaatacccaggtacccaggctgagaaaccttgctctagagtgaatccaagtgaacaacctaggaagaactggtctaacaccaaaggcaaagtctaaaagattttgaaagttgtaagcttttttctcttgggacctttttcagatttctgtgattaaaacacacgtctgtagtcaatcgtgttagttattagctctgagctggggaggtccctggaatctacacagtttggagcaactattatagaactggctggcccagcccttggtttcataagacctgccagaaagccaagtcctggcagagtcatctagacactaccacagattgaaatcaactgaagccacccagagatgtatcaagttcagaactttctaccaccaatttatcacttcaaagaaaaattgcataaccagaaattctaattggacactctgaactcggctgtcagggacgtggatgaaagcaacattgaaacattcctgcccactgtgtgtgtgtgcgcgtgtgtgtgtgcacgtgtgcgtacacgcttaattccaggaatgattatgtacttcttgattgcttaagtcacccaccacacagtatagccctgtgattaacagcccgagctttgcagtccagccaatccaggttcaaatgcaagctctgctagcatgagctctgcttagcagtgaggtcctgttggtcagagggttgctgaatatattcagtgaagggactgtttacagaggtatagggaggtcatgggaccatcaaaatgtggtgatgcttcacccagagactagcggtcgtggga

SEQ ID NO: 89372 - DNA, 1199 bp, Homo sapiens
ggacttcatacagggaccagctggccgaagtcctcaggccggctcgttcctcatttctctcctcattttgcgacctgcatgaggaaagcatggtcacattctccatctgacggggcagcctttatattcttacacctaagaaaagcacttagtttctccccccttccatgggttctcatgttgatgggttcccatcctggtttcccaaaccccactcactccagtaatgtctgtttctttggggtgaagaattccttttagtggctgtgttctggttatgggtccttccccacagggtggttggtgacagcccagtaccctgttatgtctctttgaggataccctggaccccttcttttctattacttcttccaccttgcagaaagtatccattaccacatccttttatgcagtttagtgttgattttcttctttggcccttctattccccctaccccaaccttcaaatctagctgcaagccctcggagccaggtcagtgcaggctctggccaaacacatttttctggtctttgctaagtgcatcctagcgatgctgagaccccatcgatctgcgctcttgggctgtgacccaggaagacagatcccagttttggatgcctgtaatgttaccaggcattccttgccatgtcttccttttatttccaaatgcacgcccactgctaggagaagggttgcctgggcacctggcccaagtccttcctgcagttcccctcctcccttgcacagcccaggagatgcaatcagatctttgtgtccttcctccatccagggtggttatggacaagcatggtgagccgtggcatctcttgacctgctgggtttggggtatcacagtcactcctgagcctcccttgaagatgcttagaggcattacatgctggggaagggacactctgctccttcctgcctggccaccctggcacgggccttcactgttctctcctggcctcagctttctgagggtaataccagagccctccccatagagagatcgtgagggcttcggaaggcagttcctgtgaagtgctcagtaaccattcctcaaagggagccagcagccctgcggaactccctgccccgctccggtgtgaacacggttcctcccccagctgatgtctgggatggaaaaacctcctgctgttcagagtctcagtcccttacccatgtgttcttccag

SEQ ID NO: 89373 - DNA, 1009 bp, Homo sapiens
caggtcccttccagcccctgccatgcgtagaccctgccagaatttctgtgttgctttgagcagtgtgtacctagggttcaagcacacacccttagagtgcattgccagggttccagaagagtgggctttgctcagcctgagggcagttcccttaagagtgagccaccctcctccagccttcatgtgtggcagttggctcagaattttgtgtattctcgatcattttgctacacatccacagctcatagctgagggttttgctcagaaaaaataaataaataaaaataaaaaaattttaaaaaagcataagccagattgtgccatttccctgttccctagagtgtcacacgagtgagaacatgatcatcttacctcagtgacagcatcaaatctccagcgttgataggtttgcaaatagactgtgaccatgagtgattcttccaaactgctttcaaaatctcaaactaacttcacattatgagcaaatataacccaagaaaagggtgatgaacctcactggttcagccaactgatttcaggacacattagctgtttttcatcagcttgatccaccatggattttgtttctctttccctaaacaggcaaaaaggttatatattagtttcgtattgctgtgtaacaagtttccacagacatagcgattggaaacaacactcgtttattatctcacagtttccatctgtcagaagtttagcacagctcagctgagctcttgaccttgcctgtccactgccacaaggctggaattaaggctgcggctggctgggctcttattgggagactctgggaagagtccacttccagcctcattgagggtgatagcaacatccagttccttgtgcccacagaactgaagtccctgttcctggtaggctgttgaccagtggtggttctcagcttctagaggccacctgcattccctgtcaagcagcagtgatgtggcagatccttctcctgcttcgaatctctgacttccttttctgctgc

SEQ ID NO: 89374 - DNA, 1062 bp, Homo sapiens
tcttcttgcccaagagcgccttgtcagccacggctttgactgctcatgcagtgtcttctctgaagtcactcccatgtgtcaggctcacttattctcatcgattctctcatggaagtgaggcccccttgcccctttctcatttttctctcccatgtactttcaggtttgtggcccgcaggtgtccaggatgcaggtgtaaatggacagtgtggcgacatcctcaccaacaaacggttcatgcttgacatgctgtatgcccataacaggaagtctccggatgatgaggagaagggggatggggaggctgggaggacccagcaggaggcagaggcggtagccagccttgctaccaggatatccaccctgcaggccaactctcagacccaggatgagagtgtcaggagggtggatgtcggctgtttggacaatcggggcagtgtgaaagcatttgctgagaaattcaacagtggggacctggggagaggttccatctcccctgatgctgagcccaatgacaaggtcccagaaacagcgccggtgcagccgaagacagagtctgattacatctgggaccagctcatggccaatccaagagagctcagaatccaagacatggatttcactgacctgggggaggaggatgacattgatgtcctagatgtggacctgggtcacagggaggcccctgggccacctcccccacccccacccacctttctgggtttgccgcccccaccccctccgcccctgttggacagcattcctccccctcctgtccctggtaatttattggttcctcctcctccagtgttcaacgctcctcagggcttagggtggtcccaggtacccaggggtcagcccacattcactaagaaaaagaagaccatccgtttgttctggaatgaagttcggccttttgactggccatgtaaaaacaaccgacgctgcagagaattcctgtggtcaaaactggaacccattaaggtggacacttccagactggagcacctgtttgagtctaaatccaaggaactgtctgtctcaaaggtactgctagtcttc

SEQ ID NO: 89375 - DNA, 2368 bp, Homo sapiens
gggctgaagagattcgttctgtataaaatactattttgcattgcttttgctatttggtaaaaagtccattggtatgaaaatttgatctttaatatagtgttccttctgccacatgctaggtgtaggctacatgagtcagagacccttattagctaacatggtcaccagcttacttatattaggcaaaggagctttcaaagaaccagatagccctgaggaaaagacaaaaatggtcaactaaggaatgtcagcatagcccaatagcagatattgatgttaactagagaaagtggacttgctgactcaccaaacacgggatatgcttatttaatcttaccttcattgactatgagtgatagtagtagtttgaactttatctgtaaccacccaataagctcaaaggcaataatccaactgacatttctttggcttggccctgatcaagccagcattctgcagctatctagttttccagcagccgtatatttggcatcctgtcaatattacacatgcctctagatttagtattttggataaatgtttgagagtcctatagccactgctgctgtgatagtaacaaagatgttataccacttttatcaatggaaacactgtacataaagttattgggcaccaaaggttaagtcatggttaatttacactgataaactgcaagatatgggatcacagattttatatctaattccctacattagtagagacttcttcgcctatcttagctgacttttaaaaacccattctggatattttccagttttaaaacaggtttaaggttatctcctcttttaaggtataaggggtaggagaaagcactttgtaaagcataatttagaataaacatgcaagagcttataatcatgaattaattttaactccctgcgttgctgcatgcatttatcatctttttgggtgagtatgaaactgtctgagtcaggtttccagcaatgccatttgggcaccaattctgtatcaaaattacatgcaggatcctcagaacaagtgagcccttcagacgaggagcacagtgacagagttagtgcctgtcactgctgtgggatgttgacaggccagccaggggagctgtagttgatcagcttcctttcaaaatgtgctgggattcttaagctgcttgctgcccttcactgattggtgtttaccccagtgtgtgtttctcactcactcatggcatgagtctaaatcatttccagcctcaggaatctcctcaagtcaaaattaaagctttctcatttacaaatctacaccgttaggatccagtgtaaaaaatcatgcccaatcagtcctgtccttcagttgaaagtagacccagcttttgtcctctccagaaaataacacctaagaaagggttgccagacacccactcttggtgtgtctgtgtcctgactttctaggactggtaccaagtggtgccgagccatccacatgccccgttccaattctttttttttttttttttttgaggcagagtcttgctctgtcgcccaggatggagtgcagtggtgtgatcttggctcactgcaacctccacctcccgggttcaagagattctcctgcctccgcctcctgagtagctgggattacaggtgcccactgctacacccagctaatttttgtatttttagtagagatggggtttcaccatgttggccaggctggtctcaaactctcaacctcaggtgatccacctgcctcagcctccccaagtgctaggattacaggagtgagccactgcgcctggcctcccccttccaattcttataggcagcctgacatttaggagaagaccagccacgattaagacagcagtctgtggttgctagaagttacccatgacctgacttgctgacaccaccttccaacctactgacctaattggacagaatattcctcctccccctccttctcctcctcctcctccttctcttcctccttcttcttctcctcctccttcttctcctcctgctccttctcctcctcctcctcttcctcctcctcttcctcctcctcttcctcccctcattgcccacttggctggctgcacctctaggcttttcgtggttcccgatcaggttgctgggaagaagctgccccttgactcagtattgggaggaataaaatggagtaaaagtatggaggtgaaggcactcctagcttcatttttacaagattaaaagtttcctcgagaaggcccaaaattaatgcttcacctacctccctccttctcttggtcccactgcagccaatttggtccgtgataatattctagcctcttttgtctcagcccaaagttccatgattgcctgaagcaggtagtgacctctagaacaat

SEQ ID NO: 89376 - DNA, 1484 bp, Homo sapiens
ggggtgcatcctctgatactagtaaaatactctttaaaaatgcaaaggggcaatatgatgtggcaacatttcaggaagccttaagcttaatgactactattaactatttaaatttttctttccacttcttttcctaactgcaacctgaatcctcactcttctttttccaaaacggaatgtctctgagggggaagttaggtctttttctttcccaggatgcctactgaaactaggttgtggtcactcttgcatgatggtcactcttttccaataaccattccaaatcaagtttgagtctttacttgcagattcttaaatacttttacttggaggtttaatttgttctatccgaaagcctgactcgggcatctcctctgcatgggcattttgccatctgtgtgcatcaaggattggtgtctcaccaaggatccacctgggtagacttgtggctctgcagtgcttatatccagccgagcctaaatatctggcttagcggttctagaaaatattcctattaccatgtgtgactttctgccccacggagtggctgagtttgcaggctcctgcctcctggggctgctggttctagaaagcggactcccaacccaggtagctgcccaccagctgaatctggggctgccgagaacaggcacagctcttcccgaagctttggcagttgacagtcgctgcctccccttctcaggaatcctgtgactcttctagccttgagtgctgtctgtttgaagcctcaccctagaggggctcacctgcatcttcctagaagctggacccagtccctgagttgccttaatgaccgccctcctgctccctttgagtttcctgctcgcctagacagcctctctttccacaaagggtaacctctgcctctccctcatcttggctgtgcacacccctgctccctctccctgcagtgttcttagccaagtcaaaaacaaaaacaaataaaagccttacatggcattcatcctgaagcttttctccggagactgtctttcctccaggggagaagggctactacgggcatgttggaggctcccggtagttggagctccgaaggaggagctctgccgtgggcgttcagcttaactaggctttctggaaccaaaacagagcctggctgcttcccaggcttctccctacacccttaaagaagcaaggtcctctctttccttgagcacttctggacatatttgggaaagcagcatgttcagagatggccctgccatggtttcccacacactatctcatgtccgcctttttgctgaccacccaaagatagttgttcctgttttcacatccagccaacccctagtctagcatcctgtacctggagcctgggctcaggcacctccttccatcatcacttcctccctgagagttcttggaacttgctgaggaagagggcagagctttggctaattgttcttttatcgacaaattaagacaaaaaacccaatgtcctg

SEQ ID NO: 89377 - DNA, 1050 bp, Homo sapiens
cgtgacctcatctaaacctaagtatctctaaaggccctacctccaaatatcatcactttgggggttagggcttcaacttatgaattttgaggggacataaacattcagcttataacacgtgcttgccaagctcccatcttttgctaattctgggctggctgcagagataggtgaagcccaggacctgcctctgaggaccacacaggccacctgggaagccacacataaaagggctttgagaatgccaggacacttcttattccctgctctccttctaggcctctaagctggttcgtcccctattcatcctcaccagtgcatgccctttcctttcttttccttggaaggctcctcttcattcatctaccaggcagctgcacagaggcctaagtgcacaggaaaggtggaggtgctctggtataaggggcatggaatgtttgaatggcaaggtgagggctttgagacagtacagctgtagatctggaggggctgacaggccaatggtgctgtattctccttattgatcctctcttctcagcatgtaaaccagctctctctgggcacgcaccatatgtatgaaggccaaccaagacattcggacacctcaaagcccacaagaaaggaattctgaaaggttttgattttgttttcactgcttctatggaaaaaacagatttttttttcttgcaaaatatcacattttcccaattgaaggaaaatccattttatttttgtatgtgtctgactcttgaagttctgttgctgacccaagcttggcagcatctcagaactaatccctgatactttctgtgctgaacagtagccagtccttctctgagctgaactggggccatttgttttcatctctaaataagtagtgagtgcttttaataatgaaatgcagaaaggacccaagatgatgcattaatcttggattctccttttttatcactaagaaaactgctgcagatggaaaaaggcaagagatcattgttctggattccaagaggagtaacgccatcaatattggtctgacggtgctgccccctc

SEQ ID NO: 89378 - DNA, 1077 bp, Homo sapiens
aatatagtatgtctctccatgtgtttattatttgtttctatcttcgattgctttcatcagcattttctagtttccagcataaagacacttaacaggatttgttagagttatacctatgcgtttcactgtaaatagcatttaaaaaaattttagtttattataaatgtatagataacgaactaataagatggatttttgtgtattgaccctatatcatacaacattgttaaactcacttctttgttttagaaattttttgtagattccttatagttttttatgcagacaattatgacatctgtgtgtatgagcaggtttttcctttccagtctgtatgccttttatttcttttatgtgcctggctaagatttccatatggtgttcaataggaatagtaggagtagacatgagaatttttactttaaaaaatgtaatcacaaaggaatttgagcgtaggagaatcataagtattctggtgcctttttgccttctctgccttccacaattgatttttaccagaaacaaatagaagtaaaaaggtatacttttttattagcttgtatttatggataccgtcatgattttttctgcaatcagacttaagtttagtattacttaaggtactatcatttctatgtaagttttgaaatacagttaaaatgattatatgtcacatgaacaaaagtcaatctgagttctttgaaaatgattcatttttataagcttttaaattaatgcaggagaagtgctacaaagcatatcttttttacatgtcttactctacttcctagggaatagggagctgttctctaatcttgtgttttgtttttcatctttctctcacctctcatctccctttcttgcctagaatgtcctatgtgtgtgagaccctgaaaatttgggtcaagttgcttcaagtatatttggtttatgacaatataacacctgtacatacctctactacctggttggaaaattataatatgaattttataacattgaagggacaggggagggtccatcactaagagaaaatatactatatcatctcctatttccagaaaattctaacgatga

SEQ ID NO: 89379 - DNA, 1549 bp, Homo sapiens
taccatagtttctctcttttcaaatgtatatctggatctttttcagacctttacttgtttgttgttactctccttgtttgtaaaatacatgcttaaataacatttccaatttatatgttaagtttggattccctgtgcatccaaaaacaatgctctagaaagtgtaggataaagaatcttgggttgtacttatgtataaaataggacccagaatgttaatctattagaatgaggtgaagtggttagctagctgcaggctgatggattctcccctcaaatcttcctgcatacagatcttgaatagttgttatattatactgtactgtcctatcctaatatcatatcatatatctaatatataatgtcaagtggtaataacagccaggaagaaaaaataagagtataaatggttaggtagtgacctgacacagggtggtcatggaaggcttctcggaggaggtggtattttgggcagagacctgtggaatgagtgagagccatccatgcagctgtcagtagggaaaacattctacacatggggaacagctggtactggataccttgtcaggcctgtggtcctaccctgtggagtggcctcctcacccctccccacaggccctgcaggctctcagttccttggcctctgtgtccctccagggctcctgcacactacacatggtgtctggggctctgaggtgggctttttcagggaataaccaggattccagtgtaactagagtcacaagagatgaagtcagagaggtgatagggctagtcgtccagggccttatttggaaatgctatatttagtttatccatgcattatatccatccaatgctatacttagtttatctttccatggacatttgggttgtttccactttcagctattgtgaataatgcttctatgaacttttgtgtagaaggttttgtgtgtacacatattttcatttctttttatgcaaatgagaaaaattgctaagtcatgtaataaactctgtttatctttttgaagaactgccagatcattttctatggctgctaaaccattttatcttcctaccagcactgtggaaagggtccaatttctccacatcctcaccaacatttgttctagcctgtctcttttattacagccatcctggtgggtgtatgtggtgtctccttgtggttctgatgtgtattccttagtgatgttgagcagcttttttcatgtatctcttggccgtgtgcatatctttttaggagaaatgtctattcaaatcctttgtccattttttatttgtctttttagtgttgcgttgtaagattcctttatatattctgacacaagtcccttattagacacatgacttgcaaatattttctcctatcttttagattgtctttttagtcttgataatatcctttgaaacacaaaagtttttaagtttaatgaagtccagtttatctactttggtcacttctgctttgggtatcatatctaagcacattaatccaaagtcatgaagatttctactttattttcttctaagagtcatgtagttt

SEQ ID NO: 89380 - DNA, 1032 bp, Homo sapiens
gtgtggcttgttggtttctttattattattattattattattattattattattattatttattttaagttctcacattggtttcttactgagagattttagacaagtaatttttatttcttaaaacggaagtcattgctattactgttttttccttgcagattccactcctttttactctttatgggccatccaccttatgcaattcgggaagtgaacataaacaaattctgcaggattattagtgaatttgcactagagtatcgcacaaccagggaaagggttttgcagcagaaacagaaacgggccaaccacagagagagaaataagaccagagggaagatgatcaccgatgtaagtttcacacaatccctctccttatgtcattcgttttcaaagtaagatcagtcaggaatcctccccacagttaaaagctgtgcttttttttttttttttttttttttttttgactataaaaaattatctcttttaaaaagtgctcttaaagtactcctccaccatttctgtgaaaatctgctaaataacaaggagctaggagatgtaaagttcagaacgtgtggctagaagaggaacatggaacccattttggtgtgttgcatgttgctgatgacattaaatgtttgattctatttttgtcctctgtgatgtgggtaaagttggatgaagacaagtaaaatataaaagataatgccgcttatcatagaaagacaaatgtactgattggggcattgattcagaattttaatcatcataacggtgctgtgtaaccaatcagttgacacatggaccacccattgtgggcatctgaataaactgatgtgattgctccaagatacaatctaatgggctcttgccagtcccttgaatcacaggacatcagggtggaaagagttcccagaggacagtgaatccagtaggagtttccccatagcaccctggggagcccctgcacacttacatgtctcccctgctcccgggctctttccccatctctcctgtctcagccccaag

SEQ ID NO: 89381 - DNA, 1825 bp, Homo sapiens
actcgtgaggtgggctgtgagaacccaggctggtcaatcccaggcctcccacgttggagggcagtggtaatcctgggtgagacccttaacccttctcaatgccagcttcctcttctatagaaagggaatgatgattacttttagggatgttgagcgggccaatattttatatatgtagcaccttgaacatgtgtgaatttctggaaaaatgccagccatcccaggttatataaataaactgtaagaattttttaaaagagagtaatggaacaggactgttgtctcttgtcacaatgccatttggatgaggcagcgtggaatgttacggactggaagtggtttgtcattttaacttccaaaagcatagttcattctcaaaacacttcaatctgatttgctggcctggccctgtaacctcacagacactcctaaattgaaagtgtgtttaatttatgatcaagagattgacatgacttttcactctcaatttatgttagaagagagatattttatttaaagtaacttaaagcagtttagtgctaaagtaattaaaagtatggagagtcagttcaggtggctcccatgagaaacaggtgagatgttaaaaataaattaatttcatgctcctgaggagagagtaatgtgaacacgctgctggagcagttgtctcacttgtcctggctggcctgcatatggaaggaccagcggtagcccagaaccagcagcctgggcagggagggatcctgcgctcgggatgggatgggagggccggcagctgacaggcagagccaagcaaatggaagccagtccacttagaggggccttgatgactgtcaggccgtgatgggttcataaggatgtggccagccaagccatatggttcacagagcaggacactctcagcacgatgcacagctgcgagtgacgttggtggtggtcagggaatcgagttagctgactgttacctcagggacagccccagaagattggcccggagccgtgtgagtccctctggtcatgggtgatcttggagttcacacaaggagtgtccagatgaggacaagagggtggggcctggcagctcccaactcaagaggatgtatcctggttgtggtgaccagtttatttacttggaattttatgtgacattgcgatgatctttttgctgacttctgtgccttctaagaatcccttctgtcttttccgtcctgtcctgtcctgtcctctcgggtagactgatgaggaggaggaagttgaggtatgaccatttatgaacatgaagaatgccacattttaccacctcatgtatgctctggtctaacctaacataatcagcatgaagtgtcagcaccattcagtgctttaaacaatgcatggacatttttctggttggttttcgtgtgatcactaaccacctgacaggggctctcatcatgccacgtttgccagggactgaagggttaaatgcattttccgagctgtccctgaggcccagctaatcagtaaccatgtcacaagtggcaggtttagcaggtctctccctgctgctggaaaagtggacagagaattttcctttggcaacttaaatatgagaactagattctggaataaccacatgaagagtcctgaaatcaaagaggaagtggggcagtggccaagggccaggctagagtctctgtccccagccagtaggcagcctctgatgtgtgaccatttcctctgctggtgttaatggctcccatgggccaacgtccatgcagtggcagatggcaggggctcttccctagaccctggatgcaggtgcgagaaccagagaccaaggggg

SEQ ID NO: 89382 - DNA, 1064 bp, Homo sapiens
acacagtgggtcaaatacaatttgtaaattaaggaaaatgtaattagccaccctttcaaatgaagacttgtcttgggtgaggcagctacctcctcattcacccttatccagcctttattttgatgttgaaattgaaatactaaacaatgggaataccatcatgccaagctaaacacaagccaattctaagtcagttaaatatgagcatccctccagttgccaactgcaaccccccagtgagagtggtcattggccattcttgagtcttgtgtgttccatagaaaacagccaccaattccagccagaataagtttggcagtttgctccttagcctccattcctcgaggagccactggttattttaattattgtctctagaggccttttagtgagttgaggctaagacccacagtactcatggagagatttgtcctcactgctgccccttgccctggcttcatgcacttgctctgtgggtcttgagcatgtccccagctattgttggtcgtctgttggatttgtgaggttgttgggtcttgtggaacccctcgctgtgcactggttgcctcacctcatttgtattagtggagcttgcattttcccctgctctggaatcaccttcccagctctgatacactcctcatactgggtagatgctgaggtctctcctgccctctgcacttctgcagttcacccccttctcagaagcctcgtgagggtgagcctctcctcctttctctcctctttataagtgcccgcatcactcctctcggccctccaaatcagcacctgtggcattgttaggccagcctgtgtagccccaaacttttgtcctggcagacagactgcagggcacttcagcaagagcaggaaggtacagagtgtgaaccctctggcttctctggaagtccctggggagaaggggggactggagtcttgactgccctgtgccttgctgctcatacttccttttcttctcatccctttgggtgtgacctgcaccaccactgcagtgcgaagaaccctgaagagcggcctgaccccagaagaagccagagccctgg

SEQ ID NO: 89383 - DNA, 1005 bp, Homo sapiens
atcaccagtgacattgtagctgtcataatgtcatagtgcactgcattactcacgtgtttgtggtgatgctggtgtaaacaatttatgctgccagatgtataaaagtgcacagtaatgtcccaggccttcacattgactcaccactcacctgcccagagcagcttccagtcctgcaagctccattcataataagtgccctatagaggggcaccttttatctttgatactgtatttttactctaccttttctatgtttaggtatatttacaaacacaaataccgctgttacaactgcctacagtattcagtcagtgacatgttcttacggatttgtggcttaggagcaacagactgtatcatatagcctaggtacataataggctgtaccatctaggtttgtgtaagtatagtctataatatctgcacaatgatgaaactgcctaacaacacatttctcagcacatatccccatcattacgtgatgcatgactatactaagcatgcgattctgaggctctctgtacacaaagctttacatttccattttgttttggtgatttagtaaattttttgagaaaatgaattttgacataagaggccaatgagtgagttgtggaatagttcagatttgtaaactgctgctctcatttttgcttccatatcaggatggggcaaaacaaaccacacaggtaaggtgatagatgttaggttaacaacagctaacacgtcctgtaacaaggacttaggcccaattataaaaggagtttcaaagagcacactgttgatgttactcactctattaacaaaatacagcccaaaggatctgaaggccgttccaagcgagggtgcttctgaggacactgagaagagttttgccattctgaagaggcgagcctgtggaactgtttaaggtcctgttcccagaagaataaaagtttctcattatggcattaaactctatttatttagtatttgaaacatggtgtacatgtatgtatttgtata

SEQ ID NO: 89384 - DNA, 1347 bp, Homo sapiens
aactcttggaagcccaccctgttctaagcaggagactgcttgtcctaaggatggccagggaccaggcaaagtgaggctggacaactcagagctgtgaagaggcaggcagagcaggtggaaagcttctgttaacagtgtctggcaccattaaaactctttctttatgaagagttgtgcaaaacaatgtttgggaattttttgtttttaaatggtaagaataaagtatagcagaagtacaccttctttaaaaagttaataaggaagataattgtggaacgtgtacaaacatcataacacaaaactggaagcaagaaacttcactggaaactgatgaggaagacaaactttataggaagctgcaaaagaaatgagcagagcgagatatttgtggtaagggatacaaagaacatacaattgtgtacttgagaggtttcatggaacattatgacccatccaatgaagacatcaacattaacaacaaaaattaattgaggaagagcagtatgaaaatattctaatgcagtgctgtccaacagaactttctgtggtgatggaaatgttccatatctttgtgctaatacagaatctaccagccacatgaatactcaaaatgtggctaatgcaattgaagaaatgaatttttcatacaatttactttaaatttaaatagtcatatgtgactagtggctcctgaatgaacaatgcagttctaatgcttcatgggtcaaaaccagtggtttctttgggggacctctctaatcaatcagtgctaagggattgagggttgagtgttgaagaagaggaaagcactcagacttatttgggcacttacacaagattccaaattccccattgcttccagaggcaggggacagcacaacctgctctggaggcctcactacgagcctggctaatgtcggtgggactaaaagccttacaattttggtcattcaactagaaagaggcctacggtccacacgcaaaactggaggtcacccctagggccatctgtgcatggaaaccaccactctggagctggtagggagttggagggaggggtgctcacttccgggtggggtttccagagccagaggaggatttagaagtggaggaagtggagggaccggagggtcctgagggccctttctggccacctgcaggctgcacaggccctttcttttttgggattacgatcttgttcttgctcttaaacactttgctgggatctagcttattcacaaaggagtcggtctcttctgtgagcaggtttgtgttgtaggtgataggtttatacatgctgaaccattgctgtaaggcagaattggaagacaaggtcacaattcaaag

SEQ ID NO: 89385 - DNA, 1037 bp, Homo sapiens
ctggggtctgaagtgctgttagggggctaggtggcagctgctgcttgagggcagagaggcttttaatttcccatcaggggtctttggtctagtaattcaggtttttattgctgttaattggcctagatatagaagtataaaagataatgtgttttctggatgcttatctagtacatgaacttgctgtaggagtctattaacaaaatgcctatttcttttagtttttactcccatattctaatctcatcaactatttggcaataactcacaaatgaagatggataaaaggactaataattagcccaaagggtgatgctcagagagaaccaaaggggtttttgggtttgggacacacaaggaacctgggagcatctcaagaggccaaggaggtatgtgtctcctgagccatggctgacaagcaaggtcaggcaagaccctagccaaactacgggaccacgcttgtaaacaattcttacctggtttcccacttttgtagacaaggcaaactttcccactgccattgcatgaatccagctcaaatatcacactgcgagagtcaaagtgaggcttctctggctgatcatcactggctgcaaacccagaagttaatggtaatgttcaaacaaactcaactcaaacacatacctatatatccaactttgctaggtggaaaaaacagaaggaaaaagccttatctcagacatatacttaagtagtatttacaaataaattctgtatttgaattaaagccctaatctcattcatggactaggccttctgtctgggtttctctatcagcaacagacaatgtcagggaatctgggaaaaggaggcatgagaaagcaaacttcttggaagtgggaccacagagcaatctgaatggcttgatgctgacataacttcatttcctttcctgagattgtttattctataaaagtgggatagcaaacacattatctgaatctttctttcttttttttttttttgagatggagtctcactctgttgcctaggctggagtgcaatggcataatctc

SEQ ID NO: 89386 - DNA, 1024 bp, Homo sapiens
tcagccatttgcgccacttgacaagaaaacagattaaagtgcctgatatggttttcagtaatctatggatgtctccttaataatctgtatatgctcaggaaacttttttgcttgttttagccatgctaataaaagaatagaatacgaatgtgagtctgaatttatgggctaatgaaagacagaagccacaaagagaaattaggggtatagtgaattatttagcttgtagaagagagtgctaagggatgagttgatatatgggtttaaagtaaatgaaggggtttccctgaggtgtccagaattgatttacatttgcagaaggataagtggaatattgattgatctttctaggaggtattaggatagaaagaattctttttgtacaagattgcaaaattaagtgacctcagaaggtctttttcaataaaattaatgaattgtttgcatagctggggaaagcagtgtcatttttgaagacttgaaaaatgaatggctttgcaaaatactatagtttgtgctgaaagacgctgataattctctatacatgcatttgcattttgttactgagactttttaagatagggagaggtaccatagactaccgcacagattgtactgtagacctggtctttaaaggaaaaaagtttcaaagttttagaacaatgttggccacaattgcaatttttgatgtatatgagctatgttctaagaagccttaaaaaaaccatccagtatttcatgtcctaagcccatactgtcaagtattgcattgttccccagtgaatacttgggcactaactcatttgaggacatggttcttttttagacccagatacattgatttttcccagaggacagtttgctatttgtacttgacatttctcagaagaaaaatagaaagtgtagcaccattactttcccgttgtaaaatgaataaatcattattattttatatttattctggtctttatttttttaaactgatcgtaacttttttgttgaaattaaatgtacattgattgcg

SEQ ID NO: 89387 - DNA, 2412 bp, Homo sapiens
aatgctgggtattggtaccaggaaaaagtaaaattgcctatgtatatttagtaaaatatttaaagtacatattttgtttattttattaataggatttaaataaacttatacaaaatgtaaatcaaaatcaattgattgtacctgttttggtaacaaaaaaatgaaacccatgttttaaaaatcggaatatatttctgtcctggattataatttggcacctgcatcctttgtaggactttgcatatttaagatatctctgatgattgaaaacatttttaatgtaaaaattgcatggatcttttattacagaggtgaaaaagattgccttatgagagattaagttttttaaaaagcaacaacaaaacagaacagagtgttcctgaagaattcggcatacctttggaagaagtctggttttgtaaactgcagctgtaggcacatatttaattttattctgatagatgttaaaggtttttttttttttatttcagagtaagtgaggaaaaggaagtgacagaggaaagactgaaagctgagcaggagtcatttgagaagaagatcaggcagttggaagaacagaatgaactgatcatcaaagaaagggaagatatccttttgaaagttctcttttttaacgttcaagaagtttgactatttctttttttttttgagacgaaatctcgctcttgtcgcctaggctgcagtgcaatggtgcgatttcagttcaccgcaacctccacctcccggttcaagcgattctcctacctcagcctcccgagtagctgggattacaggcacccaccaccaggcccagctaattttcgtatttttagtagagacggggtttcaccttgttggccaggctggtcttgaactcctgacctcaggtgatctgcctgccttggcctcccaaagtgctaggattacaggtgtgagccaccgtgcctggccagaagtttgactatttcatgaagacaatgtaaactccagagaaataattgttctaatttgtaacagggagtaaatctgcatgtgctgccatttctaggcaatcagaacgtcacttaacaatatgtgctatagcttcctttgtgcctgataaggccatccagctgttctgctgctgctgttaggctgctaagcacatacttgtcaactaaaaaggacaagaagaaatttgggcattgaagtgtagtgttggaactttattaaattctgttgcactgctgtaattgagctggaacctccttgtatttggtattctttctagttaaagctttgacagtcctaggaattctgctctgaaatcataaaaattaaaaaaaaattgtttttactgtatagatgttgtaattggtaagtgtttacacggcagcataatgctgccaaatccttcttatggagcagaaaactattgggtttagacctagaggggtgtgtgtgtgtgtgtgtgtttgtgtgtgtgtgtctatagcattatttgtaagaagataaagtaaaaacatattttaggggtgtgttaaaataagctatttctgaattttcttttgaataggtagaattacttatctttgggtattgtatgcagcaatatggatgtagaagagaagtccctaaagttagagtgatggatctgccagctaaactagtgtgtgaatgcgtgaaaccaccattgtttttattggcggtatcatcattaacttgattgttaataattgtttcaaagattctgcaaatgtcgaaaatggtcttgtattgacagtaactatgcctttgtgaataccagagaaatggaagcataaagataaattacaataattagcttgaaaaatacaagactgtagctataaaaacagagtcctgaacttttattttccaagcagtgggagttcatgataggaaattaatacaatcagaattctcagaattgatttgctgagtataacatgaataaggcttgttggcctcacaagtctagatgagtgctttttcaattattaattttttctacatctctagcatttggataatcatctccaactttctcttttttttttttttttggcccactttgacttcattgcccttggttgttgaccctcaagatagtcttctgtgtttttcttcctgctacttttttctctagatttaaaggaatgctgtttagtcagaattcataacaaagtgctcagccagttttatttactcttctacttgaggagtagtactccaggtcctagcattttttagaaatggtaggttaggaatgctttcatttgcaacaaaaattcaatttacaggctcctttatttctcacataacaagtactctggagattatggagattcagtggtttaacattttcagtgctggcagctttacaattctctcaggtttttttaatggttgctc

SEQ ID NO: 89388 - DNA, 1056 bp, Homo sapiens
gcataaaaagtggatgtgaagacatatttgatatatatctttcaaatgttatcttttatttcagatgttatcttctatttgaagatttttgttgttttgcctttagagtcctcattcagatttctgttgcctgaaaagtaactagctttctggtttttgaaaagataatatgctttttgaagcaaaaagtttttttgattatttgaggagcatcccttttaattttctgaagcagttgtaaggatgtttgttgctaaaaataagtcagctaggaattgctaaagagtcttagcatcatgtgttctgacaaggcatagaagagatctcaaggaaaataatgcagaaatcaagctgagaaggctctgattagatggaaccaacttgagaatgttttatgaaactatatcaggatcaatcttccttgcacagataacaggaaaggccaaagtgacagtattcaaaaaaagatatatgtttatttcttattcatataaaactcatctgctgccagcaattttaggctggtatagtgacgccgcagattatagggagccacacttttttaaagtcttggcatttcaagcttcaccatgatttgcaattctagtcagcagaacagagtctgttaattttggaaagtttgttctaactttgattttaattttgtttttccattgttgaacttaaaaacacaattaagttttgtatgttgattttatatcttttgaccttgctaaattctcacttattaattctaatagttgctttacacatttcttaggattttatttgcagtcgtgtcatctgcaaatgaaaataattttagttcttttaaatctttatgccctttatttgtttttcttgccttcttgcaacacctccaattaggtattaactggaagtgatgagaagagaacatcttcatcttgttctgtatctcaggaagaaatacatatttcatctttaagtttgatgtcacctgtgggtttttgggttttggtagatgccttttatatcccattgaataatttctcttttactcttagtttgccaaga

SEQ ID NO: 89389 - DNA, 1685 bp, Homo sapiens
cacttggtgggggaggcatgtcaaatgtgacagcagaactaatgtggaaggatagatttatggcaaaactctctgccttttggagcactatcagcttgtccatgtgcactattagcttttgtttctccaacacttgtggatgcttttgtgaatgctgtcagtcagatgtctggaaaattttaaacaagaaccaccaactaaagaattgttttgagagttgattcagatctttttggcagtgagacagtgaacatgaagtcactgccagtttttggtctttgtggaccttttcctttcttatgtctgacagctcagggcggcattttactattgactcttaatggacctgcagtgctatagctgagtctgcacagttcaaaatgcaaggttggcagtctagaaagattgggtaaagaagcagctttgagaggagttcctgccccaaattacttgctaaaaatatgttagaactgatatagcataaaactgatacagcataaaaggattatttggatagaagtgttatttggcttaacaggtcaggaggcaacataatttttgcagtgacttctgtttcttgaggagttgccaggcaagaaatatgataaggattttgaagaaactactatagaggtggagtttcatagctgtttatttttattccagatttttcatttttttctctataatctcttaaaatggtctgagattagcacttttcacagttgttgaatcttctgaactatcatgttggaaacattggatgtgctcttctatctagggaaaaatgtagccttcatttttgccacatgtgttgccagaccggacatcatatgaaagttgcaaaaaaaaaaattctgaaaatccagcctcacttagaagtgaggcaatattttcatctctttataaagctatttgtgattgcgttcttcaccaacaatttttttttgctggaggggtggtggtaggggcagtttgccacaaagctgaagaaacgcattctgtcaccaaaaaataccatttacattttttctccctttacagatttcttctttttctggaaaaaagtttaacatttaaatgaaaatttcatttgcctttttagtattaacgtgccgtgatatttagtctaacaacttgtccctgaatatctctgttgctgtaacactttaccaccttcaagacagcaaaggaggtgtgttttaagtgctatgccactggttttcaatccttgacctcagaggaaaaaataattctacattatgttttatgacagcttctctgtatgttttttgtaaagttaaatattctagacaaagtcaggtattatccataagatatcaaacaattgggagaactttacctgcttggttatatttatttcctcttttataaccagggaaacacaattaccacctcttttttagagatgatgaaagtgcttagaaataaagctccagcacccttaaatgcctgagctccacctattctacaaggctgtggggactctttggcatcctctgtgttgcatcttttcactgaaactttaatttgaatatttgatttttcaccaaatgtattttctttattttttccattgttaggataattacccttagaattctgtagcttctggagatatttacaaatatatatctgttaatctttccttaactctatgccta

SEQ ID NO: 89390 - DNA, 1083 bp, Homo sapiens
gttttatgattttcggggagaaatacatgtaacttttatctgaagactttatacttatgactctcgccaaatatgattgcatttctggttctgttttgtttattggaatatgaaaagcagcattgatggatgcagtttgaatcaatttttcagtttttttcccttaatttgcaatctcacctcttcagctacagtatagagaatgccaagaacttctaagcctgtatcagaaatatttatcagaacaacaggagaagctcaccatgtctctctcagaacttggtgctgctagaatgcaggaacagcaggtaagcatctttaattttacttttcttgtcttcagtggatcagcaagatgtcagaagagccatttgttttttatcttaatttcctcccagtatataatattgttttaaaacatgtagccactgcgtgtgattgagttgatgtctttccctccccctttcctttctcctcctgttcctggacccaaaggtaaggaatgattacttgaagcagtctgtgtgggtcagtggggaagcttctggttgtatgaaagcacagccagaagggtaaagaaaacactgctctgttacttaatgaagatcaggtgggctgtttgttactcattgtccttatggaaatcacaaataagcctttcttaattcatgtttattttttagaataatgaaagttaattgtggacttataaaaactttaattggagaatattaggatattttgcatatgcttgcatacatatattaatcacataagtatgtaggagagtatttatataagcgtttgtacacttatcaccaaatggtatgtattatatacttaaatgaatgctcagaaccctgccagatgtgatgtgaaataagccctaaagacccacttctggttgggggatttccgtttcctagccaagggaagccattacagactgtatctggaaaaacaggacacttccacccaaatactgggcttttcccacagtcttagcaaccagcagaccaggggattctctcctgtgtctggctgggtgggtgtcatgcccacggagccttgctcactgctaac

SEQ ID NO: 89391 - DNA, 1048 bp, Homo sapiens
aagtatttagttcatatgcttagaaggtaatctaccttgatgatcttctagcaaaatctgccagcagaggagagttaattgcatgggggaaaatgaacatttatttgggatgagactttggcaaaccacacagtgcagctgttgcatcacatattttctgtcaacttgacgactggtccatatatgcctagtgttaaaaatgcatcatgtcattctgtgccttcttttacattaactccagatgctctgggagatacaacgacctggcccacacagtagtttaggtttagaaatatttatttaggtcttgaaatactgacttctcaatagaataaagagcagagagggaaattttgaagttacaaaactgagatttattcattcttataaggctgtaagtgggaatatgaggattgttatagggtgcttatcaggataggaaattattatttatcattagagaatgaatagcaataagacctgttggtactattgagtaatcctgtggtgaacaactcataaatgcattggaagtaatcacatcctaaacatctaaagttaataacaacctgttataagaaattattactgcagtttagttcacctctttatgagactgaccaggcctataaaaatgatttacagaaacttatagaacatcactgtttacttgttgatgggatttcacaaagtaatactgcaattgttttttgacatgtgagaacgtgagaaaatcctggcttatcataagaatagtatgtgatttttggtatgtgttcatatatgtgcttatgtacatgtgtatgtgtgcatacatgtatacaagatcatatacatatttataaataggcattgttttctatgcagtctttaaaacattgtatttttaaaattatcttaaagatttagaaaatatttttctaactcagaaatttatttatcttcaatattagaaaatccttcattgtatccaaaccaagtctctcacaggttttttttttaatccttgttcttttgtcattagtttcttttatctagtcattagcct

SEQ ID NO: 89392 - DNA, 1040 bp, Homo sapiens
tctcttcattctcatttaaatagaaatcctttagcattactacagtcattcaattaaaatcttaatcactgtaatacccttcattcttttatcataggataagaaacatgatgttgctgtgtatctctgttagttgatactttttacccatcagtccatcatttgcaactattgcgaaataaattggtgggatttttctccccttatactagggatctcatttattctcattcatttgttttatgtctgtggagtagctagctatttcaattgttttaaattactttttatttaaaaataggcatggtagactgaaagtacccccccccccaaatatgaccatgtcttaattcccgaatgtcacgttatgtgtcacaagggactttgtaatgcaagagactttgcagatgtgattaaggctctcgagagggggaaattaactgtattacccaggtaggcccaatcaaatccaagcggtccttctaagaaggagcagaaggagtcagaggagaaggcagtgtgtgatgatgatggaagcaggagttggagtgacacaccgtgaagatggaggaagggctataaaagtgagaaatacaggtggccactagaagctaaaaaaggcaaggaagctgattctgtcttcagagccaaaggaactagccctcccaacgtcttgacttcagcccagtgaaacagatttctaatttctgacttccagaattgtaagataatacatttgtgttattttaagccacaaagtttgtgctaagttgttatagccacagtaggaaactaatacagtagttgtaatatatttgtttactgaaaaactcatatttctcttgcagcattgagcaaataagcttccccatagcatgcaaataattgtgtgtgaaaagtgagactatttcagaggatatggatagaagattaagaatttttgcttgtttggttaatataagtgttcaatacacagaagattttttggatttgtttgaatagaaatagaaaatggcaagaaagtacagtgttaacataag

SEQ ID NO: 89393 - DNA, 1951 bp, Homo sapiens
cagggaatttcacttcaactaaattcatgaattaatatctgctatacacaagctgttgtttatagtgctcaggatgttcaggaaaaatattgggaaggcaatctaattgaataccaaatgagtagcacagaattgttatagtagttcagaatcttgggacgagcttgtcattttagaataaatttggcatgacattggcatttacttaaattgtaattaatgattcattctgccaccttgttactacatgattgccgataacaactttcgaaagggtattatttttgtgagtcactttccagactgatcagagaagatttatccagaatattattcatgattgtgccaagaaccaccttaaatcatttttggagcaaagtagtgtatgtataatgaataaaaatcaaggctaatgataaatatttacctttgtctcccactctaacaatatgccttaatacatgtactctctacctaactgtaataaaattcagtgttcaccagtgaaaaacgtgtcaccttgagagagttatgtgcctggcccagccctcactttagtaatttataaataggtaatggtaaaagtaactacattatagagtggttgtgaggatcagtacaatagtatatataaaatgtactccttgaaggtagttgctgtcatcaagatcatcactactgctgtagaggctactgtgactgatattattgctgccattttttcacttttctcataattccctgatttgggcattttgcatctacatttacctacctatgtgtcaccaccaaatattagtcttaagctgtaagctcctgaagggaattaatccatgtactttgtacattaattccaaccagttagttggaattataggcatgtcttttgacaatgatgaaaatgacaatattgttttaataatgtttttacacttcagagtttgatttcatagttaaagaatatacttttacagataaccagagaacatttcttaaaagccgagagaataagtgtcacatatttgataccagtgattaacactcaactcccggtagaaaaccttttggctgagtttttccatggctttccctcctcagtacatgtcagtgtagggctaagtaagcattgatggatacagtgtcttccagttcttttggaagaattcatctttgactcagggaaaatatgttggttagtgagctgtacccctaattctttgaaatgtcagtatgagaagtgggtgcttcccatataaatgttggtcagggtcagtgataattagagttactagaattcacattgagacactggtgatcgcagtacacttgcttacaatgaatagagggaagaattaactttctgcggcagagatttaaagtgctcctattgaagtatctataattttgaatttttaaatgatattctaaccaacttaatcttccctacctttcctttaaagaaaatttaagttactatgaaatcaatttgtgtttgtttatgtatatttaagaattactcatttatttttgactaagttttaattggaaaataatttctggggatctagctgaaagagcatggttttccaaaatttatcattcaggttatcaggcttcacaagattagaaattttttaaattaatttttacaggttaaaagctcaggctctgtttaagtcgagagaactggttgctgaaaaacagcttactaaaccccaagaactcaaactggatatgaatggcagtgactctggaccaaggtaaacctgaagtctcagttaaaacaagaatcttaagggcataaatatttaggatacgtttggtatacttttatagctctatgttgattaatacagttttgtgaccatatgaatacgtacattcctgttatacaattttgaaaaatatagaaaaatatgaaaaacaaaataaaaatcattcataatcctac

SEQ ID NO: 89394 - DNA, 1487 bp, Homo sapiens
ggttccctgtgacttccctgttgaattccagtgcttctctccaagaagctctatttgacacttagttatttatttactgttttgatccttctttgtagaggaagtgagttctgggtgactctaggtattcattttgaactattcttttgtgttttgttttccctgattagttgcagaaggttttatatacttattatttggatttacctttctgagagttgcctatttaaggtagtttatcttattgattcaagagaacgtctatattctggatgtattacttcgtattcatcatcttctgatgatttcttattataccttcaattgaggctatttcaagtttatcagcatcctcctccccgatgttctcctcattgccatctttcttaggagatgacttcctttcatacttaactgagaaagattgagatttaaaaaattagtgctccagtcaaagagatggacatgctctaaggtctaggggcatctgggcatgtatgacctaaatttaaataattatgacaaaaatataagactatacacttgcttccaaaaaaatgtcctaaatgcctctgagaagaccatatacctttcaaaatcatacattataaggatttcaagaaactctggcaagtgcttccaagtctgacagtcattggtaagccaagaattctcacacagcagtccttaattatttcatctaatgtgaggttgaaagaagtaaagacaatgaatttaatgtctatttgattccacttgctatggaaatgatgttgtctccactaacaccaggaacagttagagataagtcaggggagaatactatagagccttgagaagcctttgtagaattattaaacaaaaatgcccactaattttagaaaatacaatcaagaatggttacgagaatgatccatttactttgtaccttgcaggctctttggctttaacactagaactccctaaataaaatttaatttcaagcaaattttatttatttggatatttaaattatcttagtattaaaaatactgtttttaaaatattaaacttaagtgaggcattaagaatttgggactaaaataaatgagataatgagaaagtgaaaactttttttataattaacagttcattttgagttaattatagacaattaccaaaatctaattgcaatttatttcctattgtctgtgggaagaatcccaggcaagggaatttacattgctgccttcctgcataaatgctaaagaatgaaaataaataataagtgaggccttaatgacaaataagagcaaatggtagggcacagctgagccaaaccattggaagataattatcacatgaaagatggtaatgatttcaaaagtcataagttgtttctaagtcctccggtttcttttttagttagtttgtttgatgctaatttattgcttacacaaagatgacccttaaaaatgaacagttttgtaattttgcatactccaata

SEQ ID NO: 89395 - DNA, 1076 bp, Homo sapiens
agtgggaactaggagcaactgccaatggatatgaagtttcttttaggggcattagaaattaggttttaaggatgattgcacaactgtcaactaaaaatcacttttttttttttttttgagacagtctcgctctgtcacccaggctggagtgcagtggcgagatcttggctcactgcaacttctgcctctcaagttcaagcagttctcctgccacagcctcccgaatagctggaactacaggcgtgccccaccacgcctggctcctttttgtatttttgatagagactgggtttcaccatgttggccaggctggtctcgaactcctgacctcaagcctggcttggcctcccaaagttctgggattacaggcataagccactgcacctggcctaaaaatcactctaaatgggtgaatttcatggtatataaattatatctcactaatgctttttaaaaattgttccctgtgtttcgtattgttcaaaatccaaaacgaattaagtgtcactaagaacaaaataatgttacaaagctttgcttacttttagagtacataagcttttccccttttctcctcaagattttcctgccacttaccccttacactagttgggaatcgctttttaaaaactgaattcttggccaggtgcagtagctcatgcttgtaattccaacatttagggaggccgatgcgggcagatcacttgaggccaggagttcaagaccattctggccaacatggtgaaaccccatctctactaaaaatacaaaaataccaggcatggtggtgcacacctgtaatcccagctactcaggaggctgagacaggagaatggcttgagctcaggcagaggctgaagtgggccggggtcatgccactgtactccagcctggacaacagagtgagactctgtcttaaaaaacaaacaaacaaacaaaactgaattatctaagatggcttatcagaatccctttctgtattcataatagatatgataaaacaaatgagaataaatactatctaaatcctctttatgagacctatgtcctggtgactagtaatactatttttaaaa

SEQ ID NO: 89396 - DNA, 1041 bp, Homo sapiens
atagcttccatttgcttttctaactgcattgaaatagtttctttacattgattttgggattcagcacaactggatacacttaggatgaacaaacaaacacaaaaatttaacaaacattcttttatttgtggaattttctggatagataggatgggcaaaagtttatgtgaagatagatgaaaagaaataattactgtttctgagcatacattttgtttataaagtgtctgagaacatggttgcaatcttattggcttatggcggtttgttttaggtggttgccgtctcagaagaacttgcaattacatatgaaagagtgctaatttttaataatcctacagaaaaaagtttacattgaactcaactatatttgtttttcacattgctcctgtagtgaagaggattgatttctgcattacttttgcaatttggcattgtgtcctttggtacttggtgtgtgcaagccttaatcctttaaccgtgaacctgagccctgggctatttgatggaaagactttctttgttacgtggtatggtggagtattgtattagtctgagtcaacttgagaaaaagaaccagtaggagatatatattataagatatattgcaaggaatttgcttacacagctgtccatgctggctaggcatgtctgaatccataggcaggctatcaagaagatcaggctggaacttaggaacaggctgaagctgctatccacagggagaatttttcatttttcaggaaagcctcaggtctgcctttaaggcttttcaagaaattaaacagacccatcctgattacctaggattttatggactttaatcacatctacagaataccttcacagcaacccttagattagtgtttgattgggtaactgggaactttagtccagccaagttgacacataaagaagaccatcatagcccataacttgtcaacttggcactcatacacatcatcttaagccatacttaaccttcaaataaaaacattaaaaatgattattggaggttccaaaatggccaaataggaaaag

SEQ ID NO: 89397 - DNA, 1046 bp, Homo sapiens
catgtaaattatatataactgttaacattaaggtagcatgattgatttaaactagtcacactcgggggtaactagagactctcattttatccttattcatactctgaggcttttcatactgttggagggttctggggtcaaatgaatgccagggcatacatagcccatacaaaagacaagaaatccaggattttacagctcaaagctggctgctctattatgtgtccttttaagtgttttcttaaaatctctttaaaatgctattaatttatttttgccctgctttctattatattcttatttacttttagtggatgatggttttattaataggacccaatggcaaaaaaaaaaggagagatttcagaattgctgtttatttacccaaagctgccttctatctatgtccaagggccatttttgaggcccctgtgatggaatatggtgggtatatactcatggtcatattgtgtatccgaaaacaaaaggtcttgtagcatgctttatttagaatttttatagaaatttctttgattctacatgttactttatcagcttgattgttgttatcgagtgtaataacaaaagccctacagagagatttttggtactgcttgttccaaggagacaaggaatcctcttgctggttgctttatttagtagtcaaaacataaaacattattctgtaaatgccagagaatgggttatttttgtaatgcacattggtcaggtgaggtttacgtccatctattgcatgggcagaagagaagggccaattggaattggaactcctggtaaattatcaaggagcatattgggaggtaagttgacttttcttcagtaaatggggaatatgcattcccttaaggtaaattacatagtctgatttagggaactttggatggtatttttaaagtttatcacaagacttttattgataatataggaatagggctccttttcaaactgctattatcagtggtaagggctggaagatttcttactttacctttgactgaaatgttaagagttgcctttagttaact

SEQ ID NO: 89398 - DNA, 1057 bp, Homo sapiens
ctatgtactagatattgctcttaagccttttaaatgttttctcatttaatagtaacataaataatgataataatggaagccagcatttaggtagtgtatatgtgctgagcattcttttatacatcttatattaattcgtttaatcctcacaacaactctgtgagttacatactattaataagttgttttatagatgaggaaatgaggcccagagaggttaagtaacttggttaagaaattacatctatcagaacttagaaatagctatagaatagccagttctgtctgacaccaaagctaatgttcttaaccactctgctgcccttagtgctcctcggggtgagactcttctctttcctacaccacacatctaagttacatctttctatctattgttgtccagagaccattattctacccagtacatctaagggatttggcataagtaaattaatcactatgatggtcacattttttgaagccaggaaccatgccagtgtctttgcataataaatactagtaaattattattcctttttactgacttttcttacctcactcccttcatgaccccgcccccattctcctcttcttgcaagcttcctgtttttgttacctgcttcatgtagcactttgcatactgccatcgtaacacctgccacattatgtattcattgtttagttgcctatttcttcctttttacctgtaaatgtccaaaggtagtcatttactcctttgtgtacctccatgcctgaatacagaaccgacacatagtaggctgtcagataatattattggatatatggaaataaaatttatattgataattttggagttggaaggcagaaagatttgacagtacatggaatatttcatgtatgaaattttgttcttttttttttttttttttttttttttgagacgaagtctcgctgtgtcgcccaggctggagtgcagtggcacgatcttggctcactgcaagctccgcctcccgggttcacgccattctcctgcctcagcctccctggtagctgaaaatacaggtgcccgccacca

SEQ ID NO: 89399 - DNA, 1067 bp, Homo sapiens
agtgaagtggcatgatcttggcttactgcaacctccgcctcccaggctcaagcaattctcgtgcctcatcctctgcactagctgggattacaggcatgtgccaccacagttggccaatttttgtatttttagtagcaatgggattttgccgtgttggtcaggctggtctcgaactcctggcctcaagtaatctccctgccctggcttcccaaagtgctgggattacaggtgtgagccaccatgcccggcctacttagatatttttaaatttaactcagcaatgccatatagtttccagtttaccagtcttacacattttttgtggaatttaatgatatagaaagactattggtttttgaagacttagtttatatattgcaatttgttaaatggatgtagtctaccagtgtttaagtttttgtagattccttaggatattgaaattcacaatctcattgcctgtgaataataacagctttattgatgcctttccaagctttatgcctttttttctttcttttttttttttttttttttttgcttattttattgtctaagactttcaaaacaatatgaaagtgttaaagaagacatccttatattgttcccaatcttagggaaaaggcattcagtaattaaccagtaagtaaaatgttaaatacaagtttttggtagctgtcctctataaaattgaaataagtttccttttattcctagtttactgggagtttttaatcataactttatcaaatgctttttcggcatttattgatataatcatgtggttttgctccttttttcttttagtggtaccacttacctgaatttatttttgaatgttaagccaatgttatattttgaaaaaatactaacttggccgtgatatggtaccattttatattattttataataacttaggtattacacagtaacaaaatacgttgcaaagtatttcctcctcttctatatactgaaagtttatgtaggattggcagtatttctttcttatatgtgataaaatttaccagtgaagctatctgggcagttttctttgtgggaacatctt

SEQ ID NO: 89400 - DNA, 1037 bp, Homo sapiens
ccttgtattttccttttcttttattctaatatggagctgttagcaaaattattatctatatgaccattaaagaggctaaagttgcccctttgagccattctgcccattgcacagctagtgtatgcagattatagtacagggcaaagttattgcattggcatttgctgtggcacccaaccaaatgggagatataaactttccatggatgcacagtagacttggaaaccctgtttatcataaggctgatgacctagcactaatcacctaagttacactgcttggttcatcaccttcttaattgctttaccctctttagtgtgtctgaattttttaatatacttttcttctgtcttacatcttttgtttcttttgctgttatcctttactcattaagtactacacaggacatttactacaggaccattaatctttattaccagtatcttactcccttacctctcctatcctcctcaccattctgccagctttatgatgctaaacatgttaaaaaaaaaaaaaagaccagactattgtctcaagaaacaaccttacgatagcaaagatatgtacagtattgtcaaaattacacttaagatatatagacttgttcatcagttttagttacttttattgagcaatgtcaaacagggagataatacttgggaaaatctaaacttgagtaagaacttttaaaaggcataaatctggaaacacctgattttcattcctcttttttcctcccttgtagcctcaaaacgttttccaccagcttgcctagaacccccctttcctgagcaatcatcgatattcccttttatgagagccctcaaaactgagggcatttttttcttgttatgttgatgggctagcagaggctgtgaagccactgagtgcgcagttttcagaactgaaatgttaaacctctgaccttggcactgcccattcctaagtcaggctgtaaaacctgactttggccgctcccttcctcctttttgttcctccttcttgaatctctaaattcccttaaaatgttggca

SEQ ID NO: 89401 - DNA, 1996 bp, Homo sapiens
ggcagttcaacatacaaaaatcaatcaacgtaatacacattaatagaatgaaggaataaccacatgatcatctcagtttacacagaaaaagcatttgacaaaatccaacattctttcatgctatctgcccaactttataggaaattgtttgttgactctgccatagtaggtcaccaaggacaaggagaggtattggaagaatacacatgaaaagttgttataggacagaacagaagtggcacatataatgtccactggctttccaccttaccacacgtaattacaaggaggattagggaatataatctagctgtgtacctaggaagaaggaaggagtacattttggtggataactgacagcatctgccacagcagcattcttcataatagctccaaaccagaaatactccgaatgtccctcaatagcagaagggataaaaagtcataaatgcatacaatggaatactacttagcaaagaaaacaaagaaactgcagtacataaaaattatcagcataggtaaattttgcagacaatttaagcaaaggaagtctcaaaaataatatacatatttctaaagttcaaaagcaacaaaactaaatgacatgtttaaccaaacacataaatggtagaactataaagaatagaaggaaataattattagaatagttggggcccctggaggcaagaaggaattgtgactggggatggatattggtattgtatctgggtggtagtgctgccagggcttgctttcttgagctgggaatgggttacactggttttgtctttataatttattctttaaactgaatagataatatggctcagccgtttaaaaaatataaaataaaacaaagggcccagaaacagagttttcttaaacattgaactctaagaaaaaaaaattgccgtgaaatatacccagttatatctaaataggacatgatccattataatcaattccatctgtgcatgtgaaaatatatgtgcgtgtttatgtaaatgcattcacatatattacatgtatataaacatacacatttatgtatgaaatcaattagcctagtaatattcttaacagcattttatttatttatttatttatttatttatttatatttttttttttttgagacagagtctggcactgtcgcccgggctggagtgcagtggcacgatctcggctcactgcaacctctgcctcctgggttcaagcaattcttcagcctcagactcctgagtaactgggattacaggtgtctgccaccaggcccagctaattttttgtatttttagtagatatggggtttcactatgttggccaggctggtctagaacacttcacctcattgttcacctgcctcggcctcccaaagtgctgggattacaggcctgagccatggcactctgccagcatttttatttatttttaagcatatgttgttattgtgtgtgtgtgtctgtgtttgtgtgtgtgtgtgtgtgtgtttaaatatacaggaatatagagttccatgaatatgcataactgtaattgttggtatacttaatattaaataaaatttataaatggaacaaatacaattaaaagctgatgtatagctttctggaaacgcaataaggaatagaacttagagaattaataaaaaagaacagttaaacttggtctgtgctttacagcaatcattcttatccttttcagggtcccataccctttcagaatttggtaaaagatatggtttctttcttcagaaaaataaatgagcacacatatatacattgttgtgccttacaattatgaggtatctgtacattcctgaagtacattcttcaattataaaaatccctggaccatctgttaaaattccttctttaaattgtccccaggtattctgtgatagtgaccaaaaatatatttatattctgtcactaccaagcatttcttcttccctttcacctcactcacaaatccctttcagttgtttctactccta

SEQ ID NO: 89402 - DNA, 1066 bp, Homo sapiens
ggtttagagttacaaagtgctggaatctttcttatgaaagttaaagggagcaaaataaaacatcccacctccttgggcattttcacagtaaaccaagatcagcagggctttgctaggcaatcaggtttaaaaacaaaatctctagttactctgtcactgcaaaaatgtattttcttaaagcgcattatagatttcccatgtttacaaaactgaagtgagtttttcatatgccattgttacatttcagggaaacaagtggcttacctttgaagcttggacattcctataatgtcttataaatttactaagagtgaacttttccattttcttttactgaatgcccaaattattttctttatttttcatatagggacagtgacaggagttagaaaagatgcgtctacatctcctatgccaacaggaagcctaaaggattttgtcaccacagcctcaccatcattacagcacaccacctcccggtaagcttcagagattctttagtttttaatattctccctatgagagcatttttttgaagtttatttaataaggaagggaaaaatcttgacaactcttagtaattctttctcaagagaggtccttcttttgaagcatctagatttggccagtttgaaccacatggagtccttttctttatacatgcactttcttagttgatcatggtaatgtaagggcttccatagaaacctaaagctaaacctatccttcaccagaaagtctgtttagcagcagggctttcctaatttatcacagaaaagttatacatttagactataagtttaactagctgaaatcattgctattgaacattatagtggcttttgtactagttaaaggaataccaacattaacttaagaccagacacatttgaagggttaagcatttgatcagccttttctggagtcagggaaagaaatatcttattttaaatttcccatgtctaatgaaccaactcccacattatgcaattaaggctgaatatgtaaacgtcagtaccaaaagggcttggtttatgtttcttcagggatatgattggttttgagc

SEQ ID NO: 89403 - DNA, 1036 bp, Homo sapiens
tgtaagagctgttttacttttcacatgatttttcaaatgttctacaacaatgttatattccataattttagaaacaatgtttaaaaagaagacaaagggaacacatttataggggacaaacccatttcaaaattttacactcagtagttccaagtagttgcaaaaaccctaaagttactcttggcccatatgacataaatatcttatttcctttgtcaacccagcaatagatgaggattatccttccttgttgtgtcttctccagggtactgaactctgaaaactgctatgaatggtgacatctgttcagtattgccagttcctgctgtcatttcacagcttttagcctcatgaactgccattttagagttgttcatttggtccaaggttatcaaattcccttaacttcaactttaagaaatatttttaatgtctcttccttaggcactttaatgcttttataaaaattactttatatgttacctaatgtaatccttacaaccataagaaagtaaagctccaagagacaattacagaacaattaagagcccaggtgtaataattataactctgtggtttataggcctaggtttgaatgctagctatgtggctttgaacaaatcatttaatttaatctataaaatgggagtaataatatctccctcataggtatgtcatgatgattaagtaggatagtttatgtaaagtacgtagcacaggcctggtgcatggctaagtgctccataaatagtagttgtcattatagaacttcccagggtcactcaagcaatcaggaacaagctaggatttggaccttgctcttgtgattccaaactataagtgtatcccctaacaaagagttaggaatagggttaggttcatctcagaggtgggcagtttgattatattttttatattgaccttgcaaatatgcctgttactttacctccatttgcccaattccttatgtgaaaatatgaatattaatagctattttataaatttgctcataggattaaattcaactatgtatgca

SEQ ID NO: 89404 - DNA, 1352 bp, Homo sapiens
tttgagaccagcctgggcaacatagtgagaccttgttgctactaaaaatttaaaaaattagccaggcatggtagtgtgcgcctgtagccccagctactcgggaggctgaggtgggaagatcacttgagcccaggagttagaggctgcagtgagccatgatcacaccactgcactccagcctgggtgacagagtgaaaccctatcaaaaaaaaaaaaaaaaaaaaaaaccatgaagggaaatgcatgaacattgttattttcattaggcttaagatttctggatctatgttctcaccaaatcatctttactatgcctttttagaggatataaattaactttttggtgtacaaatcctaacgaaagaaagaatgacttaccatgaaagaaagattccaagttggttttgaagctcaacagcaattggccaacacatttcctatttgcttattaaggctttcattgattttcttgttgtcatgggtgcatactgaaaaaagtatgactattactgagattaaaagcctatcattggccaggcatggtggctgacacctgtaatcccagcactttgggaggccaaggttggcggatcacctgaggccaggaatttgagaccactctggccaacatggcaaaaccccatctctactaaattagccgggtatggtggtgggcacctgtagttttagctactcaggaggctgaggcaggagaatcgcttgagcctgggaagcagaggttacagtgagctgagatcataccactatactccagcctgggtgacagagtgagactccatctcaaaaaaaaaaaaagtttattatcgtgttgcttggaacccacccccaaatcctaataaatgatcaacttggctggaacataagcctcttagcagacaagggaagagtgattaatgttgtacgtgagaggctgtttcttccgatgggaaagctgggagattctgaggtgcgttgggatttgtattagaatagggaccctgcatcaagctcttctcaccacatgggctacttgaaacccagagccaataattagagtgaaaaagaaaatttcaagccaaatatctgcatagcaagatagaaagcagacaaaattgtatacagttgcatgtcttgtacaagccttgtgtacagttgtgtttcttaacatacatgaataacccatcctttctacattttgacagttgaaagatatcctggattaatgctcatattaaatagtaatatataataaagaagataagataaaagccttccttagctaggaggattttttttaatgttttactttgaataaataaaaggatactaggaattgtacctcagggtttttt

SEQ ID NO: 89405 - DNA, 1059 bp, Homo sapiens
tatatatatcatttatacatgtgtgaggatatctgtaggataaattcctagaaatggaattgtgggtcatagataagtacattttaaattttgatagatgttaccagtttgttttaatagaggccgtacaactcatgtatcatctacaatatttgaaagtgtctattttctgacaccttttacaatgtaatcaaaaagtttggtactttgccagtctgaaaagtgaaaatagtatcttgtagttacaattgcaaagaataaacttttatgtttcagtcatttatattttctgcaaagtattctatttttttgtccactttccactgttattagtctttttcttttttatttataggtgcttgttacatatgaagaaagtaatcctttttgtaatatgtcaaaatgtttttccaagcttgtttttagtcttttaacataggttgtgtagcattttttccaggcagaaaattctcccatacaaatgatttttttggtctttcaactggttatagatttatctttaattatttcactctgcatctattcctataatagtttgttatggttgctttgttttgttttgtttttgttttgttttttgagacaaagtctctgtcgcccaggctggagtgcagtggcgggatctcggctcactgcaacctccacctcccgggttcaagcgattttcctgcctcagcctcctgagtagctgagatgacaggtgtgcaccaccacgcccagctaatttttgtatttttagtagagatgggatttcaccctgttggtcaggctggtctcaaactcctgacctcatgatccacacaccttggcctcccaaagtgctgggattatagcatgagccactgcgcccagcctatggttgcttttttattgatatatcatagttgtacatatttgggtggtacatgtggtattttggtacatatatacaatgtataaggatcaaatcagcgtcactgggatatccattacctcaaacatttatctcttctttgtggtgggaaagaattcccaattcttttcttctagctagtttga

SEQ ID NO: 89406 - DNA, 1049 bp, Homo sapiens
tccaccacccaagcagggtctccctactttttctcactggcctcgttttgacccagagaaagcctatggaagttatgcagtgcagacctcatcctgtctgctgtcttttctcccacagagctcttgagatgggtccttcagcttgcagtggtccctagtagcctctcaagctaatggggatgatgatcctggtttagccagagttcaaaactctccagtcattgaaagcaaggggagggtgtgttcccagatgtgtattacttgggaattttatttgatctggagggtgtggctttttttctctcctttttaccaaccccaactaaactgggagtaagacttagtcagtgttggtagacaaagtcataccacccagggcagcctgcatgcagcgagtctgcgtggcttccctgaattactcttttaattaaaactagattatttcaatctagaaaagccttgttgagcagcctccttatccagatagatccaaagctcatgtctcttcaggctgagactggcgctgtcacctccacccagccttctttcacttggggttttttattctttggagtagaaaagaatggagcccactaatattatatttttcttctgaaataaatataaagtcaagactaactagttataatcattcccttaaaaagttggaaaatcattacagattaaaatttctttataaagttcacctctgagagtaaccaaatcggtttcatcccatatcaaaaagcctttggagtgtggagctttctgtggtatggcagaaatgggtggatggcaaactaagagccctcagccattttttcagttaaagttaggttgccagaactttcttttccttgccccctgtgtcatgactagcttaagtgtacttgactcccatagactactcccatgcccacagtcacccattccagactccagtgtccttaaaactctggagtgagaggatgccagaggatcaagaaaaggatcacagtttcttgaagaagcttgtttgcctttagaagaatcgtaaacagagtctaaac

SEQ ID NO: 89407 - DNA, 1036 bp, Homo sapiens
taatgtttccaaagtgacacagaaggtattagagagaactgtgattttaatcctggtctgaagtcaaagtccatgcctttttcactctgataccctaatccttccatctcctctgctagtctgggaaagtcctggttagagctccacaaagggcagaagcagagatggagatgctcagagtttcctgaagaggcaaacagttaggctggcaggaagagggagaaagggtgatacagagggccctggggagctgatgctggctctccaggcttccactctgtcactagcaagtcccggggcacctgggagtgttggggaccagagactggggggtaaccaaggggagaacttgaggagagaagggagggcagcttagagaaatggagggagggtcagtagggggaggaaactagaaagttaaaataaaaatcttatacttgcaagcatttatctggggatgggagggtgtgttgactatacacttattccacgtgctgtcactacttaaagagtatttccagaacagctgcctctttgggacatgccttcagttgtccgtaatttgtccattccttccttccttattcactcattaatgcaggaatgaatcaatattgactgaatatccaacttccagaactcactagtctgttgaaggtagtacatcaatggtagctaataatttttatttgggggtgggttccatttgggtaaatagtcaaatggcattcacagccaagtctgatgctgtcactttgggctgggcttcctaagctcactgccatatgtcccttatccactttaccaagtgggcaagcaaggtggggaatgtttatctgtgttttatccactgtaattcaaacactagccctgcagaccctgtgctatggggatctgcagctttgcccagatgactagcagcagtcctggaggatggaggccttggcagtgcttgcatgagtggggaagctctagtatgtcttgtgtttctctctaccagtgcttagcatgagggacggaggtgtaatcctgctca

SEQ ID NO: 89408 - DNA, 1077 bp, Homo sapiens
tttcatttaatgctcccatctccctctgtgtttttctaaagatctgacctttttcctgttctgagcaggattacacctccgtccctcatgctaagcactggtagagagaaacacaagacatactagagcttccccactcatgcaagcactgccaaggcctccatcctccaggactgctgctagtcatctgggcaaagctgcagatccccatagcacagggtctgcagggctagtgtttgaattacagtggataaaacacagataaacattccccaccttgcttgcccacttggtaaagtggataagggacatatggcagtgagcttaggaagcccagcccaaagtgacagcatcagacttggctgtgaatgccatttgactatttacccaaatggaacccacccccaaataaaaattattagctaccattgatgtactaccttcaacagactagtgagttctggaagttggatattcagtcaatattgattcattcctgcattaatgagtgaataaggaaggaaggaatggacaaattacggacaactgaaggcatgtcccaaagaggcagctgttctggaaatactctttaagtagtgacagcacgtggaataagtgtatagtcaacacaccctcccatccccagataaatgcttgcaagtataagatttttattttaactttctagtttcctccccctactgaccctccctccatttctctaagctgccctcccttctctcctcaagttctccccttggttaccccccagtctctggtccccaacactcccaggtgccccgggacttgctagtgacagagtggaagcctggagagccagcatcagctccccagggccctctgtatcaccctttctccctcttcctgccagcctaactgtttgcctcttcaggaaactctgagcatctccatctctgcttctgccctttgtggagctctaaccaggactttcccagactagcagaggagatggaaggattagggtatcagagtgaaaaaggcatggactttgacttcagaccaggattaaaatcacagttctctctaataccttct

SEQ ID NO: 89409 - DNA, 1961 bp, Homo sapiens
taacgcttcaatgcttttaaaacagcaagataatagttctttgatactttgagaggcgctttgatgaccctcatccaagtctatgacactttcctatggttttctgtattctatgtctggatggagctgttaaaagatgaacaaattggtggatatttggggaaagcaacacaaatcttaaaactcacccgtgaagtgtgagaaaacaaggaggggaacaaatgggacttaccaagcaaggtcattgttgtgaaaagtctgtaaatgcttctaactcttccccctcttaaaatcataatagttgtacagaattttaaaaaggaaaagtttaaaatacctatataatagaagaaaaattagaggaaagcaaaaaataaaaaaaaaaaataaaaaaggaaaaaaaaaacctatagaagttagcattactgctaaaatcccagatgttgtaggactgtacttttgtagagtttagacagagcatcaatcccttctccccgcgagtgcagtcggatgccgttgtccccaagggccaggccgaactcgccccacacctgcgggcgcctggctgccgacgccggtggaggccacgccgtcggtcgggaacggtcgcgtcgcccgggtcgccgccgccgccgccgccgtcatcctcgcctctcgcttccctctgggagctgcgcgcgcttcactcaccttccgcttcactcgccttccacgcttgctccagagactttccgggcaagggagaactgggaactttcatcttaaaacaactagacaacacacacacacacaaaaccttaaaaaagagagagaaaaataaacaatctttgaagaatttctgaaactgtttacaaggaattttgaaaaacagggatgtttaaatgatgccggctctgtttttctgtaaataaatttgcatattttgtaggacttttaattgtaatgatagagaaaaaaacaaggaaaactatttaatgaaagcacgatatttatctttggtaaatgactttagagcagttaaagacattgcttaaaaaactcagaatcagaaaaaacactgaattatttaagaacacatatattttaaagtataacatatttattataatttatttgcacccttgggaagattgctttggcattctgccttgattccttctcattgatgtccaggtcatctggaggccgggggttctcagacctaccagtttccctttagaagaacaaatttccagttcctctagggcctcctgcctttcctttctttctgtcaattttgttgttgttgttgtttttcattttctttttttctcttgactcctccttttaggatgtccagatgtaaaaaaaaaaaaaaaaaaaagaaaaaaagaaaaaaaaaagaaaacagctgcagttcagtacaactgctcttttcacactcaactccctaaaactccttgtaaccttctgtaactattggatgacgctttctccagcttagccctaaataaagcacagtttaaaaaaatatttcttcattggtctgtgcctctcggactctggccagctgtgcctcacagccccaaggcttgcccactggaagtagctttggtcctctttatggaatctgccacacaggccctcgttctgagcctcagcatgtgaggctcttctgggaggtgatgggaacaataaaaggaggtcctgttccactctaggaagaatctctctggactggtgtgtgtctctgaaagtccccactgcaaattcattcttctgggttcctggcagaggtggccacagtgtccaagcagaacagaaaggaggctacctaggccacccgacctgaaggccgagcaagtgttgggttggggggggaagttatgtgacaccttagggaaggaggcagtggagggaagaggccacaataaaggaagaaggatgaggatgcaactccaaatttaccagcaagcatcttg

SEQ ID NO: 89410 - DNA, 1075 bp, Homo sapiens
gaggagtgggctgggctgctagatttttcctatcttgtttgctaggcttctgtatacatattgtatctgggctagatccctcagagacaagtttaattatgaattcatatcccgcagtcccaaattctccccttagatgtagctacccccaatccagaatgctaaagtaacccaaatcaagaaccttctcccaacaacgaaacctcagctacaaccatcaccactagacctcccagtggtttctactctgaatagaagagtatatttctttttaatgtatcatgatcatgactaattctcatactggtctctcttccttccctcccaccatcccctagagctcccatcctagcccctgaggcaggttcctattggtgtttggatgctgtttgtgttttccctcttggcttaatcagccctgattttcttcattttagggcaggatgctgaacgggctacattaaaaaacaaacctctctctatatatatttataaatgagaactgttggatgacacctttgacatatcagccaatatcaatcaagctgaagactccagacactgtctgtgtgactgtaacatttcttcaaggaaagtatagcgtctatggagttcagagggcacgtgtttgggggaaaatatatatgacatgaagaagaagatgaagaaaaatgagaaaaaaacacacaaaaggcaactttaaaacaaaatatcacgagcagacggggaggctgaagggctgggagctgggaggagacgctgcttaccgatcccggggcttttccagcccacgggcgcctgacgcaggctggggcaagtggtgcgtggggcctggtccccaaggggcggctgagaggccgccactgagcatctctatctgtcattcctttagctatttagggaccaaaggaccaaactttttattgcagatgtgtagctctatgtcaaatagagggggaatggaggaccccctccttcctgcctcatggctgttcttgaaacagcttagagcgattctatgaaaaaatgtaataaaaaattaaaaaaaaaacaaaaaacaaaaaaaacaacaaaa

SEQ ID NO: 89411 - DNA, 1091 bp, Homo sapiens
gcgtttttttatgcttctctagatgtcacatagagaaaaaaacaaaacaaaagaacaaaaaatagtcaaaataaagatgaattcctgaattatcaaacatgggatcatttacctgtgcaaaccattatttttttcttaaaaataaggaaaacatcttaaaaatatctatgcgtggttgatttacttgcacttgaaaatattgtgattttatttttttctagaaatttgggggcctttttcaattgacactttcctaggtctggtctttttccagttaggctattttcaatctcacttcaaagggaaaaaaaacaaaaacaaaaaaacaaaaacaaaatatctacagtaacagaatgataaaaaaattctaaaccaaaaaactagagtacaaagccagaggcctctgcaagagagcccggtaacaattgtaaggtttgtattgtaaccacttctgctaaattaaatgtggggaggggaggctggggactgggggctcgggagggttttttttggttggtttggaagaaacagtactaacaaaagcaaaatgcacctttttgtttacaactgaaaaagggtccttgacaagtgttttttaattttattattattttatttggtgttgtaattgtttagactgctgtgtacggtttgctgtttgttgaatcaacagtgtgaaaaacctgccagcatggattgatatacgcatgacgttgtcccctcaagtgggggctttgcagttctaactttcttgatgtaaccagtcacccccatgtataagtggaagctgcttgctagaatggagatgagtctcatttgttaattcacaatgattaagcattcgccttctgattctagtcagatcatgatttttttaaagcaaaacaaaacaccaaaaagccaccattcaaaacaaaatcaagcactgtctgagttaatttatttaagtttgataattaaatctcttctgaccttttttaggttttcccatccactcccttgaagttctgaattcctctaaattccctggcatgtatgagaaaagtattatgtgtgtgtatgtgtgtatatatgcatatacatacacacat

SEQ ID NO: 89412 - DNA, 1091 bp, Homo sapiens
agtgcaccaagcatcttgtcctgaccccagtgagtcctgtgactctggctctgagtatgcttttggagagtgtcgggtccaggctttgcaggcacaggtgctttgggtctgacctatacagggccaggctgtagctttcggcctggccctcctttgcttgagaccagctgattttaggacctgagatctgaattggttcagcttggccataatttcctcacccagctcggtgagttggacttcaccatgccggtcagtgatcccactgccacacctagggctgtgctctgtgagcctccaccccgagagtggtcgggaaggggtcaccctgcaggcagaagaggagctgctgcctaatgaagacagtagccagctgagcccgtggagtcttgggggctcctcagggactgagtgtgagggtgtgttatgtgtctagggccacacatgtgtgagagatgagggtatgtgtgaggaagttccctagattgagctttagggacaggggctgtgtgctattcaggtttgtgctgcagtacacaggacagtgcctggccctgacaagcggttgcactctaaagctgggagaggagcaggcagagtgggaaggagtaaacgcccatgaagggctcagggctggaatggagggagaaagaggagagtcccagggagtccctgagttgcagttgccacagcccccatctgatggcaataccctccttagttccttaggcctcttctcccgtgccaacgggagctgcccgttggccatcctgggtgggtctaagggcttctgggaggagttggaagtggcatttcaggacttggtgggcatgggacggtccctgatctgggggaaggagatccagtgttggaagagcaaagaacccagccctggtgggcaggcaggctggggtctgcagaggaggagtctagggtgcttctgtgaaggttgagctggaggccgggcttgggctcagcttctttgcccctcatccacagtgatattttaagatcccaggcctcccttcctccctccctccctccctgcaggaaagcataaagctgagagtgaaagtctgctgtatgtagaa

SEQ ID NO: 89413 - DNA, 1070 bp, Homo sapiens
acaggaaggcccagcccataccctgcctcacgctgctgcagctgagggacactgggctaccactggtgaagtgggggtgggggtggtcccctcatcaggctgcagccctgggcctgccttgcccttgccttccccacagtccaagccttcatcagtaagaccagggccacaaggggtggggtccaggagtccccatgttgcccgctccaggtccagaacagagagctgtgcctacaggccctgatatcttttctcccactggtgccattgtcagctccctgaatcactctggcctattggctcaggggtctctaaatcctgccccacccttcacacagccgtaggtcaatggcaccctgcccaacacacatgacagcccctactgcaggccttaaactgaggcccccatgggccctcctgcccctctcccaccctacactccaccatcccatatgtgtagctctgaactcctcctcattccttctctccatctctgagcagctgcaattcctgcccccccctcccccaccccacacacacaccttgctccctagtctaggccctctgtggccagtcctggctccagcctctccttggggtggcaggatctgctgctattgtccccattctcccaggccatggtccatgggttgagccaccccagggatgcaggggatggggaagagtaatgcacgataccaacagagccgcacagcatgggcgggtgagagcgcggcactgggagtggtttgtcaggaaggcttctgtgggtctggaaggatgagcagaggttggcagcacatagagctggggaggcaggaggtccaggcagggggaacagcgggattaaaagtgcagctgctgcagagtccaaggtgagcatggggccagggagagacaggcgcaaggtgggctggagcctggccaaagccgtgtcccacagagttgtccgagtcatgaacaagaaagaaggctgtgttcctccaaccctgccaagagttggcttctttatgtcatggtcccctccccatgtggaatgtcatggaaataccaggatattctggtggcag

SEQ ID NO: 89414 - DNA, 1067 bp, Homo sapiens
gccgctcgtcagtcgccggccggccggtcggcccgccagcccgctcctgctccccggcaaagttgggagggaaaggtgtactcacctttgtgcatgcctgtgaacctgtccttcagaaccgtaagctcgtagattttgccaaactcctcgaagaggggcttgaggtccttctcatccaggttgcgggggatctgcccaatgaacagcttgatggcatcgtggtccttcatgggaatggtcgacgggttccccgggctgtggcttaatccgttcatgtgcccggcactgcccgggctgctgccgagcccgttggtactgaggcttgcgttgtcagcctgtccgtttgctaacgtggccatctttatatacatagagaaaatcttctttccttttattctttctcgctcacactctctcgctcctctctctcgctcgctcgcgctcacacacgcacacgcatacacacactcgggttctctccccctcggtttctctacacctcgctctccgctcgctctctgctctctctctttctcctcttctctcgctcgctcgcgctcgcgctctctctctgctctcccccctctctctctccctccctccctctcctctctctctccctctctctctccctctctctctccctctctcctctctctctcggtctgatctgattttttttttctttttttcttttttttttttttttttttttttttacattgaacagacaggatctctgtcctttccgtttaaacaggctggaccggttcaagttcccagccagaccaggggtgggggtggcgagtgtgcgcgcgcggaggagggcgcggggggccgggaatgggcgcgctgtgggggcccgcgccacggcgggcggcggccgggggcagggcggcgtggggcggcggccaccgcgcctcccccgtcggcggccccgcgccgtggcgatggtacagtccgagacggcccccggctataaatagcgccaggcgcatggctcttcgggaggcgctgagattccgggcccggcggccgcggggagcgggtgtccgtgaggagccggg

SEQ ID NO: 89415 - DNA, 1041 bp, Homo sapiens
gataatgtcagactgagagaaataaagtaatttccacaaagactcatagttattaaaatttgtgatgggattaaaaccgtatcatttctaattactcaatcagtaaccacgctacccatttgctttgattgttttctgaggtatgatcccaggtaacgtgtatatggattttgctttttttccacataaaaattaagttttcaggatttctgctttcagtattcaaataaacctttacaataagacaattagaaaaagtggactaaatgctttccttcttaaaggtattagacagttataatgaagtgggaatatatgggtaaaatattaggacaatggagtaatttagaaagattaactcagtttttggatctgcattttccttaaaagggtctaccgatattagaagaggtggtgaagaagctgcctaatactattctttttactttgtatgtatttgaaattttctatgatacataaaataagaaaaaaaagctttccatgaatgtatcctaacccgcttttcaatcccaggccctactgcttattgatccttgaacattgtttgctgtttcctttgcctggaatgtcaaatgttcattttgcataacaaaatattttcatttttcatagtctgaagtcattttctccatgaagtcaagattgccacacaaatgaaaatagcctcactgtgtccacttgccactttatttgactttcccattgcactgaacgtattccctttcaagtatgcatatttgtgtatgcctgtcacttcataaacatttttttacagagaaagaactatgacattctcatagtttatatccctctgctttaacaaacacaggggtaaattaatttctgtggaacctgaagcttatgcatttgcagagacgaactctttagtaaaaagaatacaaaaatacaaataagaaattagatagagtgcttgggagactgtcatgcaagttaggattcctgaaaaccttagcttcgatatatctacagtaaatccatttcagctaaacatattacaaa

SEQ ID NO: 89416 - DNA, 1038 bp, Homo sapiens
ataattagcaaagctaaaaaaaacagtgcttggaaatttaattaaaaattaaaaacaatcattcccaagttaatcaatttaatgcatttccaattaaaattccaattggattttttgctttgaacttgacaaaatgatggtaaactccatggagataaataatagaaaatagtagtcaagaaaaattagaaaaagaagagtatttggtaggaacttgcctgtatataataaaacatcatagatttccatacaagattgcataccaaataggttttcacacccagcttctctaaaatctccactgaaacaatgaaatgaaagctttaagatatgacaaggaataaaccaataatagtggtatggaagggagccacgaaagaagagagagtacaaagatttgggcaagataaaaatggatgaaaatgtatttgtaatacaatcaaaggaatgaaacctccatgacctggtataatccagagaaagctggaatccgtaaagaattcccacctttcagaatcctggatggaggggccttgggctcagtggaggcagatgctagatagtaagtgtgagaagtagggctgacaacaaagacgctgattaaagttctctgaatctagcaggtgaaccaagtgactttttcacccctcttcccttctattctttcctgctctccttccttgaattagagcaaaggtagcttgatatttatccccaggcacaacactagaacattactgtcaacagaaatgggtcgaatggttgaagagagtggtcacattgacaccttggagtaaatccgggctcactctgacatttgggaaccttcagccttggaatgaacatcatcttgttcagagaaaattagaaaaaagttgtctgaagaaattctgtatcccaagagataaaaacgtccaatactggtatgtgagatctctttagcatatataacaagaaccctaaagcaaaattgtagctccaataaaaccagggagcaaaggaggaaactagacccaacccaggagaccatttaagaca

SEQ ID NO: 89417 - DNA, 1076 bp, Homo sapiens
tttggaacaaaaggtcaatataagcatagcacgcatatcccatattcttggaatagtagggtcagaagacacaatacctttaagaccagaatacttctgaaattgatctatagatccaatgcaactgctagcaaaatgacaactggcctttttcttgtcttttgaggaaaagtgaaaagaaattaaccagctagtctaacattagcatgaggatgcatgaaattcaaaacagccaaatcaatctcgaaaaaagaacaaagttggaagattcacactttccaattccaatagttaacactaaattatggtactcatgataatgtaatactaggataaagataggagagacacagatgaatggaatagaattgagagtctgtaaaaaaaaaaaaaccttacatttataaatgcatattaatagagacaaatgcacataataattgaagatttcaacactcctcacccagcaatagacagaactggtaaacaaaaaacatatcaacaaggattaaaaaaaaattgaataataccatcaactaaccagaacaatttgacatttacatagtactctatcaacaatagaatatacatgaaacattccccatgataagttatattttgggtcataaactttaacatgtttaaataaactgaaatcatacaaagtatattttctgaccataatgaaaagaaataacaggtcaatgacagaaaacatgaacatctccaaataattgaaacgtagaaaacatggttataaattattgatacttccagggaaactagaaaactttttgaacacaaatgaaaatacaacatatctaaattagtatgatacagctaaggcatggcttagggggaattacataacatcaaatacttctgttagaaaacagtttctttgaatcaataatctaagcttacacctcaaaagactataaaaagaagagcaaaataaacctaaagaaactataaaaggaagaaaaaataagtccgaaacaaacagaaggaaaaaaataacaactagaaactgaaagcaattacataaaaaccagaaaaacaataaagaaaattaa

SEQ ID NO: 89418 - DNA, 1088 bp, Homo sapiens
aatatttcttaatgctgttaccttaccaaaagttttagataggccctgtattcagagttttgtgcatcccattctttccaaaataacagccaattctttgggaagcatggatgacttttccaagcaccatcatcggtggttgattaggagattccttttgaattggaaagatggaaattgactatcgtggtcaaatggtttcctggtctccctaccctctacctcaatagcatttgttcccacaagtgctctttacttgcaaatgttggacaatgtagcactctccagcagacagacagattaactataattagctataattttcttaatgataaaaccctttgggggctaatttatacatcatctggttttggcactggaatcctttctaaacatttcaaagggtgtgctcacactaacacaacacctgaagcaatgctttgcaaatatctggtattcagtaagaggatctttatattgaaataaatgcaagtcacagctgtatgcattgagaaaacaagcagaaaatatttatcaagcactgtctgaatactcagactaattttgtgaaaactgaagaaacattataaaccttccaggtagttagaaaaaaattgactgacttatgaagaataattctaagctgagttctggagtgcttggtacagatgatgtgcactgtggggaacggcaaaggaagactttgaattagagatgactacagtgaaggatctgaagtggacctttaatgaacaactcaatagatggagaaaggggagcagggaataaaggatatttcaaaggggcacattaccagcaattgtgctgaggcatggtggctcttaattattttgatctgctgctgctaactttattgagcatctctcatatgcaagcgttctgaagaataaaaggatgagggagatttctatcttcaagaatctctctctttgaatgcagagctgacaagagaaacaaatacacaaagctgaaaaatacaagataagaatagggtttcactggctgaggttcagaatcactgggaaagtcttaataaaacaggtacctggggctcacctaaaagtttc

SEQ ID NO: 89419 - DNA, 1066 bp, Homo sapiens
agctaacttcttgaagtattagaagcaaacatggtgtgttgtcttgcaattgaaaattaagttccgagaaggtggtgtatctaactttggttacatccatcaagttagaagtgaatgatgaaaaacacccttaagagggtaatggctacaatggcaagtttcttgattagatgataggttggaccacatgatctttaaggtattttccaattcttaatggccagtcctagaacactacaatccatgcaaggatatgttaatttactgactgaattatgctgtgccacctccccacatcacttggcctgtatagtccaaactccagtgagtttaacaagcatttagctgcttgttaagatcaagcttctggaactttaattaacgattgacttgttactagttttattttatttgagactctgacttttcatttgagggcaaattatgctcatcatttggcaaaaggtctactctggttatctgatggcagccttttatgtagcacatttttatgacatgtcacattgacatgatgatcacttctctacagctttgcacacttagaccttaggatttatacttttcactgagttctttccactttatataaagtgtatggtaattcagaaaaatatgagatgagaagaaaagaaaaaaagtcatgcagtgttctggctaaataaacaaatgaaatgttagcaatgaagtgagcacaagataggaagggaaaaaatgatctcatatggcctgactatgatgaaaactatgtcacctaagagtctgtacagaagacatcattcaaagtcatgtgcaccacaaacacacgcacacacacacaaacacacacgtgaaacatactttatactaaacgaagatttgatgaaggcatttcctttaaaattaagtaaaagcaaatatgtctgatatcaccatttttattcaatattatgccagaaggactaagtagcacagaaggccaaaaaaaaaaaaaagaaaaatgtgtgaggtttgtaaaggagcaaatatatacctagaattgttcaaacaggaacaggatataattgaa

SEQ ID NO: 89420 - DNA, 1094 bp, Homo sapiens
tattttcccttgaaggtggtaacatatggagcaataattatagaagattttcttccatcattaccgtatttaacacttttttttcacatggaatattcatttctaacttggccaagactcaatgttttcttttcaaatgagtaaacctttgttgagttttcctgtactgtatgatataggcttagctaatcagcttcacccagctcatatattataacaaaatgttgcttagaacaactcagtctagtggcattgatgatgaagctattggatttaatggcctcatttcagatttaccctttcaaactataattttggtgtctgtgacactaatcatttttcttctctcctatccctctttctcctcttcctcttaaacctcctctcctcttcattcttcttctcttcctctttgttcttactgccttttcttctttctcctccctttttgctaagtcacatggcaggcagtcatgacatccttgctgatgattgtctttaatccataaaccatgacaaacaatgtgaattccctgattcttcaaacagactaaatttgggtcaactctctctaagagctacagggtttgtcctatctccacaagtttcttaccctctctcctgatttactcctagttcagtttccaccaatttgcagaatcctttccttactgctccaaatggactggcattgtcaaattctgcatctctgacttctctgctttgctaatctggcccttgccatgttctgtactgcactgttcatcaactttcacgtgggtaagatttaaggtatctagggaagaaaaggggaaaaaaactcattggtgtgatcctctaccacatgtcaggcagtgtcaggaacttcacgtagattatcttctttaatcctaacaacaactggatgtggtgggtctcattaacctatttatttatttatttatttatttatttgagacagagtttcactcttgttgcccaggctggagtgcaatggtgcgatctcagctcactgcaacctccgcctcttgggttcaggcgattctcctgcctcagcctcctgagtagctgggattacaggtgtgcacccccac

SEQ ID NO: 89421 - DNA, 1104 bp, Homo sapiens
cccctcatgccctttccttcctcaaagcccttttctgtgtggtgaattagaatcctttcaagccccatatgttccttccctcaaacactgaggccgaaaagtgagttaatttttcctcccaggatgagaactccctcttatatgttccccatttccaacagtattatctcatttccttacaccagtcaaactcagaagaagtggtttttcattctccctacagcctcttcaactaccagatccttcagagcagccagcacaactatcgcttcagcttagttccttatcctgtccctagatggatgaaagcaatggttgctagtagggtctggctgctgcccatctctccctgatgtagttgcacactattgccaagttgttagtctaaaattactggctcttttcttctgaataacccaaatatctaaacctggcattcaaggcctccaatggtgtgtcttcaacttactttttccacattcatgtcccacaactttgctaacatacttaatctgctccagccagtaatctagtttacttactgctccttaaacatacgtcaaacgttttggcttccaggtttatttctgcacccttcttgcagcctagaatgctttctttttccctcatcttcaagaccctcatgaaactccaaatcatcacaaagttaccccttatcaatctggcctggcatgagagcttgttcttctgcagctaagaacacttattctggcaatatgaatgcagtcacatttattctgtgttttagttcattctcatgctgctaataaaaacatacctgagactgggtaacttataaagaaaaagaggtttaatggactcacacttccacataactggaggggccacacaaccatggcgaaaggtgaaggaggagcaaaggcacgtcttaacgtggcagcaggcaagagagggtgtgcaggggaactgccctttataaagccatcagatctcatgagatgttttcactatcacgagaataacatggaaaaaaatctgcccccatgattcgattacttcccaccaagtcccttccacagcatgtggagattatgtgaactacatttcaagatgagaactgga

SEQ ID NO: 89422 - DNA, 1028 bp, Homo sapiens
atggatgctgcaagtataatttagtaggattatagaggaatttcttaatacctataggcattgatcaaatcatttgaagtagaaacatactcagataaagtattatgcatgtcagtattataactgcaattgaaatagaaatggatttatgtttgtagttagcatattgacattttgataagcacttgactgatttacatgaccaaaaacaaaaacacgtctgtggcattttaaaattctttaccatcctgtgctcttgaatgcataaatacttctggatagtctgaaatattgtccaacctgatgtttggagctcagatttttagagatagatctattgccatcggttcagataaaatttttattattattttacatatgaaactaatttatttagattcatagtttattcagcatggcacattagcaagaccttgtcaagatgcagggtaaatataatgaacatgaagttcctgtttttttcagaagagtattgtggatccttaatctgacttcttgacacttcttatttgatagactatgtagtgcagttctgatgtttgatcagcgagtgttattcagcactctggtaggctcagtgtaggatacacaggctgtatgcttttaaggaaggagtgttcatggaagacaggatgtgaccacatggacagccagactgtgccatagagggttcaaccctgtgtgtcccaggtgtcacccagtgtagctggaaagggttttcaaacagcagaagcctgaactctggtgatctggccatatcgaaaccaagtattttaatggtgtaatttcttcagtagtctttgtggagagatatctgtctgtctgtctgtctatctagcctatctatctgtatatatatatgtgtgtatatagatatagatatatatgtatatagatatgtgtgtatgtgtatgtagatatacacacacacataaaaaatatatatatatacttaatactttttattctggaaaattttaaacctacaaaaatagaataatacagtg

SEQ ID NO: 89423 - DNA, 1051 bp, Homo sapiens
atacagatgtgctttgaaagcataaagcactaatagcttaatgttatcagtattaatgaaatcatttgaggaacagaaaattctcgcataagaagtcacatatctgtctggagcagtctggtaacttcatgtgataaaggtagtagattttctactttgagtttttgttttgattgttttttttcctgatttattctcagaagtgcttttgagtatgagtaattttgattattttatcttcataatgtaaattgggttttgaagagtggttaaagaaaatcatggtttgtttaaaaagttctaacaggttgaaatgttttcccaggtttttttcgccattatattatctggtgtcttggtgttttctgagttttattaaaaaatttaacagagctgtttttcatgagctctattaaaacaattatgtttttatttaaaatggaaagttgcctttagcaaaattgaggtgactgccatattattttttagagtctaacaacatttttggaaccttttcctctggccaaaactttttgtgtggtttgttaatttaaaagaaagatatatatatatgtatttctgatttatgttaacttcatttccatagctggaatgaatggctgaaactaccagtaaaataccctgacctgcccaggaatgcccaagtggccctcaccatatgggatgtgtatggtcccggaaaagcagtgcctgtaggaggaacaacggtttcgctctttggaaaatacgggtaagcattctgttggtctcatctgtaggagtgtagcagctttctgacccttttctttttcggaatgagggaaggctttaatagtttatgctcagtctccagtgtaaaccagttaggtacatatgatttgatcattccttacactgattttaacatatatttcctacaggatatacagatagattaggaaatacaatttatattgctcttctgttggtgatttaatgtgatttctagtagaaaatagaagtcattgggaaatagaaccttgcttttagggaaaagtgactatgacatata

SEQ ID NO: 89424 - DNA, 1054 bp, Homo sapiens
atttaaattttgattttagtcattgtaaatgtggcattcttcagttggttaggaatttgatctctgttattccttagatcttcaccaaagtgatgaaatgtgtgtgctcatttctcatccttctctccttccactctctgtgtagaattctctgtcatagttctgagcgcttggaggagaaaagaatggcatgtgcaaagcagtgtgacatggattttagttgcttggttaattgctttacattccattgggggcttaaagcttggcagtggagatatacatttccatgtatagaattctctttatttttaggaatctaaaatttcctgtaatgaactgtattaatttacttctaccctgaacattctctttttccctagcatgtttcgccaagggatgcatgacttgaaagtctggcctaatgtagaagcagatggatcagaacccacaaaaactcctggcagaacaagtagcactctctcagaagatcagatgagccgtcttgccaaggtaaaaaaagtcatttggaacaggtgcaaagctctgactgatgtctattgtagtatatataccttgacattatgaactctgtcagatttttaaaaaatctaaatcttaacttttaaataattgttttattgagatataattcacataccataaagttcacccttggaaagcatacagtctgatggtttagtaaatttacagacttgtataatcatcaccactatataattttagaattttttcatcacccctaaaagaaaccgcaccattaacagtcactcccattttctgctccctgcagttagttccaggcaagtactaatctacttactatctgtatggatttgcctgttctggaaatttcatataaatggaatcattcagtatgtgaccttatgtctggaaatctgtcaggtttgaaaatgtggagcgttggtgatattttcaagatgaccacccactttttctggtgacatagccttaaagttgttagtgtaacattctagagaagcttatgccacttggaagtgaagatgactcagac

SEQ ID NO: 89425 - DNA, 1033 bp, Homo sapiens
tctgttcttaggttgcacacttttcttccttttgatttttgttacacatattgatttctatggtttagtcatataagttaagggtgaacttagcttaaaattgttagaaggaaaaaccattctttttatttttgaaataaaatagttctcatgaacatgtgtgcaaaataccttcaagattataaacccaaactactgaataaaccaaaaatgttaaatttgagaaagcagttataagtgcatagtagacactactgaataaacagtagtgctgtctataataaaataatagtgctgtgtaaaacacactacatgtatataataaaataaaaatgtgttatgttttgacttgtatttgatagatacatgtattactgaattaggaaaaatgatacatactgatcctttaagagaatgttgaaaataatcatttttcatgaaaatcattttttttttcagagtgaaaaacgaagttctaatttcatgtacctgatggttgaatttcgatgtgtcaagtgtgatgataaggaatatggtattgtttattatgaaaaggtatttcccttggaactgtttttggtctctaaagtagaggggagaggaaacattaaaaaaatattgttgttcctgctgggatgaattatttggttgcagggtagcagcagacagctgtcagcagcagctgtttatgtatacagaaatcaaatcatataactacaacaagattacaaaagcctatcactcatgtaatgcagttctgggttacagaattcaataagtatgcaagtgattaaaaactttgtgattaattgttctgcaaattggcaagtaggacactaagtaatggcttcatttactaatattatttatttaaaaaatgaaagggggaaattatatttctaagtggtaggctatttattgaaagttaagagtctgtttgttatttgagtgtatgtgtaatgtctatatgtggccctcactgaagtatacttatgaaatacttcagaaatgtccatttgtacaatagatgcaa

SEQ ID NO: 89426 - DNA, 1031 bp, Homo sapiens
ttgtgattattgtccttgccctcagtaactgatagcttaaataactgctaagatgataatacagtgacatcacaaggtcattagtagctgacaggaggaaggaatgctttagtctatgttgtcagggaagattttacagtgatggtgatatttgattggttagaggatatggaaaccttgaatatgtggagagtgaagggacgatgttttaagaagctgtaatgacgtgtgtattatgggactagtggagtttaaggcatacttagtttcccagtcttgagaaggatacatatttttaagatatgtagaagactgctaaagttgtatcagaacaaaacattagatattattaaatgctcctaagtaccttttctatttatgaatagcttttgaaatttccttttggtgaagtttacattgtcaatattttaaaataatttgtaggagaatttagttgagagcaaacaccacaagcttgcccggagtttaagaagtggaccttctgaccacgatctgaaacccaatgctgccacgagagatcagttaaatgtaagagaattatgaaatattaatttaaaaatagttaaatgggtgttctggttgaaactgatagctatcacctcacttaaaaattatttagatgcacattttctccaggttgatgaatcctacatcatgttcataatttcacagatcagcagttctgttatcatttggggctttccataaatgtgttatctctggagacagaactgcatatactgtatactttcatgtcagtagtattcttagaagctggccctaagacattgcctgagaggacttagtgtgtacacatgccttgttgtatgcattgactttaaaagagtttattgtgtgcacatttttcctttttctggtagaagacgttgttattttgctaggttttgtttctggttgaattaaatgaactctccagttaaatattttcctatggaatatgactttatcttcttttcttctcctttaaactgcattttggacacataatt

SEQ ID NO: 89427 - DNA, 1187 bp, Homo sapiens
aactatatgctggctatttatatacagttatttatcagttaatgacagggaagtgttctgagaaatgtgtccttaggggatttcatctttgtgcagacatcatggagtatacttacccaaacctagatggtaaagcctactacacactgaggctgtgtactcctaggttacaaacctgtatagcatgttgttgtactaaataccttaggcagttgtaacgcaatgctaagtatttgtgtatctaaacatagaaaaggtacagtaaaaacagagtattataatcttatgggattactgtcatatatgtggtcctgtcttggctgaagcattgttatgtggcacatgactgttcatgtaaggccatcagggaaggaagaacacttttttgacaaaaagcattgctggattttgggctttaataattctttatagatagactaatccagcaacttgttttcttaatttttatagggtgaatatgttcttaaacataacctaatagtttatgctagccagcagtactttatgggatgtggagtaacttctcaagcttcaatatatatagcaatgtcgatcgcatagaacaactattatcaaatacctttttaagagggaggggacagtgagatcattttgaattagtggtatctgaatttcaagaagcaaattaaatatttattaaagttgatcattgtatgtgtgtatttaattatggtgaaatttaaacactaaagtaaatagtataatgaaccccaacaaataattcatctgtcttcagcagttgccaatttataaccaatcttgtttcatctgtaacactgctcagtctctccaccccaaccccctaacctctactagattacatccttctgacttctggcctactggctttaacaaatcagggggctcccataaccctctccttgggtgtgataatttgctagaatgactcacaaaactcagggaaacattacttactattgatttattatgaagggtatcctaaaggatacagaagaacagctagatgaaatgataatttgccagaatgactcacaaaactcaggaaaacattacttactactattgatttattatgaagggtatcctaaaggttgcagatgaacagctagttgaaatgacacatgggttgaggtcctgagcacaggagcttctgtccccatgga

SEQ ID NO: 89428 - DNA, 1079 bp, Homo sapiens
gagccaccacacccggccttaaaaatcatattcttgaataaactgcttgcgttataattattgagccaaaagatatctgctttttacattttgcagacaatccccataagtctttttacccttgtcttatacttttaaaaaatttgttcctttataatactttaaatatatgactagacaaagcttttcttctttccttttttttataattttatttacagtttttttacatttgttctttccatgaattttagaataattttatcattttcttaaaactgcaccagaatcttaagtggaattacattatgtttgcatattataaaaatattgacacctttatgacatatcttccatcacagtggcatatgattttttattcactcacttatcaattttactaaaatcatatacattcttaacattttgatttattccctggcaattatattattgttactattataaactagcctaccccatttatcttttatttacatttcttagttaaaaggaaaactgtttctgttacaatatttgttttatctcatcactttattgacttttcttactctaatagatgttaggttgcttcttatattttgtaggtatagcattatggtagctgaaaagcagtctagtttttcattgcattagctaaaagctgcaagtaataatggtgaataaaagtagttcaatattcatctttgtcttgttgctcattgtgggtacgcttttagtatttcactctaatgtgtgttgcttactggtttcagtcaaatgctctcatttatgtttaaagtttctccctgtctctgtttgttcttttctttttctgtgtgtttaaatcaagaatggcttctatatattatcaaacacgcttttgacactcgttcatatcatatagtgtctcatttttatcaatctactgtaagtatgctgatacatttcctaatgttttatcagccatacacttgtaaaataaatctcaatactgtctgaatttgatttgttaatatctgatttaggatttttttaatggctattctttatcttgcattattttgaaatttttaaat

SEQ ID NO: 89429 - DNA, 1036 bp, Homo sapiens
aagggtagaaggggatggcttggatttgaataataccatattgacagtttcaccatttagaactgctgttttttgttttaatgttcggctttagattcatggaccacaaattgaactgagtgccaaggaaagtttgaggtagtgctatgttctctggtttggctgcagccccacttctctgtctttccttctatttaagtgattcaaacatttgtttcctgcctgccttttgagaaaatttggagtttgtgaaccctgctacatgagaattcctagcccaaataccttggatattgttagtaccttcgatagaggtagaaaaaattcaatttaatgtgataagtttggttttacatgtgttcagttagaaatgacaaacagtgtcttgaaaaggggatctggtccttgaaaattagagtgcatgaatgtgaaagcaggtcatgtaatggaattcaagattagaccttagatgtaaaaaatgaatatgtatttatatttgaaaattatcaataatgagatagtagctaaatccacaagagtggaattattcattcaacagtaatgtattaataatatgttgagcatctattatgagctagacatggacgtgctgaagatatagtggagaacaagacaggtaagccctcagctctcatgaagttgaccatctgaatggctgaatacagagtatactctcccagaaatagtggaaagcataataataagcatccgtgacttgagatttgggaaacattgtcagttaagaaggtcgaaaagtttcacatgtgttttaaagataaaacagtgtgaaagtcaacttagtaaaatcaaaaaagtctgacctgggagcccaaagtcctgggtttcaatctcagttttacaatcagtcataccaccatagacaagacacagcccctctaagtttcactattgatgaagcaagcaagttgattgagattgatggttttcaaactacacatcatcatgatccactgaaagtaatttaaagtttcacagtctagcatttgtatttaaa

SEQ ID NO: 89430 - DNA, 1070 bp, Homo sapiens
aaactggatgggaaaggaaaaattacttaaaattttattcatcttttgaaaatataagtgacaagaatagcttcagagaggttttcagaataagagagtcttatgtaataccaaagtattacacagattatgaaaataatagtttttgttctcgagttactcagtaaatatgtgagcttagatgatttctgaggatgttaatactctacctcataaataggagaaaatgcttgttttggtggcaaaagttttagaaaatttgggatattacacaaattaaggcattaccactcttagtttaccttttattgatggttgtatgtgttcctctttaagttttcacttttaaaagtgatgataaaatgtgttttattactccaattttattatttttgcatatgtaaattaatctgttttagtgaaatgatatgagtatttacaaactgaatctaagtttcatttcacatcacatgaatggctcaaactatttttaaggtatgtgatagtggaatgtgaagatcaagatactcagcagagagatccaaagacccatgagatgtacttgaacgtaatgagaagattcagccaagcattgttgaaggtaacccttaaatgtgagggttggcaaactgcagcacatgggccaaattcagcctgttgcctgtttaggaacatcccatgagctaaaaatggttttatatatttatttttatttttatttttttgagatggaggcttgctctgttacccaggccggagtacagtggtgccatctcagctcactgcagcctctgcctcctgggttcaagagattctcctgcctcagcctcccgaatagctgagattaaaggcgcccgctaccatgcccagctaatttttgtatttttagtagagacggggttttgccatgttgggccaggctattctggaactcctgacctcaggtgatgcacctgcctcggcctcccaaagtgctggcattacaggcgtgagccactatacctggcctggtttagcggttgaaaagaaatcaaaagaagaagaagaatttgtgatacatgaaaattatg

SEQ ID NO: 89431 - DNA, 1046 bp, Homo sapiens
cagtgaaagttagaaagtagggttatagtttctccaagtgaattaagtttcctttttaaactcaaaaaatgcactggggcagcatagtgaaatttttgcttaatatttggtcatgcaaaattaaactttgaaggaaatttcagtttctctctgtggcttcacaaatccttggaaacagaaattgaatctttaggtccaacttgaataaattcctgattctttgtcagctttagcaagtgaaatgtattctgtatccttcctgtgaaaagtccaactttcacagtcaagcgattgtttggtttaaagcatgctgctgctgttgttagggattatttataagtgcttgtctctcacatacaacaccatctcctttatattattttggtgctttgcaaatacttttaagttaatggaatcaatttttatgtctttactatatgttttataaactactcttctattttaacctcattaatcctttctgatttgttctagaatgagagactacaggcattgcttggagataatgaaaagatgaatttgtcagatgtggaacttatcccgttgcctttagaaccccaagtgaaaattagaggaataattccggaaacagctacactgtttaaagtaattgtgatggatatttaatgtgtatgattggaacctaattcttaagctagatcagagatactaccttggaaaactattacattgcagagatcacatctataattctagttgatttagtaaatgctagattgaagggtaccttttatttatcagtgtgttttgatttaagatcttcttttgttaccggtacatgggcatttttatgtaacatgtgaaatacttttatatctctgggttgttttttaatatttaatttttttattgttttatttttgtagagatgggtcctcactttgttatccaggctggtctcatactcctggcttcaagcagtcttcccacctcagcctcccaaagtgttgggattacaggcatgcgccaccatacccaacataatatttagtttttcaagctaa

SEQ ID NO: 89432 - DNA, 1052 bp, Homo sapiens
gcgatcttggctcactgcaacctctgccccctgggttcaagcaattctcctgcctcagcctcccgagtagttgggactacaggcatgcaccaccacgcccagctaattttttgtattttttagtagagacagggtttcaccatgttgaccaggctgatcttgaactcctgacctcaggtgatccacccgcctcggcctcccaaagtgctgggattacagtggggaaccactgtgcccagcctaagttaactaatttaaacttaatttagcttaacttcctaaatctttattacattaaactgctatactatttgcccacaaaactgtcttttaacagtctttacatttggttaatatattttaccttttgattaaaagctgttacggaaagaaaatctggacttgaaattgacaccttataaggtgttagccaccagtacaaaacatggtaagtgtattttacatcattattatttactttagtgtacattgtgtgtactttttcaaattgaaaatttttaagtatgttagagatacaaataaattccatttgtagcactgaagacaagttggaccttcctgcctgcttcccttctgtctttccttctttcctgtttctcagtaactactgattaatgtaactactggttaatgtagttactgagaaacaggatatttcagacattcctgacaatcctgtagacacacatacacatacacacacaccctcacacacacaaaccatttaagtcttttcgagatgaataatccctgggagtttggtagaagattccctaggaatgcttgcctaatgcttactgtaaattccatagtcttgctgcccttcctgctttatactagtagttactgagaaacaaaatacatgctttaggttcctatccttcctctggctactcccaaatctttttgatgccttaattactcttctcagtttcttctcagaatgatattttaaaaagtgcaaatgtgcatctttacaatcctgcaaaaagtcatttgttagctttcattttctctttggacaaagaccc

SEQ ID NO: 89433 - DNA, 1023 bp, Homo sapiens
acttcataaatgtctttaccactcaaatgaatgcatttggttttctatctgcttccatttcaagattatttttccacagacttaaaaaacaatttaaccctgcatttacttatgttatcttacagataacatggttacgagttatgggataattgacggttgacttttaactgtgtccaatttgatattagaattgctaggcccatgttataatttaaggtctcctgaacctaacttaagttttgatgcaagtgacttttgtaatttaacagaattctacaagattttctcttttaaatagtactttgagtttcaagtgacagacatgaagattgcatatttgagaattcagatgagaaaccagagacattagaaaacaaattgatattaaagttgcacaaactgcttttatattcagtagaatgtataacctggtttgcatttgttttcacatattttttttaactgttactgcagctggatattgcgtgatcacctatatacttggagttggagacaggcacctggataaccttttgctaacaaaaacaggtaacaattaatgactaccagtagacatacattgtatatgcccatggtttttacccctgaatctatgtactaacaagataagttgcggcctggcgcggtggctcacgcccgtaatcccagcactttgggaggccaaggcgggtggatcacctgaggttgggagttcgagaccagcctgaccaacatggagaaaccccgtctctactaaacacacaaaatttgccgggcgtggtggtacatgcctgtaatcccaactactcaggaggctgaggcaggagaatcgcttgaacccgggaggcggaggttgcagtgagccgagattgcaccattgcactgcagactaggcaacaagatcaaaacgccatcttagaaaaaaaaaaaaaaaaagatgagttgcgtaattgaagataaatcagagagtcttaaaaattcctttaaatgttaccttggaagaacatttagggaaagtcc

SEQ ID NO: 89434 - DNA, 1066 bp, Homo sapiens
agttccaaaattgtcagatattctctctgtaagtagaagttaaggaaatcaaaagatcgaacttaaggaatatgtttgtcattatctgggatgcagacatgagagagctagttcattgaagatacagccttagatgttcctccaccaaattgttcttgtcttcacttcttacatttacctctcttttacctcctgctatcttgtggctcaagcactctcagatcacctggtatacctccagtacagtgaagagacaagggcactgagctggggctatggattgttgcactgtttgtcatttcttctttgtagctttctagtagtgaaaccctatacttcaaacactaaatggggaccacactttatccacttggaatccccattttctcctagcctgtctttgagaagtatatgtgggttatttacaagagaaaggagtagtctgtaatggttgtgtgtggtggcgtaggattgtctggaagcatgtgccagttaagggttcttgagccggcttcgtgaattctctgtgcctcaatttctgcatattatcgatgagatattatctactgtatgtttgcgtatcagtcggatgaaatgttgcatgtataatatttggcatggcattttgcacaaagtagttcttcagtaacattgacttttatatatatataaaatatacgcacataaatatacatactagtttttctagtacttaatgctactgaaaatcaagtgtagctttaaataagactaaaaaaattattttatctttggaaacgatagacctattgatgtagttttgtgtggggatgtagggaaattcaataggaaaggaaaccttagaagatcacatttagtttgtcagtgattgacattgttcctgttctcatatagacactgaaggtatgggagaatattaatataatctcaccttgcttcatccaattcacaaggaataacaggaataaagtggattattaataaacattccacaatttaaatcatatatagtaactctagattttagattaaaaaaaaaggcacacctttagttaaaagagcagtt

SEQ ID NO: 89435 - DNA, 1046 bp, Homo sapiens
tgaaataaaccaaacacaaaataccgcatattgtatgatttcattcatataaaattaccagggaaggcaaatttatagagatagaaagcaaacatagagttgcttacagataggagtatgaaggggagtgagtgcacatgagcatagtttctgttttgaagtgatgaaaattttgaattatgttatataaaagttgcacaactctactaaaaattaaaatgggcaaatttatggtatgtaaattttacctcaataaaactaataaaaagctatctggaaaaataagatacatttgaggcaaaatataagggagcatgaacatttactgatacatgtgtagtgtgccttaattcttaagagattagaaaagaaagaaaatcacttttggttgagtgttagataattctttatggaaaaagtagccttctgaagtgactataaaggagtttgcatttgaattgggcattggaagataaatagaattcattcaagaggctttaataatttgacccaaactaaactccttaaactcatatatctattttttttaggactctagttttgattagaattccccactcactgtttgttaaatactagttgacatgcatcactctatcccagagttttactttgccttttagaagtacctttataataacaataatagcttatttctttgtattcaccaataaggaatctatcagattacatagtttagttagtgcccaataaaaaatacctttggttgcttaagtgaccaactgataccatgccaggcgggtagatcaaaatgacaggagtagggggtgataagccttgtgcttgatagagggttgataattcattggggcccaattaggaggctcttgaatgccaggtagaggagtttggcaattgggtagcaaaagagtggctaatacacatggtataatgaaaaacaaacctgccagcagcgtgagggtcagcttgtgggaggaaggcttggcatcaattaagacatgattttttttgtgtgtgatcatacattttaaagctcagttcac

SEQ ID NO: 89436 - DNA, 1009 bp, Homo sapiens
tgaagattttttacattgccagataaaaagtgttacttaaccaacaaacaaatgtaagactacaaaatcgttcaagagcaattctaatataatttacatatgttcacgcaaaatatgcttaggctgtcaaattagcacaacaaagaatgtgtttcactatcttttctaggctaatttgtcttgagctgttgtctatagagcagtttacagacttgtgtcttgtatcattttccagtgccagggttctgaaattcattcagaacctgttagattaaagctgcaccctgtgattatttgaaaagaattagcttgagagtaatgtcactatatttgagttcttagagaagtatgagtggaacttgagtacagttgaattattaaatatgcaagttagaaattaagtctactgaaaaatttacattttgagtcaggttttgtgtcagtactttagcagtttttgagaatgtgtttgatatcacagtgtttgtaaattctatgaaaaatgcattttccaaacaacttatacatgctttttatgactatgcctaatgtaaagaaaatgtattacattctgtatgtacaaagattaaaaatcaacctcttttttgtgctttaaaatgactttgggattaaaaaagcatatttcccaatcattgtcttcattccactacaaagtcacctcacagcatcttgctccactcggcatctctgtgaaagcaacatgaaatgaactgtagtaggtgtgtagtttggggaagtcaaatggccattttatgtatgtgcatttggtatcatgggccgtggaacagaatatatgttggacctctgaaaagttgtaaggggccaattctaagtattcttcacggcagccagaagttaatggtggtagcagctgaggtatggttgttggacgaggccgatttttttttttttaacatggaacaatgaaaccaacaacaaacatttttaaaattaaaatggataatttgtaaatagtttttagctttta

SEQ ID NO: 89437 - DNA, 1031 bp, Homo sapiens
ccgggattcggagagggcgcgggaggcaggcacacgggcccgaccccactccagcgctcaccggggacgcgggcgggcggcgacgggacgcggcgggggcgcggggcgggcgcggccatggagcagcagcggcggcggcggcggcggcggcggcaacactagcgaccgcgggcggacgagcgggcgggcagggccgccgggctcagcggaccgaactgcacagctcagcaaaagcgccctcgccctccgcgcgccgcctcctgcgagcccaaacccaccaacattttttaacgctccaacccatcctttgaagaaaagcaaaaaaaaaaaaaaaaaaaaaaaaaaaagcaaaaaaagaaaaagcattgatcggagagacggggatatatatatatatatatatatatatatatatataaaattttttttggctcctgctaaaattagcagggctcgccgcgcgcctgtgtgccagtgtgtgcgagtgtgtgtgcgtgcgggcgtgtgtgtgtgaatgtgattactccaggactcctcgggctccggagacgccattttcccccttgatatctctctccataaatcggtggcgcggcggaggcggcagagtcgggcgggaagcgcggggccggccggggcgcccgccgctcgccgccgcctccgcgcgcccgggggccccggcgccccccgagctagggcggccagctcgcggctcgccgtttgacagatgctcatcgccatggagttgccgcagcagcacctttgggggctcgggcgagcgacgggagccgggatctgagcgagcgccggggccagcggagccggagccgccgggacatgggtgagcacgcgcggcgaccttggcccgggagcccgggcgcccagcctccctccgcgccgcgggcccccgcactcccggaaccgggggcgacgtgtgtgccctgcatgcaaaagttcacgtcgccttgctgggtctttgactttgcacccggcgggaagggggagaccgggccgagggggcgggatgccgg

SEQ ID NO: 89438 - DNA, 1071 bp, Homo sapiens
attatagtcacccgccaccatgcccagctaattttttatatttgttgtagagacggggtttcaccatgttggcctggctgcgtctcgaactcctgacctcatgatccgcctgcctcggcctcccaaagtgctgggattacaggcatgagccaccgcgcctggccaagaccttggtttttaaaaaagtattgattaatagtagtgactaaaagggatgatttgatgtgaaatctctgtgaacctttctactcgttatactttagagctctattacgactggtgttttgatccacaaatatttattaaaatatcagcattgcagattgtgtgagccattgtgcctggtacacttgcttgggaaaggcctgctctgagatgtggcttttgccctgggagagtgggcagtgtatctacagatacgtgctttgctgaaatggaaagcattcttctgcagccaaagttggaacatgatcccaaatggaattttgctatttgtgtgatcaggcctagggtatagtcagggaagatttcaaagagtatgtgtttaggatttgatggaagatgtagaacaaagggacattcttggcgggtagaacagctttggcataggggcagcagtgggacagagttcaaatgcgaattgagaattgcctcaaggaaacaaatgcttatttcgaacatgtactgcatctggcagaagcagcatggccctgaagatgaaggtcagaaggctgacattgaggggcagacacccccatagcagacacctttgtggtccgaggtcttctgtccacagtgagaaggataaaacccagggccctctatgtcagactcaatgtgcctgttataattcaaactaatcaaccttccaactctctgaattagcaaaaattggtttgttcattgacattattattgattgtgaccagactctgatgggtgccatggggatcccaagagatggagtgaaagatgctctaagagcccatgaaaaccaggggaggagtagcagcagccagccatttaggtctaagtgctgaattgtagtgggagcccgaggggtttagtgtc

SEQ ID NO: 89439 - DNA, 1057 bp, Homo sapiens
tggggttcaaaagaggtatctttagaacaagaaatgaaattgtatataagcatttggaatggggatgggccgctctggggaacataaaactcttgtgatactggtacttatttccaagtgtttaatgtataattggagaaggaaataaacaagattcagtaacaagacaatgtttaatgacagtacaaggtagctagaggagatatatcacagagaaagggaagtggagctgatatttgtttagttctctggtatgcttagcatctcctttgcagcagaagcacaaacatatacgtgccagattacactttatgttcaaatgacaatgaacaaagcaatggcttaatcagacggttgagaagtcaaggaatttgaattaaaactgaacaggtagtgaggtgaaagagaactttgaaagactttattattatctgttagatggttcagtttatcctcattgcctccaagtatgtctaccaattccttcctcaatttataaatggtgtggtggaggaccagagttttcagggaccactaatacagaatatttgaagactggtggctctatggttcaaataacatttggagtcagacacaactgcccctgtgatttcaacaaatccctcaactttaattttcttatctgtaaaatggatgtgtctctgggttaaaatcagttagtaaatcagggttaaatagtataataaacttaaatcagatgaaaaacgtaaataaacttagagaatacctgatgtatgttaacaattcagattattttctttacgatgtgaattcctcctccctgcttggacaggaaatattatggtcacaattacttctttcaaatctactgtatttaacctattttggtattgtgctacacatattatttacctttttttcctgcaagattctgtgaggagaattagaaaaggcagatgagaaaactgatgcccaagagagtttaagtgacgtggcaattcagatggcacactggttttagaactcatgtatgtagaagcaactaacaacttttggtcaaaagttggcatcactt

SEQ ID NO: 89440 - DNA, 1036 bp, Homo sapiens
cattcagaaaaaccttgaaatcctccaagcacccagtcctgcaatggatgctataggtaatgtcagcattatacaactacagttaggctcaacctgaggctgagctgcaatcatgttagagaaataagatttatatgcccagaacagctagaagacaatacaaggctggtatttagtggcgaactatacagctgggtgcaatgtcagtccggccaaggagtgagcaccacggtctggagtttacagaatgttgccatggagaattgaagacttggggatgatctggaaatatggaaaggcttgggatctttttattcatttgtttattcattccttcgtgcaacaaacatttggggaacaccaattgcatggccggcattgcaaggatgagaggaagtggatataagaacagattctgtgtattttaaaaaatacagaaagaactatgtataacattgctgtggagactggtttgacttgagtagttactgcaagttggtggctaatttgctttggtcttttaaggcgagatcagtatgaaaagtctggaatagatgaattcctaaagattaaggctatttgaaactgcattactgttttacctacagtatttattatgacatactcacattgccctggtttgggtcttcaagcaatgtgaatgaaatttcagctgaactttcttatggccccctgcctctaacatcagattcccttaatccaaccctcacaccatgtaccagaattatcttcctaaagcttagatttgatattattccttctccactgccattccttaaatggcttcccattacctgtaagataaaatccaaactcgttagcacaacattcaaggaagttcatgactttgccatgaccttttatttccagcctcacctctcatagattcccagtttctaccatacttcctagccaaacatcaattccctgtttcttctgcataatcctgcacacgcctgcccaggacgtggcctcacgtcttccctttctctgctacgtcttccttcttcctgct

SEQ ID NO: 89441 - DNA, 1053 bp, Homo sapiens
tttgggacttggagatggctctagaagaagcccttttgttgacagagttttggggttctaggttgtaggtgttaatcataatctttgtcactctctccctgacatttgatcaattatttgggctctagatatgtggatcagctaaaaatggcacaaatgaatgaacttcttttctttatagcccgaagatattccatagcatttctgttaccattaggttttttttttttttttttttttttttttttttttttttttttttttagctttggggcagttattttcaataaaaccactaggaatcatattatttctttagcacagggcttgtgtccatccttataccgggtgttgtggctgattttgttgcatttaaaatccaaagaactggctagaagagactttctagggtgactgactcctcacagtttgcccaaaaaatctgtcctggtttcaagactgaaaattctgcatccaggaattgccccagttcctagcaaactgggacgattggtcaccttagtttaacattttggaagacaaaggaacttttagaaattggtttgttttgccagaacatagaggttgtgctctctcctcccccattacaactttgcagtgatttctggatactctgtcgtgaaaccaaaggtttaatctccacacatacagaaacttctgagattcatgcaagaaaatgcaacagttcaaatcaggctctgaaagtgaggctttgcattggagttgggtctcttaagatatgaaaatgagtatctttgtttctggccattgagttggccagttctttgtgtgttgttgtatttttgtgtgggtgggttgtcttgagtaatggttaccctttgtctccatcaccttcactgccaggatttaagcagcaacccacagttttgggagttcaaacccaaattcgctgccctaaaaagagaatacattgtcctgattaggtaccacttttcctaaagccactgattgttcccaaatatagctttctccccattggaacacaccagaataatgttttggaatctgtac

SEQ ID NO: 89442 - DNA, 1115 bp, Homo sapiens
cttacatttatttatgcctagcactgttactttccagaaatgaattaatacagctatcatcactgagtctcaattacttgatagatgacaggaacatcctctgatctctatgggatgagaatgttaactttattacccttaattcctgctgttttgcaaccagagagtaagcaaaggctaaagctgagggtgagatgtagaaaccttgcctactatgtgtgtggaaaagtttagtggcataaacttgcagaatttacttatttgtatgaatgagaaatatgtgatcagtaatttggctcagaatggatgaggatgagatttcgtaagcaacacaccagcatctaatcctgaaatcaccttctggatctatttttataagttgtaccactctttgaagcagtggacatggagtggcctctgggaagcaggtcctacactaggagctagaaaggaagccctgttaagctgatctttgagctgctagtgattcctactagggagtcacctgaatatatgtgctgactttgagctgctagtgattcctactagggagtcatctgaatatatgtgctgactttgagctggggttggcaaactgtagcctgtgggccaaatccagcctcctgcctgtttttgtattgcccctgagcaaataatgttttttacatttttaaaaggttgggaaaacatcaaaagaataataatattttgtaatatgtgaggcatatgaaatttaaatttcagtgtttataaataaagttttattggaacacagccaagttcatttgtttatgttttgactctgactgctttttcttatagtggcagagttgagttgttgtgacagaggtactatgaccttcaaagattcaactatttactctctgatccttacaaaaaatgtgcattgatccttaacttagggtaaggacatagagtttcaggataataaaggttttgttttattttgttttgctttaataattcagcctccaagtttggaggctggggggaattaggtgttatattatgtgctgctttttgttgttgttatttaagtgaaccagttaattttgctgaagtcattgcttgacagctccaggcaaagacagctt

SEQ ID NO: 89443 - DNA, 1070 bp, Homo sapiens
cccaggttcaagtgattctcctgcctcagcctcctgagtagctgggactacaggtgcatgccacaacaccgggctaatttattttgtatttttagtagagatggggttttgccacgttggccaggctggtctcaagctcctgacctcagatgatccgcccgccttggcctcccaaagttctgggattacaggcgtgagccaccgcacctggccttagctcttctgttctattaatatcaaaacagctcctgcttagtcagctctgtgtattttgcattggtagttagaaacatctgaaatcttgtgtctctcggggtgtgtgtatgtgtgtgtgtgcgcatgcacgtgtgagcgctctcctatccagatatactgtaacagagctgaagcatcttaattctagaagtacctacagagtttaatggggttttcagcctaagtgctgtgtagggtatagaaagatgttgctaagaagtattgatctcaggacatttagggaaaaacccagggcactgtatttaataagtaactgtcaaaatatgtgatccagatgatagtgcatggtgtggacaatcacatctgcccagcaccttgataaagtgtactcacatctgcccagctgttccttcttttgggtttgctcttcgtatagttaagcaaagttgttatttctccctgttttataaactggggaaaggactctgagggtttaaatggcttgcctgagcttacagctaattactgaggttggtggggtggggggtgtttgggactcaaaccctcaggtctcctggtttccagcagtggaagctatcttcgaaacattccaccctgccttgccctgctggggcatctttaagaagagaatagttgagtctcttgaaactcacctggttgtttctgctgcttggccctggctgtgggtaaactccagcactgcagcttcatcctggagacccacagcgcctttcttgactgcccatagccgtatccctgctagaaaacactgggcaggtcacagcggcagtgaggcgtggtacgaagtgatgggctggcagcagcacagggct

SEQ ID NO: 89444 - DNA, 1809 bp, Homo sapiens
tgccccataagtcacacccggatcctactgcttgctaaaggtgaggccttgctgtccttggaggttttcttgaaggttctttggtgtccaggctctttatgttttcttatttctgaaaaatgggaactgtgtatcagaagcataggtgagtcattctttttgtttgtttgtttgtttttgagacttagtctcactctgttgccaggctggagtgcagtggtgcgatctcggctctctgcaacctccaactcccaggttcaagcgatcctctcacctcagcctcccaaatagctgggattacaggcatttgccaccatgcccggctcatttttgtatttttagtagagaaggtgtttccccatcttggccaggctagtcttgaactcctgacctcaagtgatccacccaccttggcctccgaaagtgctgggattatggcattagccaccgcccttatccaggtgagtcattcttttgtggaacccctgaatcatagagaaagccaattggctgtgcaggttgctttcctggacataacaacagctgccattttgctacttagaggagctgagaactttgccaagcacttgacacacattgctaccgaatcttccccacaaccgcaatgtgatgttactatccccattttacagatgactcaaatgtggcatagagagctccaggaaattgccctgggtctcagaggcagccaggaggttgtgataccagtgccacaccctctgagctccaaggcagccaccgtggctcctcatgcggtgctcaggcagctgaacccaaggctggaatcagagtttctcacctctgactctgccttctggaaaaccagcagagaggtgtttttctggtccttccattaatctctttgtaaagtgagaccacaatagctagatgccagggaaacgagagagacagttgggtcgaatcttgagaaagctgtataagatctgctcccaaacttcatgcttttgtcctctttttctgtcatgttccacaaaattgatgaaacttgtctcaacagatttaggatgctcaagcacattctctcagattgtcttctgactttgcagacacagggctctgctggcctctggctctgcagggtctgccctcactgcacatactcccatgtctactttggggccattgcaagggattggccctttaccaacaaaagggtatattttgatcctttatggtgatgagagaaagggtcagggaatgaacatatgatgaatgcactaaattggtaaaaatacatgaaatccaaaaagctgttcttaaacacaccatttcttccctcctctcactggtggactaagcctgtgacccagagcactgaaggacctgaggattcccttagaatagagtataaaataaaacaaagataagagaaagacagagatagaaggtcagagaggttgaagttttctctgtttcttcctcctaaggacatagaatttttctagatgacttaaaatgcatatatgcatctgtgtgtgtgtgtgtgtgcttgtgtgtgcattttaacttcttaaaatatgtcataggttcataatagtgtggattataagaaatgtagcaactttactaatgaactcaactttactcctgaaactaataagagtttttgctcagcactttaccatatggaatgatctggtttttagtaaatgctgtctcctgttcatttttgaatataatccagatatgaaaacaagtcttgcctgaagcaatgagggagaaatagcagataggatctagaaacactggactaggtgagggaggttg

SEQ ID NO: 89445 - DNA, 1209 bp, Homo sapiens
atatgacccattcacactgtggatgaacgagttgcactttttctgtgttgaaaaggaacaagaatgcatatggccatgagggggacttttccttaccctcagaaggtgggggaagagggcaatggtgtgaaagaatgaattagttctggcaaatcttgttagtgtccattgtaagcagagaagctacctaagccatctgtggtcacttgcaaaattgttccttgtttgttcaggctccccaccgaagcaaatctttgtggcttctgataatttgcatattgtcacttgtttgccaactagagggtatctggacatgtgtatgtgagagggcatctgcgtggacatgcatgtgaaatctttgtggcttctgataatttgcatattgtcacttgtttgccaactagagggtatctggacatgtgtatgtgagagggcatctgcgtggacatgcatgtgtgtaccgaaaagagcccagcattggtatgacattgacatagatgtttggggggcctggatttgactgggctctaagctcagtaggagaggaaggaatcctgggaacctgtttatattattttgggatattcctagtcaccatctccggtcgcctttttgtgcccccttcccttgctgccctaccttcccatgagtcccctgctgccctaccttctcacacaattttgcctcaattcttgtgcttaatgggtggtgtgtgtgagcaagaggcagaacgtatttagggcagcttgttataagctaagggagatgttagagtagtatttgctaccaatggatccttctatgtcaaagatactgttgttttgtctcaattaattctacagtgtttatggggacctattgtagaccctcctgcagagcagcagtattcgggtgctgcagctgtctaaaggctgcatggccaccatgatttctgtcttccagtggtgagcatcacgtgctctgtggatgggatgaacaaaattcgggagtacgctcatgaagggactggttattgggttctgatggtcactaaaggattcccatctgagtgcttgtagaaggctgatgattgtgaagggcatgtcttcaggacggttctctagtaggcttctaggattccagattggccaaagaaaatggtaaatgcaaatctgcaaaaattaaacagcacaaataccgtttcttttcatcatcacaatatcctatggg

SEQ ID NO: 89446 - DNA, 1025 bp, Homo sapiens
aaagtcttctctcatttaagactcactacttagaaatatgctaattctgagagacagaataatgcacttctactccattgtgatcacttttgcacagtttggctactttattcaaattcctgtattgtactgtctgatttattccagagagcaggacaatcaagagacaggcagaagtagaaaccttctggagatttagcagttattcactgtcagagactggtggttctcagagctgatcatttccctggacatgatcacgtctccctgtgctaagtttatttgcaatctattaaaaactacacaaggcatgcgggtctcgggaaaaagtcactgttttgtttcaagtgcaggtaatcaaatttaagtgtgtttgggtacctgttactgatgttccatagggaccatttgttcattcagttaacagtggatgagtgtggattctaaggtagtcattgtactcatcattaagaatataaaatcaaataagacatgtcatttgcctttaagaatcagacaagcttgagtcagataggcaaataaaatggtaattataaaataatgtatcaaattcaatgaacagaaagtataatcctccaaatcctattgggggcagggagagaaagctctgggatggagggaaggtagtcttggagcaagttttgaggaacaagaggagtcagctagaggaagaaggagaacaggcattccaggaagaaataatggcatatgcagaggcatgggtgatgaaatgatagacttgactagaagaaatgcaagtagatccatttgaatgaatgatgccaaaggtggttgggagcagaggtaagaactaggcagtgggaagaatgcagctaagaactaactagtgcttattgaatccttactgtgtgccagatagagttctaagccctttacatgtgtatttcaagtagtctccataaaaccctaggcagtagctactattgttatctttaccttacagatcagggaactgaggcatagacacagtaggtcatctgcct

SEQ ID NO: 89447 - DNA, 1046 bp, Homo sapiens
aatttaagatatctcctaggtaaatggatatcactattcataaagaagggaggccttgaaaagaggatgctgcagcaagtcaatgtgattcctgttgagtttaaaggggcctatggggacacccatgtggtgatacttgttaggcagctgaatatttgagttctgcagattactgtgggctttggaatctgttaatagttaaaaccatgggtgtggcttaatttgcctgggatagcttgtaaagtcttagagctgtggagagatctttggagattacaagcatttaaaagataagcagaggcagaaaaaaaaagtgtttgcaaagagtggtctggctagagcaggagaaaccccaggaggtcccggggaggctgtggtttatgtcacacaggcttttgcaccgcagggtcactgtgacttttgagagagtgttttctgtggagctgtgagatcagaagccagtgaagaagatgcagaaactgtcatgtagactaatctttgcagaagcctgagtgtgacgtgaggtctagctatgcatctgtgtgagtcaacttcttgaaaactcagcgtggaacatctgcagaagcctagagtggtgcggctgagaccttatctgcccttgttatatgggtagcactaaattcccttagatacatattgaatacgacttgctttattctgtttggttctgtgcattttactatggagtatgaagaaaaattatataatataggttctgccctcaaacaagttttattctgtctattctacataagacaaacatggaaaactaagagtcaatatgagctaaatggtcaataattcagctgtcagatactggggaggtaagagtttgctggagtccttgggatgcaatgagtaaactctatcctgaaggatggaactacggaggattcagagaacatgcgatctgctatacagatatgtagatggggtggtatgcaggagtcagggaaagaaggcagtgaggaacctcgctcttttcttgaccctggactttttccagcctcttttttcaggaactt

SEQ ID NO: 89448 - DNA, 1038 bp, Homo sapiens
gatccttcttgctttcatcattccccactggtctaagagagacatcaaaaggagcagctagaagagttacagtgggggtgggagaaagaggaagcttaaatggtatcagggtttctagatgataagattgtcctgggagccctttatagacgagacacaagatgttctaattatctactgctgtgtaacaaactaccccaaaactcagtggcattaaaactagagccattttgtcatgttgtcagggttgtggatcggcctagtagtgatagttcctccataatcaggaactcagttggagtggctgtgatagtgtgacattgccccacttgtgactggctctggctgtgggcagagtctgtcagctcttctccatgtcttgtctgctgtatgaccctggtgactgggctgggatggatgcaacagctggggctgcctgggttccactctgacctcttgacatggctgacttgtactttccagccagcatggcaggtctcggggtagttggacttcacacatggtatcattcagagagaatcaggtgggagctgcaaggccccttatgtatgaccctcagcatttccaaatatcccttcccccacattctgttgactaagcacagtcactaaggccagcccagatgatcaggctttgcagaagctgtgctttttccacatggccacaggcgggagaggcaccactcgctaaactgacagaaaacagggtccgcagagaggtttatgagactgtcagaatccatgtgggtttttgtctactgtctggaagagccctgagttaggagccaagagacctgggttgtgattatggcttcatctcgatctaaccaaacttagaattgttttgatttgtgaataaaaatgttggtcatgatagttttatattttattctactagaccctggggctaatggaattattctgattttagaagggaggaaaatggttctttacacacacacacacacacacacgcgcacgcacacacacacacatatccttatatgctccataacct

SEQ ID NO: 89449 - DNA, 1131 bp, Homo sapiens
ctgaacctgtttttctcttcctaatgccttgtttgatcccatttttctttattatgaaatacccagtggctggtgtgtgtgaggtgcatgttctcagtttttgtgttgaggctgtctagttctatttgatgagcaatgtgtctgtgtgagtatgcaaatatgctggactctttgcatgaaggatttaaaatagaagctgacctaagaaagttgattaccactcagatagacgatcacataccctcgttatgagtcctgaattggttgaactttgtgactaaatatgatattcttggaatttagcttactgctccttgaagctgagcagggctatgcaattgtattttctttaacatgctacgacttgactgcagacgccctaaacccctgatgtcttctgcatgtacgatcaaaaattcctagctccgggaacttgctgtgctgagcagacatccagtaaaggaggaaacccaaagcctgtgtcccgacggatatataagtgaagacgttagtcaaaacaagacgttagtgctatttctcacccttgcaatggacaggagcagccatattgtatgttgcatttatttagacccttctgccgagaataagtgctctgtaaacatgccctatttagccctcaatgcatatactgctgcctttctgaggtcttgaagtcaatgaaataaattactctaaaaagaagtgctatgcagccccttagaacagtaaacaagaacagttcaggtcttttcaggaacctgaagccaagggatggtttgtttttttggtctccaggaagaaccagtacagaaggaggtattgacctcgctactttggctggcacccaccaggtcccttcctggcgctcacattccccaagtgtgtaactcaacacctgtccttctgcggcaaacagagcttacagtgatggctgagcccctcctgccctggccctaccggcagctcgcacctttcacttaggatttcaaactctcaaaaaccagagtcagagaataaattctccctcaggattctggtttgggccaggaaaaaaaaaataatcagaaaaacaactcccacaagaagtcctgggatcagcacagcaatctctttctagctccagacctagat

SEQ ID NO: 89450 - DNA, 1472 bp, Homo sapiens
ggggtcaggctgtgaataaaccactacgtggctgattttacatccttctctttcaccacaaaaacctcaatttccctttttgtggaaaacaaaaaccctctttcagtgttccatcaaggggactgtggcctttgaattgcacggtgtccctgagaaattttaaagattaatcagcttttttggggagtggctgggagaggccctattcctgtccattagggagtagcaggtctccccttctgttccttctgaccaggctgccatcttcatgtgtagatgaggaaattgatcagcctatgaatgatttgcaaatccacagatgtgtggctgagaccctgagggcattcatcacaggatctgcccggtccaaaagttcccttctcccatcacaattcagggccttcacagagctgggggagtgagtaatgatgggggcaaaagtcacacactgaagcaaatgaggacaagccctgaaaatcagaccctgttgaggcctggtccaggggctttctagtacactagttgagatcatttctaaaaggaaataacagaataaaatctcagataggcagtataagaatttgtaaatggtaaatgtgctataagggtgagtaagatgcattgcttattgcttgagaggatttctttgcccttcagtgtatctggatttgtcattcatgagctattaattaaattcgtactctctgctagtattcgtttcttccctgggccttcctgaagactgcatgtgtgtcctagctgtctgctattccagctctcctgtatattctgggagtgtgtatgaatcaacttaggcccttgttaataccattgttcttgcaagacataaaaagaaagtgaaaaaatttagtttgacattctaggatcttcccatttcacctgaaatgttatttaaagacttatctcttaccagtttctgacttccgtgaattccctgaccacacttccaattcccacttccatacttctgtttacattgctctgaccttaaatgtctcctctctctccctatctagtcaatacttacctctccttgaagaatccccttccttcctggtgtcctcagctcatgccttccttacctctaaacttctagagcacctctccgcagtaacagtcatttcctggcaaaatgtgtccctccattgttacgtttcttcttttggactatttaaaattcacttattttattacattttatgttgctttctcttatttaggttagaaattatcttggggataaagggtttaatttattggcatttcccacagcatatcacataggaagtactcaataaatacaaattgactctatatgattaagttttagacaatatcgaagtgtgttatgttccatttctactcctaaggagttttgctatccagtaagaagagagttatttataagtctacatagaattctacttagagatattcactaatataatatt

SEQ ID NO: 89451 - DNA, 1553 bp, Homo sapiens
cttttatgtgtaacagttgcccacaaacttagtggcttaaagcaacaaaaattttattattttatatttctgggggttaaagtcagaaatgggcctcactgggctcaaatcaaggtgttgacagagctgtattcatttagaagactctaggagagaatgtttccttttctttttcagcttctagaagctgctgtcatttcttagctctgttcttccatcttaaacctagtaactcaagtcgaatcattttcaacctgccatctctctggttctacctattctgtttgctcttccacttttaaggactcttgtgaaaacatttggacctacctgcttgatctaagacagtctatttcagggtcagctgattagcagccttaattctgttccgctttaattgccctttgccatctaatatattcacaggttccagggattaggacacaggacatctttgtggggccattattctgcctattacatcttattttagtagtgctaataacttggattaataaaacattaacaaacaactttaccttgcctttatctccttgatctgtgactgctcctccaagcacaattctttatactggggaatgaaataattgctttttaaacaaaaagcaatttgctataatttgtagaactgttggagtcataatgctttcaagatatgttttaataaaaagatacttgtatatttgtaaaagagtctgactaaatattttcattcatctgaggttctgggaaatctgattttaattatcagtgatatctgaatttggattcaggtctttcacatttaaaataccctgaaaggataattttggttattcaacttgtatcaaatgaatgacagatacagaagagtttggcaatgtgttcattaaatttaaaaaccagtatactgggttatcatccagcaagtgctaactgtgtcttggcagatgtctgatgtccgagtaggagtgattatggttactgtgtgaagacttgactctcaaggagttgcaggatcatacgtgggaagtggaggggttcccatgtgaccttctatgaagatcagaagaatagaaaacctgaagaatagattttggttggaagaatagaaagtctgcctagagtgtctttggaatgccagaggatgagatcgtcttgtttactaagagttgtcacggttcccctcacctcacctcccaaatcctggtaaggaaccaggacctgccaaggtgaagcactgatagatttggctggccttgaatctgcaggtgctaaggtttgggttattattctagagcgggcattgtgagtcatagggctccaaggattcaatggtagagttacgtcacctcctttgggcattgcaaagtgagcataggtatttgcctactactctgctgacagcttgggaaggttgcccattttacctttacgctaatgacgatattacctattacacattgtggccattacagtgtgcacaccaggggaggagacagcaagaaagtggttatcaggacagctgagggctggcactccttaacacttgt

SEQ ID NO: 89452 - DNA, 1048 bp, Homo sapiens
acactcagcccttatcagtgccattagctttgctccttggctactgaccatctcagtctgaggtcttctgggagattttgctctggtttcatgtcctctagttagcaccttttttgtctcctggccctggtccttatgccaagatggggtggcagagaggatgctggggcaggaggatgcggagcacaaaagtatagctcattggctggcattgcttttcatgatttgaccatccagaagcagctattgccatgaaagaagataatggcaggagaaaaggcaagatgacaaaagaatccctaccagaagatttgggaggttgttactgacttatttcagaaagtcttctttcttctctttttttcctgctcaccaagtacgcattagccccaggatgtctgtggggagggccagcctgcctctgtgtccttagcaacctccagggtgtctccctaagtatgtcccagggccctctgctagagctctgcctcagagttgatctatctgaacaggttaaataaacaggtctgtgtttgggttaattatcactggttctgttgctctccattactgctccatccgggactctggccaaggaacagatgggagaggctgcatcatcacccctgcctcctcattgtgtctggctctccctccttctctctctctctctctctctctccccccctgtcccgttacccctttctgtctcactcccttcctccttcccttcctgcctgcctctctcttcctccctccttctcttattctccaccttcctccctttctctctctctcctcttctctctcctagccctgcttccctgccttcccttccccctccctatttttgctctttctctctctctctctttctctttttggctgagcaaataggccagatggtggtgaggggaacagacaacaagtgaggcatggcatatggggagcttgtttaatttcggctcctgtagggaagtagattggaggaggtgagctacaaaagcagaaaatggaaaggggaagggtaagaaaaaaaagaaaagaa

SEQ ID NO: 89453 - DNA, 2943 bp, Homo sapiens
ggaggcagggttcagactctgtcttgtcctgaggatctcaaaatggggagtcaataaggagactagggccatggagccttggaagtgctaagtgagcatcaaaggagggagcaggaggaagccttggagggagaagggccatcagggaaggctcctggaggaggtggtgcaggattgttttgatgttcaaggtagttggtaagaggcggggtgagcaaaattatttcatagaacttgagtgtccagtgtagtggtgaccatcccttctctggcacccttccttgatctggaaggcacacacacacccaggagtgaagagagagcttgaattggggcagggagatgtggtcaaatatgcagggtagaggggtcactctgccactctgccatttctgttgggatgtcttgaaggtgtctatgttgtcagtcaggcagatgaccatttagaaggtggctgtaatagttcaagcaagaatagtgattaaaatatggggcgtcataggagagatgacagaggtggaaagggaagacatttatgtagtgggactgcctttgagaatcactggatgtaaggagttggagagaaaggagtggatctgtaatgatgcccacatttctgtaaaataggatacatgatagtacaatagtcatagcgttgctagcttggcacataataagcactcaataagtgatggtgataaataatcatgatgaatattactgtgttttttaggtgatccagtgagtggttgccttcaggccatgttccaaaatggagaatacaggaaaaagaacatattttttaagggggaggtggtaagaaaagtaggatgatatgtttttaacagaatcaagttcacacaggggttatcaaatgtgatatttggggagtggcgtctgagttggaatatctctttgttcccccataatgtttagcttagtgctcagaacatgcaaggcatttaatagatgtttgatgaacttgtggattaatgtatattctgactcttaacaatcaggaactatcagtttagaaataatcatttattcctcacatattaagggagtggcaattaatatcatgcatgggacacagtaaagaacaagcgggtggggtctgtgccaacatggagtctgtggtctggtatggccgtgaggacaataggaaagctacgtgcacatgtgattggagacgattctgcatattgtttctgagtgtgtaagcactgtcttcaggtaaaggtgaggaacaggtagggtgtgctatggatgcatacggcacctaagttatattgaaccagcctcatgtttttatatagtgtctgatggccagagatagaccttggcccaacagttagtcacatgccagccccagccttggctgctgtttaatgctgtgctgcaagcacttagggaagctgcatgtgaatggaggttcctggtgactccagcatcaatcatatctactctgaggcttctacaggtgatgaccaggtctccaaggtcctgcttcttccccatgcatcctttcagggataccttcatgacccccaggggttttgctcttggttctccttcatgtgggttaacaatctcatgagctttttaaagtttatatttagaacaactataggctcacacttctgggacctgctccaggaggtgttacagtaaggactagagtcattcagcatcccaggaaaagggaactgaaaagagcattagaaatcctcagaagaaaaaaaaaattctccttttattaagagtgaaaataattctagaaaggagaggtgctggcccaggccacacagctcgagaatggcagggaggagctttaacccagacatcctggcctcccaatccagagcttgctctactttttatgcactgctccacattgttgtgcatgtgtgagattaagtacgctgatgcctctgtctgtttcctacatttcccatgagaaatatgaaagtcagtattttacaatatgcagtctgtgtaactcagttattcagaatgttaagaggtgttagaggtcaaaaaaattctctgagcaagaaacattgggaaacaactggttcaacaaagctaatctgatgtctttgcagtaggatgtctcaaagcctttaatgttaataagcatcacagatcttcaagtgtggttgagtttatgttgtttcacaaatttattaggtcacaagctgatatctaggagatcagctatccctagactgcactcctagttctgattcttatgtagagacagcctccctggcagagagcataggtcaggttgtatttgtaaagatgctgcatggatctatgcttctgccttgggaggctgagtggggtggggaggctggcagtaccctgactgcactggagtacaggactctggagaaggaagcatcctgaaacaccaactccattgagtgtcactcctcctgctcccctcccactagaggaagaaatggagggaaagatagaagaaaggaaggaaggatggaaaggatggaaaggaaggatgggaaggaaggaaggaaggaagccatttcactgctctcaaggatcctcatgccctaacaagaagaaggggtgcaaatatatttctcagagttagtataaaagatgatctctctgtttcctatttacttaggaagaaatgtttagacatgtaggcctagagaggcaaagaaaataaggagagcaaacaagaacattggtttacttttccagaggaggaagaggagagcacacaagcctggggaagagcagaacatgatagttttatcagcttcagtctcactgcttttcctaacaaaacttcaggacaattcctgatcgtggtcaaacttcaagtagctcaagaggtcatgctttatgcagtgggtcagttgatatcatgaactcaatccaagactgcttgagatgccccttgaaagg

SEQ ID NO: 89454 - DNA, 2188 bp, Homo sapiens
ggtaaataaaaatgaaagttaaattatccagagttgttacagccatatgtgttcattcacttgttgttttctgacttctctgatatgccaatgcatggtgaagcatccaatgagtggtactgacagttgttgctttgagctcacaatgaagaaggatggctgggtgggagcagggtgggatagaaagtgaaggactcataaatgatgcaagattgagttaaggcttgaagaacaggaaagatttcaagtgggaaggcaagagggaggtgtgatggggaatgtctagctctgggcttaattgccaaagaggacttcggagaaactggtttattgataggagaagtaaaatactggtgtattagtcaacttgggctgctataacaaaatatcatagactggctggctttaacaacagacatgtatttcccacagttctggaggttgggaagtctacattcaaggtggcagtagatagattcagttcctggtgaaggccctctttctggtttgtggatggctgccttctagctatagcctcacagggcagagaggggaagctctgctgtttcttcattttcttataaaaacactaactctattatgagggctctaccctcctgacctcatctacacccagttacctcccaaaggccccacctcctaatatcatcacactgggggttagggtgttaacatgaattttgggggagacacaaacatctgtccgtaacaattgggaaccaatttaaattagatttgggttctggaacttaaatcattggacaaacttgggagatgttttagggtccaagtatggcagtcatccgatggatgttttgaaggcatttggccacctgagttggcatttaatcatgccagacaccaccagacttcttccgggtttcctatctccatttcactgctctttcagagttctgctttgtagagaatataagggaagggaagacatgacccctgctctcaataggcttagctaggtcataaaaaatatcaagttatgaaagattttaagaacaaaactagctaagatgcaaagtgtgtagggtactgacagtctgtgttataaatataaaaagataggagaccactgtgggccagttgagtaggacgtggctctttggggcaagtgagatttgtgctgggccttgaggttatgggctgtggttatgatgaggctgatggagtgggaagcagtatgagcaaacttaagtgcacaagggtcagcctggtatttgggggtcatggagaggtatggacagaagagcattatatttagcacttactatctcctgcaggacatggcaaagtaaagttttttgtttgtttgtttttatggaatgtgtagacagtgaaaagggtaggcaagggaggagaaagaagcaggaaggtaagggagagttaaacatgctttccacatcagcctcacccttctgttccccacagctagccactgctagtctaggagaacagttcacaaactcacattctttagctggaagaccttcacagcttacctagcgacaagattttgagagagtttgagagatagagcagagagctggaaggtaagaaagtagatgagagaggttatcagatcagcaagggcaaggagttcctaatttgatttgtgtccattctttactttccatgcccctttctctttttctaccactatttgacaatgaatcatatggaaattgtggtttctatttttattactatttatagttatttgcaggttttattgttatttgatttatcctttatttgtcattttgtttcttgcaatttcattcatatcttctctcttttgttataatgccagaaacttgaaaggaggaactatgctttttcgtatttctcaaagtgtaaacagttttctttttcttagtaaatccttaataaaggtaacttcaatacatttggaaaccaggcaggcgtattagtcttctcaggctgctataacaatataccatagactgagtggcttaaaaaatagacataaatttttcacagttctggtagctaggaagtccaagatcagggtgctggccaattcacttcttggtgagggctctcttcctggcttacaggcagctgccttctcattgtgtcctcacatggtggagactttctcttcctcgtcttataaagccactaattcttt

SEQ ID NO: 89455 - DNA, 1033 bp, Homo sapiens
cttatttaatcttcctaacaaatctgacggaaatatttagcagataatgaaattggagatttagagagattaaacgacttgtctcaatttcacaccaccgagatttaatcctgactcctgagtccagactcttaagaactctgtttgaaagtattataggaagcaatgcataaataacacagtgctgtgtagatcaagtaacattaatttgttgctaaacctatcacaattcaaaatgtgtcaaaggataataatgaggaaagtctaagtcccaagacatcccaggtacatcatttatgtttgttagagagatgtgtttctgaccgttccatttctagttggagatgagtctcttatacattgtctcagcgagtactaaggttgaggcggggtggaggactctcttatcaggagggagaacagggaaatcccagcttccatccgtcccatctattatccgtgtagcgtacagctctaattttgccaccgatgcagggagaggttagtctggacatagattactgaggcagccgctgatgtcaggacaccccagagctcatagactgagagtacacacacactcctgagctttagccaaattaagaagtttgatcaaataaatctgttctgagatcattttctttactaattggcactttccttggagcaaataaaacagctgagaatagatctcaggaccttaaatcttgagactccagaagtcacagagctgaaagaattttttttttttttttgagacggagtctcgctctgttgcccaggctggagtgcagtggtgcgatctcagctcactgcaagctctgcctcccgggttgaggcgattctcctgcctcagcctcccgagtagctgggactacaggggcctgccaccacgcccggctaattttttgtatttttagtaaagagggggtttcactgtgttagccaggatggtctcgatctcctgacctcgtgatccacctgccttgacctcccaaagtgctgggattacaggcgtgagccaccacgcccg

SEQ ID NO: 89456 - DNA, 1170 bp, Homo sapiens
agcctcacattcctgtgctgtatgcaatggctttaaactagattttagttctcaattctggctgcatgttggaatcactaggaaattttaaaagcagcaaccaaaaaactccaaaaaactgacgtctgcatcctatcctgtaccaattaaaccagaaaatcaagaggtgatttttaggtatttctttcaagctccccaggtgatttgtatgtgtggccaggttgggaacttctggcctgcatgcttgtggagaacctgggctccttctcagctgagcattgtcaggagttgtggtggtggaggctcttgttacaatagctgtaacagtactagggtaatacatgtccctgactggtggttccatttcctatcagacctttgcttagcttggtaaacactgttgctgaaacagaccttattttaaaggtggccatatagaatattttcacctttaacttctcactacttccttgttgagatagaggcctcctctcatcaggtctcagacatctctctctggatggggaagggaggaagctggtttacgtgggtgcactgcagaggcctgaaatgtgtctgtacttgaagatgctcagcttaacctataaattatcagccaggacctgtttagaagcccagttctgccttggttacccaagatctcaatgcagcagtggccagcaaaagccaaatctgaaatcttggtcaactgaccttatttctgtcatcaaaggaaggagtgaggctttgactgaagcccagtgcattttattacctttaagtttaaatgcttattcagaaccattctggctgacacacctcctctttccttttccttctctcttctctctagcccctgccaatccaaacatgacagaagcacaaaatcaaattcaaatttcaagtgtagtgtgcgataacaatacatttttcagttattttgcaatcactagacctagaatttgatttttttataagatgggtatggaaatagagggaggtgtatatactgttttttaactcgcagtaaaatatatttaaatagcatcgaatggtgatttccaccatgccatcttcagtttgagaaataaaggacatacaaaaagaaggaaggaatcttaaataagatttaagttatgtttatgatatcaaagacatttcaatcctttg

SEQ ID NO: 89457 - DNA, 1041 bp, Homo sapiens
gttatgtcagtgtatttcttaagacaacctactatatttttgttagagatttatgccatacacatattgcttttgaatggacctttggtaatcattgttgtatatgagcctcgtgataaccaaaggaattaggcagaacaattgtttttctttcctttttcctgctaaggggagaaaatcaaggcaaggagaaatcagttgccttgtttataggttttttgatgtccgagccagggcctggactcaggccttctgactcctgctccagtggtccttccatgacttgtgactcgtggtaggtctttgtgcatgacctggccccattgttgtaccctggctgaccctggccatctaaatgcacagagggtgctatattaggaccgttatgtaatgaactgggccagctggccagactggtctttcaaggtttacctctccctttggccaattgacagttctaccaagcttctaaacacttttttttttttctttttcctgcttcaggctttcctgacttcttttcccagttctggagtgctctccctggagttatcactctagcaaattcttccagttctttaggcccagcccagaacacacctcttcaggagctcttccttgacagcagcctgttcttggtattaccctaggccctgagttcttaagatattgttatctggactgtacaacccattaagcaagttgcacatacaggtttacattttgttcagatcttcaagtacatgtaaagctagaggtatttgtccattcttttctgtgtcccaggtatggaggtagaggtgggagtggtgctagcatagttctaagcacgcagtgcttagagcagataaccattgacttgtctcttgtttactatatagtattatctcaatggttgacagggtatattgtgaagcagaaagggaagatgtaattatttttcaaacagatatgggtcaagagtttcccattgaggctgggaatgtgggagtggtacccagggaaggaaaggcaatgcaagcccatgtctggggtgaaaaa

SEQ ID NO: 89458 - DNA, 1555 bp, Homo sapiens
accatgttagtgaggatggcctcgctccctgaccttgtgatctgactgccttggcctcccaaagtgctgggattacaggtgtgagccaccgcgcccggccatctctgttcttaacctgccttatttttagcatttatctgtaaatgcatactacatattttacttgcttatttgtttattacctgccatgctgtgctagagtggaagctttttgagggcagggactttgctctgctcacattgtgtccttgtgcctagaacatagtgcctggcacagagtgcatgttcaacaaatatttgtaaaatgatttgtgaagtaatcccctctaaaaatagaactcagaagagacagtcagggttaggatctagcccaggatgaactttgttaaaggccacagcaaaggaaagcccttaagttggaagccttgggttgagaccaggttttgccgcaaacaagctccgtgttacgaaattcacctagagctcacaaaccacactttccttgtgtgttgaatgggtgctgatatcttgcctataagatagaagtgaagatcaattgagtaggtagatgtacctttccctctgtaggaaaaaaaaaaagcagatttggttcctcttctttccttgcagaaggaaagaagttttcccattggttttgtttctctctctttggaacaagatagcgacacgagggttttgttgttattgttgtttccagctttaagcaggcattttgtgggtggatatgaaggcatttggttttattttggtgatggtttctaattttatcttctcttgtttatgtaggttttttgttttgttttaatgtgataaatggccagcaacttctctgagccctgtggaaatggtatccaggctacggaataattatttagtgaatggcggatccagtttatgttggcacagatcaaattaatcattattaatcatgccccaatgacagtaacctcatcccttgcagaagtgctattctttattaagcagtaatagctgtgaggaatgactgagctctactccggttacactctactatgcctttccctatttctcagcaggagagggagagcaacacacatccagagtgaaagtaaaaggaagaattaaaaacaaacaagcacccatgaagcatctccctcttcctactacctatgacaagaactcaagttccagcataagaaaagaaaaggggctttgcagtatgctgcccctcaaaaggaacagagtaaatgattataatagtaattagagttatacttaaggaagtggtgtttattagccagcctgtagtaggactaaatccacaggcttcctcacctagttcctctgccagtgcttggatcttgagagttgcaatctctaagctttttaaactcacttctatctgaaaggtacttcccattctggggtgtgtgtgtgtggaattgcttccaagaacaagataagctctttgcctagggaaagttggtaaaggaggcttactgttcagtttcagtccacattgaaatacaggacatatggaaaatagagcatgata

SEQ ID NO: 89459 - DNA, 1033 bp, Homo sapiens
gtctagatggtgcatgggtgcacaggtggtgtcaggtcccgttactgaaagaggaccctcaccagagtttctgagggtgaaactgttagatgagcagctaacataacaagcacaatgagaataggcagagagctcatccaaaagaccctgcaaaggggccaggcccagaccatccatccagtgatttctctttaactgctttgggctctgcaaaaggacattttttatgtaagtccctaagacagagttgggatccccacagaactggacacagggtcagagacacccacggtgaggaggacatgtggatgccattcatctcgggcctcccttgggctcagagggaccacgttatgcctgggaaagagcagaaggtggaggcagggttgtgccctgaattctcatcagcatgcagccctttccactcttatcaaaatcaacgtgggtatttcctgctcacaggcccctggaggtgcagcaagaacagaggctggctgggaagggaatggaggagaaactctgtattgtagattcaatatcagctccatgatttcccccccaagggataaatattgtgctttgcagcttatatgatggaacagacttcctatgtgtacgattccaggaagagagttaataaaacctcttgataccttgcctccccggcagcatttatttgtctagcagtgaggctgtgtgctgttcatacagtactggtgttaggttgacatttgttttgacctttaaactttatgcttcctctttccccatcctctcccccgccccagcctccccacctcctgttgttcctcagcatgtgagtttgatcttctgtgacctgggcttttccaaaggttgactctcctgggcttggattgggtggggtgcaggcttttcctcttttctttgctcaagggtcatcgtgtgactgtaaaattattgtctggcagcagtgcgagcgccatttcacatgtggggagtgtgtagagttttgttttttctttaaataagaaaaaggaaagaaaacacctcg

SEQ ID NO: 89460 - DNA, 1456 bp, Homo sapiens
ttgcaacgtcaatagaaacaaactgtcttcttgctcctagaatatagagaagtggtagtgggatattagagttccactctttaagtgtgtattcccaactgatggaaaataacacccaaaccaaaacaaacaaacaagtaaacaaaaacccagtccaaccactgggggcctgcagaatatctcaggctagccgaagagaatgtgataaaagtaggttcataccttaggttccaagtattaatctcaaccagcctctctctctctctctctctctctctctctgtctctctctgtttatgtgtgtgtgtgtgtgtgtgtgtgtgtgtgtgtctttcttccccctctctgactgtatgtcctcttttggcatggcatggtgaggtaaaaggcatagctcctaggtgacatgttaacatacttctagtttcctaccacaaccacttataggtgcctggggacaacatggccattcaatcagattgaaaacaaaagtttgagccagtggtagattatagttattgaggacaatgtgagaaagaggaagggaggcccaagatttatacaccaattcctcctagaaatttgtttggtttactatgagctgaccctgtgactttgaagattttaatcttaaaattaggacaggttttactgcctcttttgatgtacgcatggatcctggcacagtcaggagagtctcagtcagagtgaggggcgaagccatagaaaattgttccatctgaggaactttattgaaacatacatttctgaccttgatccttggaagtacccttcaggagagagtatatgtgtttgagtgtgtatgtgtgtgtgggtgtgtgtgtgtgtgggtgtgagtgtgggggtgtgtgggtgtaggaggcttagatatatgcatcttataaaataaatgcaaagacatgctgatgacccatcttggatctttatccctcctagcatgagcatcctctgatggatcactgctataggtggtgatcacaagtaggacgtgtagaggagactggcaagagttgtcatgtagaatgtgacctggcagtagatgatttgtggatagggtgcgagcacatgggattatgaaaactcagagttggaggtcacttgtgagtaatctaatctaactcttctacagacactctggaaaatattcttcaacctcagcccgaaaatagttatacagtctggaagggtcctagccaggatttgaacctgggtcacctgatcccagagcatatactgtcgaccctcattgagacaaatgactgtaccctctcaatttgagtgagttacaggtctctaggagtttagcaatagattcctgagattctatgcttttacttggtgttttttttttttcctttttctttttccttagtcagagcacttcaaatttgatataatgctttggagctaggctaatggaaaggttcctagaggt

SEQ ID NO: 89461 - DNA, 1060 bp, Homo sapiens
atggatgccgatttaaacccaggctagattgttttttttctaaaaggccaaagaaaatatgatttcaaaaccagacagaatctcctctcatttcatttagtgacaccgtgaggtggaactgtctggataagactccatctagcaagttaaaaactccccaaaagcacagggacaggaaatttcatggtaaatatttaagctcctgggctccagggcaattggaaagtgtgtgttaagaagctttcctctttccctctaattccctgtattcatcacttgagctgtgccatttgggcttatcctttatgcctaaagaagtcttgccttttaatcttttagccacaaaaaaatagtaaagaaatataaaacaccttaaataataatgccccagggagataatatcctaggaaatttagggcttaggtgttcctatggagcacacatgtgttcacagatgcccatctctgatgctgatcagttaatagaggttaatacttcgtgtaggatcagcagggcttgaggtcttgtcctgggcattctgctcctactttgtcgctgggtgactcagtttccacactgggagaatagggagaagagttttcccttaggctacctcccaggaggtggagaggattaactcagatgaggaaggcagagatgctttagaggccaaaatgtgggcaataaaataaggtaggccaggtgtggtggctcatgcctgtaatcccagcattttgggaggccaagacaggaggatcccttgaagccagaaggttgagaccaacctgcacaacatagtgagacccccgtgtctacaaaaaattaaaaaattagctggacatggtggtgtacacctgtggtcccagctactcgggaggctgaggcaggaggatcccttgaacccaggaatttgaatccagcctggtcaacatagcataactccatctcaaaaaaataaaagttaaattacttggccactatctcaccattctaagtggcagaactgggttatacactcaactcagtctttctctgaaactcagagtcaacccctagcact

SEQ ID NO: 89462 - DNA, 1038 bp, Homo sapiens
tgccaagacttgagttgtttcatttggctcaagtctggaggcattgatactgagctggccttgtatgaaacccacttgctggtcctgttcgtctgagagtcaaaaacgtaagatcctctggagtagagaacagtccctccttcccatccccctcttattctcagcctaggggggcctattctcaaaaacctggagctagaggggggtcacctaatcactcaccattttttctctgagttttattcggggtattttgtaaacttggacttagggttaagaagttcatcaaaagctttatcagtgaggctttgatgtcacttgcataacattttcctaaagaactgtcaagtaccaaatcctacatattgttgatttttatcatctgattttcttgatctcattatggtttttactaagaacacaaacaaacaaaaagcctctgttctaccttttctggggtcaaaatgtaattttcttaagttggccaattcagtggtaaggcactatagttttccactaagtgactcttttctagtactcttcaaagattctacttagtgtttggccccttccttttttgcatctgttcctgtctctttcagcctagctcagaggaggagtgaggagcctgcggaaggcttccatggagtggagaattatggaacttgtcattgtaacccaagggctggggcagaccagggatctctcccctgaagcccctgcaggaaactgcctgccaaggtctatttactcagccccagagcatttaatcctgcgcagtgtggggtggtgtcactgggtcagagccttcgagctgcgagctgagcagccgggtggaaggagaaggataaatggctggttaaaccctgaggtgttgggtggtcactgagcaatggttggagcagcctctggccaccgccgtgtgttgattttgtagtgagatcattacctttcctgggttgttaaatgcagtttaatcttccttaagacaggactggacaatgttgcttttgtgacttcagagagtcactagacagg

SEQ ID NO: 89463 - DNA, 1374 bp, Homo sapiens
tttatgtatccctattgcctaacacagttccaggcataaaaaatgcctaatcaatgtttgaggaatgaatgaatgaagaaatgtgtaatccctcatagattcccctcttgaaagaatttttccattaaagtttcccagattttgaacccatgtgttagagaggatggtaccacaatgcaaaaaactgaactaggaacctgggttctcttcccatgtctgcccttgagaagctgagcaaatggagccaagctgcagtttcttgataccctgttacttgaagtgtaaaatgaagaagtcaggccagagaaagcctgttaatcactggtttttgtgattctatgacttaagggactgtaatactgtttaaatcaaacacaactctcactatttgcaacccttaacgttttgagtttgttataaaatgtcctttgctagaaggatgtcagaaaaccaagcctacttatcttgggtattgcattattcccttctggtctggggattagggaaaatgaagtagctgttaggaatgcagaacgacctcaaccagaacatcagaagccacttaagaggcacactgcttccagcaggacatgggtagaaagaagggattccactataaagagagatttgtagatatgttttcttctttctccacgttaaggagagagaaagggaatgaaaggaaaaacaagatctgaactttcacaccctgataaggatttcctggtatttacaacatgtaaaataaactcttttttttttttccaaaaagaaatgtattttttgctacgtagccaacatgactggttttggggaaaaatatagacttttgattctaatatgtagattagaaagaacaaaagagctcacaactttcttcttaaagtatttatttacctcatagaggaaggaaagaaaagccaggaggaaagatgaagaaagccctgtcaagagtgctccagcaaggaaagtttcctggctgtatggaaatcatctaggtggggtgtgttgtttttccccctgttgggactccagaggggggcttctctcttaaaaaacctgggatggttccaatggagagaactagataatctttcaggctaaactcagtcaacccacagggattgatagaagcccattgtctgcttttccaggaatcctgggggttgcaaatatgtctaggtcagtctggaacttcccccagcttgtattcgcggtgggcatacaccactaactggtcagggaatagaaacgggcagaggaagacagcatgccagggtgatcttgtccttgtgataattatatcttaccactgggaagccctaatagtatttatatccatgaccccattttcttaaaaattaatttttgggg

SEQ ID NO: 89464 - DNA, 1096 bp, Homo sapiens
ttatttcactacaagaaatttgcaatataggcataatgaaccatttgcccaaggcttaatataaagaattagtgccattagcaccatggagataagaatttgaagtctcaacatccaggcctgactctagactcacctcttacaggtttttcaatcttggacaagtcaagttaactctccaggcctcatgttctgcatttaaaatttaaggataataaaaacaccttccatccctatattataggattgctgaaagaatcaaatatgctgatatacacaaaagtctgtggaaactgtaaagcacaaaacaaatatcattacccttgtcatttgtttttgtgcataggctctgtttaggtcattgactctgcactactgccagcattctaccatgttgcacaattaccattaccttggataaggcttggggtatctttctattttgtgagttaaagaaattgcatctaaggagctccacggacacttgatgatttatgaaatctgcctcatgaatatacttctcattgatttccttccttttcttctgatttcctgcagtggaagaagcaaccccagattataatggaaatacctcctggataaagatccatgagaaagattctgctaaaaacaagctgtggcactttgagcaagtctctaaccattccactaccacagtatgttttcaatcccaaaatgtgcagggcacttcttatctgtcccccaaaacatgcaaaatatctcataaatgttgatatccttgagttcatggagcaatttcaaatccattattttatttgatccctttagtaactttgggaaaagtgagaacagggataagaaaggcaaatttatatgggagaaaataaaccttttggggttatgtgcctagtccaaattcccagaaatctagatattcagacttcagttcagtgatccttgacgtttactaagcctcttccagtgaggatctagtgatgataaatatacacacctactacgtacccccaaaaattaatttttaagaaaatggggtcatggatataaatactattagggcttcccagtggtaagatataattatcacaaggacaag

SEQ ID NO: 89465 - DNA, 1046 bp, Homo sapiens
agatattttgcatgttttgggggacagataagaagtgccctgcacattttgggattgaaaacatactgtggtagtggaatggttagagacttgctcaaagtgccacagcttgtttttagcagaatctttctcatggatctttatccaggaggtatttccattataatctggggttgcttcttccactgcaggaaatcagaagaaaaggaaggaaatcaatgagaagtatattcatgaggcagatttcataaatcatcaagtgtccgtggagctccttagatgcaatttctttaactcacaaaatagaaagataccccaagccttatccaaggtaatggtaattgtgcaacatggtagaatgctggcagtagtgcagagtcaatgacctaaacagagcctatgcacaaaaacaaatgacaagggtaatgatatttgttttgtgctttacagtttccacagacttttgtgtatatcagcatatttgattctttcagcaatcctataatatagggatggaaggtgtttttattatccttaaattttaaatgcagaacatgaggcctggagagttaacttgacttgtccaagattgaaaaacctgtaagaggtgagtctagagtcaggcctggatgttgagacttcaaattcttatctccatggtgctaatggcactaattctttatattaagccttgggcaaatggttcattatgcctatattgcaaatttcttgtagtgaaataagtcatctcaagaaaagaagtgggaagccttgcttccaagcagttaatgtagaaggccacccttgcctgataggctgggtcctggaaggtcactgacagggacttgggtaagtcagtgcctttgtcttccgatctggaagatgaaggggttagacaattctctcttgcactaaaaattatgttttgagatatatggatgaaagatattctaattgtggactttcctaaagatacaatgcagaaaataggagttctttcatgtaaaataagcaggttctattaattcattttactttgtggactg

SEQ ID NO: 89466 - DNA, 1766 bp, Homo sapiens
tacattacttttaaggatgtccccatcttttttcattcattcttataacattctttagcaaggttggacaaaggattttttttctttttttacttcctctggctattcttgcctttctgttctttagacaagcctggcccagtgcctccccaaggggtctgcacttgctatgatctgttctctgccttcacatgacctaccccttcttgtcacttaggtttggatcacatgtcacttcctcagagggcctttgcagattcttgcagttaaggtccccaggccatgtctttttctatcacattgacctgttttatttccttcataggatttattgtcatctgaattgtgaatattattgatttgtttacattatcatggtctgtctttcctgctggaagttaagctccaatagacttatttttcttgctctacgttgtataccaaacacccagaacagtgctttgcacatagtaggaggttagtgcatgttgaccgaaataaacatcttatgagaaatttaacaactgctcaagagtacgtagtcaatgaaggactgaactagggccagagttcagtctctcaactcttagtttattgttcctttcactgatatgatgctgccaaaatgtatatgtatttatacatgggagttcctgataattactgataaaatctggagtgattgtgagacatttatgtgaaactgaatgcatttcttaagggaaatgaggaactccctgaggctcacaccattcagcttgtgacaacagaatttataatcgatgtactttgtatattgggaatcaatcatcccatatttgtttaattcatttttaaaggaagccaattttaggagcattttcaatattttttattgatgatacttgaattttaacaaataaatacacatcatgtacacacaatcaggagagaatataaacagtgacaggtgacaggccagttagattcttggtcaaactgcagagattttctctctgacagaggctgaaagggttttatgggtgaaactgttgagcatgtgaagttgccaggggacatggctgttccctctaagttcagccccagaagttgcattgcaggtgttttctagatggcctactttctctcaattacccatcatgaatctctcggttattagaacttttggagggatgaggtagtggatgtcacctagattacctcttaattgtattgtttttctttttttattcttctgtgaagcaaatttgctttcatttgctctatgttttctcttttgagcattaaggaagctttctctggatacaaatgtctgagtgctggtgaagaggagtatgtttattgattttccagtccctagacttgtcagccctcatctccccattagagaacaagtgttattaatctgtcattttaagaccattgttccatctccttgctgattttacctttggttcttccccttcgttatctcttgattgagacacaacatgctcaacagcacatggcgtttcaggttagggccaaggatgattttgtaaaaacactagcttctctcttatatgttgccactttgcgattttgcctatgggacctgctcagacctgaaaggatggtatcattgccttataagtacattttattaacccccccaccataaatcaaagcattatcttatgcaagtaagctctaatttgactcttttatttttctcactccatcacccaagagtttcctgctgttcccctctgtttttacatatgacc

SEQ ID NO: 89467 - DNA, 1025 bp, Homo sapiens
cttgataggagctgtggcctttggttaaggacacagctagcctggggtgacccagcatggaggaagctgggaaaacaatacttctgacctcactcacctcccttttgtgatctcctgctggtgccccttcttggctaaaaccaaagggtaaaggaacctgaatgtgtaggtatagaaatcagcatcactggctagatagcagaccaagaggcaagggcaagatgtcctgcccagtgtggaagctaccccagtctttgttcctttcatctccttttcaggtcagtaccttggaaactgtggacagctgttcatgactgacaaatcattccctaccagagttaatatttactcccctttggctactgggaccttaggaaccaggtgtgtgatgggcagggaaattgtcaaaactcaggctggtggttgtcagtggtttctctggcctgagggaagtggatttttattttatgctaggagacctcaaggctaattattcaccaagttgtggtggctaccgtcttagcccaacataaattttaaaaatgcctgctttggatgtcatttccttttgatgtttggggtaagtgatgcttctgctttcactttcttttgggggctgggagtcctttagaagcagcaatgaaaaaagcagggatttatattgggattctgtttataattcttgaaggatatctatccccattctcagatttgatcttcacaccaaccctggtggccttccgagcacggatccgacaatcaaaatgtaaataaacagtttcaaaatggcaagaactttgaagaaaacctgtggtgctgggaagggcaggaagctttcctgatgcatctgtgcagaggggtgagcaggagtgagccagtgaatggagaagggaagagcagcccagcaatgaggacgtttttccaaaagaccccaagagggagtagttatggctgaggaaattttgaggaactggaagatccatgtaggtccaatgaactgatgagaaacagtgggaaatgagact

SEQ ID NO: 89468 - DNA, 1048 bp, Homo sapiens
aactttgcttatttgatctcattcaactggaatgctctctttccttgtcagtaccccattcattcttcaagaaaggagtgtcttcctctgaaaaatattcctagacttcttagattccaggtgtatcttccttcctcagcattcatcttgagcccatgtatctattccttgtcccacccatgtgattgctttatgcacacatcataactgaatctgcttgagagagaagggaatgcctatgtgtggtttgtctcacaaaatctaataagatgccatatccagaacgatgactcatagttacttaatgaattattcaggtcaagcatggctttctcaactattcctagacttttcacttctccttagtaatagcaggtcttcatttctggccatggggtatgcacgtcggtaacctgccagtcctccaagaaccaagctttttgtttgttttttgtttttgttttgttttcagtaggaatcagctatgttcccctggcatcagaggaaacctgtaggtatttctgtgggtcatttgggcctgggtgtccttgagtagacgttgaaaagtattcttccaaagcacagagccccatgcggagttaaagcaaagatcagaaaaccagagaaggtctcgggagagaacacaccatataaggtaagggccaatatttgcttgcagggattgggggaagggacatccttaggaaccgagagtaatgactttggtcttctgaaagtgctgttctgttatatagcaggccattaaactatgttaacagtcatatcagttatgttcaaaatgctgctcctttgtatataaacacagtggagttctgtagctgtgaaggcccaggcccttggcacggctgttccagggtaggtagtaaaacgtttcttcaggactctgcagcagctgccctaatggaacactattgacttgagttacatcggagctaaatatagctggtgcagtcatgtccacaggattgcatctgatagccaggacagaatgtgcttcttagagacatgcacttcttagactgagtct

SEQ ID NO: 89469 - DNA, 1527 bp, Homo sapiens
atctgggttttcccctcccttttaatgggtaccttaaaaagaatgaatgcttttactaaaggatcccaaagtattttcataattctcatggtctatgagagaacatgcagttctatccactatgaggaaggcaaaagcccataaatatggttcaacttgccccaagcacacaaacagagaacttgagtattataaagggatttggggaccattaaatccagccctcttcttattagtaaaaagaatgagctcaacgtgggatggtgatttctgatagagcttgcatcgtttcttacactctcatggtttttttctccggatatgggggaacatccttaagggccctgtgcaaaggcttccactcctccaggccatgtcacctatcagtctgtgtgacatgtgtttcacagaacacacagtgagacataaacgatgatgggaaattcctctgtaagccttagacacaaggctgctgcaggatcctggcctcccctggaataagcactgtgtgtgcttcaactcctggactcaagcttctcccaagatctcaggctgtttgcagtccctacactttgtccatacaactaaagtctaaggagagctgatagaggaagttttctctctctagggatttaaattagggatttaaatgtatcagaagactttaaagatgagaaaccgtttaagactccaagtaattaaataataaaataataaaagtattcctagcatgttgaaaggtgacattgggaacctgcttatttgctgctcagccatatgtctgagggattaacttattctgtgtgtctagcagctgccagacacccatggggatggctgtgggtccatgtgtatgcacatgtaagtgtgtgtgtgtgtgtgtgtgtgtgtgtgggtgtgtttgtacgtgtacttctcttccttcaccgtctcaaaacctaccagttattcaattctatgctcaaatctcaaccccttcacaaagcaattttggacttctccaaaggtgtttttaccctggacatctcctttttaactttgattatgttctgttgtcctggtaacttcatatgaatttccatggtctgttaaactgttctttctttatttcaggcatttgctttttcttctgatctagatcgttatttccttgatggcagagactgtcatctttttcttgatttcgccatagcctgaccatggccttgagctcagcgctgagcttgtagggctagagcacctttggtttgggcatccaaagagagcttggctggcacaactcattttttcagcaaaggaagtaacacttcactcagttaaggttaatcagataaggcagtggtagggctagggggagcactagttcatccagcctcattgttctatgctaaattataggtgtctgaactaaatttcaggggagaagtctggtagatcctccatgcttggcaggaaagtgtgctggagggtctagaagtcatgccccagaccttcttttcctctttgcctctgtcacacacttcttga

SEQ ID NO: 89470 - DNA, 1047 bp, Homo sapiens
acccccaatctagtggaggacccaggcaaaaaataacctgagaatgtgatctatagctgaggcaagggctgaaggagtagagaaaatgcacctaggccagtgggagtagggtgatgggggaaggttggtacagagaaccacactcatgaacagagagtagaatcttctagaaactacctctagcttattgaatttgcacagttatataagaatatatcaagaacttgcctcatgcaaaacttgcactagatgcaagatagttgtggtagaaatggaggttgctgggtggggttaggaggagttttggcccaaagaaaacagatagcaaattaaacagaaggccagatccaagggccaggttgagtgctgctgattttttaaaaattgaattaattacaataaattgggccaacatgatatatggcttcttacacatctagaattggcaaagcagacatactgtctgttagtctaaatgacggcaaattttaggtggcctaggaagtaggagcttctagtgataagccaagactaaataaaattccttctctatgtaaccgaatgtttgattaaaaccccacatgacaaggacaagtgtttttaagaatcagagatccatatgaacaatgatctttaaggcttcagagaagagatagatgcaggctggccgcactctgagctgtaacctctgatgtcgggcagtgcacaacttgtgcagctattcatagtattccagaatgtcagaatctgaacaggtttttaaaaattggcttggattgataatcagatttggtgatgagcattttctggtaggtgaaatatcgtaaggacaggtgtgtagaggtggctattaagataaagtatgtggaatttggggtccttgaatcctgtttagctgtacttggtgtcaattgaaatctcataacattggctatgtagcctccctctaatatcataagcatattgttgggcagggaggactgcctcatatgacagaccctgatggtgaggtgagaagatatatagctgctggccttggcacatcct

SEQ ID NO: 89471 - DNA, 1045 bp, Homo sapiens
gattgtttcattcagacagatacttgagagtgggagtagacttccctttttcctcttgatacatgtgtcacgctgtttttcaaaagatatataagaatcaaaatgctacctttggttggagatgggcaatccatcacctggtttccttttgagcagtagtaccagacaccagatacacgcaaaattcattttctctctcatcagaacttctgaatgtttatctgtcactctgtcagctgagagagtgtgggtataattctatccttttcatcctccctctgtatatcactggatgttttctttctctggtaaggcttactgtgtatgtttccttcatttgcagactgtcacaaaaacatttttgaaagtaggtggaggtgcacatggaaatggaagctttttctctcacttaatcttcgtaagatccgaagtggtggcagagggtacccctgtattacagcagaggacactagatcctcagaggtcagcagcctgctcatggtcccatgcagggcagaggaaggaaactcccatccaggccctgtgactgcatatttagcatcttttcacagccccacaaggaagtgtaattgtgtgcccccactgagatcacacatggcttgactatcttggtctgctttggcttacatgataatcctgtcctcaggttaaaatcaggcaacaattggaccctaacaatttccattgagaatgattgtttcaatatgaactgggactgcgtgtaacctacatggacacctcttgaagacaaggcaaattgtaatgatctccaaaccagcagcaaaaagtaaggactcaacaaccaggttagggcgaagaaggatcattctttacaaaaaaaaaagttgccttgctgtacacgtcatcattgctgatggtggaaggaacagacaactggaagttgtactaggcttgcctgtcctggcagctttgggagactggctggttatgaggagtggcagcgcttgctggcagccctttctggccagctcagtagggggacattcctcaccagggcagccca

SEQ ID NO: 89472 - DNA, 1067 bp, Homo sapiens
tttgacaggtagcatatgacaatggctattccactattgaaaacctgggcctctgacttaggtgcccccaatctcacctccccactagtacacatatacatgtagttgaaagtcaacaattacagttgttttcaatggagtatagaaataagagagaattggctgggcacggtggctcacacctgtactttgggaggccgaggtgggcggatcaccagagggtcaggagtttgagaccagcctggccaacatggggaaaccccatctctacaaaaaatacatgtggtggtgttagcctgtaatcccagctactcaggaggctgaggcaggagaatcacttgaactcaggtggtggaggttgcagtgaacctagatcatgctgctgcactccaggctaggcgatagagtgagacttctccaaaaaaaaggaataagagagaatttatctttgcctagctcttcatgtcttattaattaaaatagactactgcttacacaaaatatccagcagagtcaaaatcttagagtggatactggttacttgcaagcttttagcatttaacagaataaaaagaaatagatatccctggatttgttttcttacaggtgatactagtgaaaaagatccatgctttcatccatctgaaggaaaataccaaatgaaacaaaaaccaatgatagcttctccctctctgctctaacaataagcagttatattttcagaaagcaaataaatgattcagcaggaaataggtggcatttatttcttatgcctagctctatcatttggtgctgaaaacacttgctctgtgatgaggactcacttctattcaggcttacgagctgctgacttagggactcccacataccgggagaaaaatattctagaacaggacttatgctcaggtcaaggaagttcaaacctcgatgcagagcagaccccttgtttatgagacctggggcttttgtgcaataaagaaatagaaataatctttattagctaaagtggcaaagcagtagaaagggggatgatatatataggagagccaaagatctgtgagatcagt

SEQ ID NO: 89473 - DNA, 1906 bp, Homo sapiens
caggaagagtatatgtggatgggtagaaggtggctaatcccagagatgatttgtggcccccggaagctatagaagaggcacagagcaggagaagaaggggttaatcaattgttctccaaatgtcctccatcagcagggaccagtaaatgtaatgattaatcaatcaaataattactgtacactcgtcaaatgtcaggagatgtggcaaggactgagattcagagatgaattaagatagaattacttgccctcaaggagttgtgtagaaagtgaccaacaggggcaagacagaaactaaaaatacaaccagatacctttgttcaacataggcccacatggacatggtagggacaagaaaggatatgagttaaatcaaaaggagggagaggggagccaagggcagttctctggaaagggtgcagttgtaggtacttggaaacaggagcagttttctaagcagaggaaagaggaaagggtatggctggcttatgaagtatgaggtgggacagacaggcgactaggctggggagggagatctttatcagagcagatgggccttcttggagtttctagggagattggattttacagagcagctagagggagccattgaagagtattaaggatgaggggaggtaacagaagtcctgttttaggaaggtccctgggttgggagaagcagcacagggtcaggtcacagaggagtagccatgcagtgctcaggacagctctccctggggccactcccctccaagggaggggctctacagctcttgcatctcgaagaggcccttgggtgcggtgcattttatcaatatcatcaaactaagccagccttcaaaggtttgtgaaggaggcagcgtcgtgtttgacagtctctctactgtgtcctctttgctccctgccctcagctttttcccattccctgcctgtgctcatgctgaaatctctctccagataaaagcccatctgattaagatttaagcaaaagtttagcaaataaaaatacaggactccaactaatactttttttgtcccatgaatagttctaaaaaagaatttttaagtattttaaattcaaatttaactattgtcctatattttatctggcaaccctacatttaatacgtctaagaatctcattttagagtttagggatccaccttgtctggctgctcaatgtttctttcccataggaagatgctgaggcccctaaaggtcaagtggtttgtttgtgaagttcacacggccaagccagagcaaagctgtgacttccagaccaactctgtgtccacttggcaacctgttctctgtacctaggaatgaattagttaaatgtggcagacttcctagaagcatttgcatttttaaaagaaggcctgagggcaaaaactcctagagtaagaatgtctaagaatgaaaattcaagtcctattcaagaggaaaggcattctgtcctggagctttcttggaattaaggcctctttctgcagccaggggagcctgcctggccttctgatccggcaactaatcacgtgaagcatttggccacggacaacgatcctgtccattggaacgatactttgaacttttcagagtgcattcagaaacatcatttccttactctctataagcttttttttttttattgtaaatgttatttacatgctttccatatttccaatttggtttctgccaccaagcgaatcaggaaagtttgatccacaaacactgaattgtatatcagctttttataaacacactgcagtcaaatttccattattttctttgcttaacctgctgccttcattttattagagtctcatgccttttccctagttaggttctgtctagcatacctctggttcaacgttattgctgcccaagaaaaaatgtcagattgttt

SEQ ID NO: 89474 - DNA, 1079 bp, Homo sapiens
ggtagaggaccaaagaggggcatccagataagtggaggtctgagatgaaagatagatgggataagcattctccttccctgtatgggttttaagggtacctgtgtacagtaagcacaggataaacatttgtggaatgaatagatggacagataaaggaggactcagacttgatatttgctgaatgcccagtaatagtacagagggatgtgattgcacctccttaggaagagcaggtggagaacaatcatattgatatgtaatttttgatagcagcaggagcaggaaaacgtaagaaggaggtcattctgagaacaagttgtcttcttgatccacattgctttttattttatttgacttatgcatttagtgtttattgtttccccagaagaggcctgtgcatggtcgaattctctccatggctgttcatgatttagggacagagcaccctgcaccctgccatgtgtacacttctctttatgaggcttacaacgtttattgtctcattcctccatttggcaaggtcaacatggcaaatatataatttccatctttaacagatgtggaccctgagttggagacatgaactgacttgtttagtttctcgcagccaatgagccagcatgccttttggctcaaattcaccagcatgactacccttgctagatcccagcagtgacatggcgctacctctgcaaggggctcatgcttagtggcatagcacacctcttttgcaaaaggactctgctaagccaagcatggcccacttttaactctcttcatgcagtgggataagggaattgatcaattgccagctcacctcaggtctgggctgttttcctatttctcaagattcatccttatggtaatgacattttacatcttaaaatacacttctttgtcttgggccagatttcaccagctggagtaaagaaactgtctttggctctcctggacagtgtccaggcatctggagtaatgagagggagatgggaatgaagaaatggtccaactctcacgttcccagttcctgaaactgccaagggttttgtaaaattgtaagaagtattttagaacacaaa

SEQ ID NO: 89475 - DNA, 1054 bp, Homo sapiens
ccatttaaagctcataaatatgggtgacatgctgcctccctggctggggattttaaggagagactgagatttgcattgccattcaacttttattgttcggtaaagagaaaagaaaagaagagagcgaggaagtaggaaatgggaagagagtgtccaggagggactgagaaagacagagggagaaatgaggcacattgcaggttgccacttggatggtgggcatcaggcttcccgtgcttgccccaggctcatctctagcctttccccaggagggctgggacatgtgaagggcaccagctcagggggagggcctggtgaagcacacaggagcaaataggtcaccggacattatgaaccatttacttcctcttttaaaagcattgttaaatcacaaccaaattaccgtaaattgtcaaattttattgaaacaggaaagccctatagcttcactcttcccagccctgctccctggggacagctttactacaaggtggagcaggtgactaccctggtcatagaatctgaagggcatcaatctggtgccttccccaaagaatatcccacagtgccccacagggaatgggcaattccatcatgtgtgagccaactggttttggttgggagtcctgcatggtctacagattcgcaaaagggaacccactacagcttaccaatgaatgcatggattgttagggttagacccaagggtggcagaggcaggaggtgtgtgggaggaagctgaaaggagggaccacacagtacacacttctctagttttgtgggtggacttccatttggacaccctgcttacctgttgccctcaatttccatctgaggaaccaactgttacagatgcagccctgatccctcatgtggatttccattggctgtttagtcacaaccactggaagatgctgaggtcatcagccatgacccttgagctggcagagccatggggggactcctggggcttccccttcattctatacacgaggaaagccagggtctgacagctggtcaaccaaagagaccgatagcagccaggccgctcagc

SEQ ID NO: 89476 - DNA, 1021 bp, Homo sapiens
tatcccagctttagggtagaaatcagcagccagttatgtctggttgtcagcgctggattggacagatataatctcgagtggagatttctgcagaggtgctcagggttagcagacttaaccaatcctatttttaactagcaatgtgatcttgaaaatgtcacttatcagcttcttctgcaaaataaggacttagtctggagttttaaggtatgttttagtaccaaacattggttttcaactgaagtcgcatacaagaaccagggaaaagcagagccactctgagtgaaggtagagagacaggcacagtgcacgccctttgtctacacattttctcaccccagtttcccagcagaggtggctcctgagcccactggggacacaatgattttctcctcttctccagggacctccaactgcctccctcaggccctgacactaagaatggaactcttttgcgatatcctgatgtaggtggtctgtgatcttttcctttatttctgatccacacctgagcaccatatattagtgcctgaggttcagctgtttctccatcccttggtgtgtaatttgtagacttatgggaaataatctgctttgaaaaggggagtgctcaagatgcagggtttatgtttggcccaacagcccatgcatttggttagagcgtggttagaacccagaaaggccaggaaggcagaaggccagaaaagccagaaaggcaagggggttgtgacgtaatggtgaggaaagacacactgttgtacataccgttttttcaggacgcattgtgagatgtcacaagccttgcctttggttgtttcccaggtcagataacaccttcaatgcatgctagtttgtgagttaaacattccaaatctcccaaataaaggaatccagatagaagttatttgagttccatccctgacattatatccgtgtatcctcccacacatcatcagatgcactaacacatctgaactgggatgggcccatttaacattttactgtttcaaccagtgcaagg

SEQ ID NO: 89477 - DNA, 1055 bp, Homo sapiens
agcacagactaaaggatttggtcctcacctgctacataaaccctctgttgtctcagagaataggatacttcctttaggcaaaatggagtattatttcaagtgtggggcaagtgtaatggccacctatgaagggtggctgtttttaatgagtttctaaaatgtcaattgctactatggtcaagggcatgctgtggtggaagataagaagagagtaaacaagaacacataggaaaacatgttttagtgcagagaaaacagaactttcactcacttagttgccatttcattcaacaggcatccatggaagacctttctgtagggctcccagctatacacagacccttccccagatgttgacaattctgaaatgttctgccaccaatattagctttgtgaccctgacgaagttacctaatgtctttgatcttgatttaccttattaagcaaaggagttgtgcagcttatttcacagagagtatgggcattgatgagacaatgcatgtgaaagtagcattgtatgcctgaaatgcacagtgaggtattgtttcttccattagagaagtgcagaataaattaattgaaaattcaaatgtagaagaaattatatgtctatggaacaagcagggaggtcgtcccggcagaggtggtgttgtacctgggccaggatgggtgagaaaaaagtgaggcagtggacttattccagagcaggggaagcatggaggaaggctaagacaacaatggcgatgcttaggtacatctggaggcttggtgtggtttaattgtggagcctcagaggagagcatcgtgggaaattatttgcaaattaaagtggggccaaatttcaggtcttaaaggtctggaaaatgaaataataggtttttttaaagtctgaaaaataaattaggcttaaaaattaactatgactgaagttttcatacttacacaaaagttagcataataatataataaacccatgtacctgttacccagtttcaatggtatactgctaaaaaagcccacatttgtagcatctgctaatttctgttgtgtaaata

SEQ ID NO: 89478 - DNA, 1070 bp, Homo sapiens
agaatgggaactgattgctagtaaattggaggtgcaagaaaaagtgcaaagagggcctagaaaaagttgacaaccagtcttttttgggagtcaagtcagctgactgctttagttttaataccttcttgaggcctagagagttgtcttgatttatgtttgaaatggtacctacctattttttcccaaacatgtaaagtgtagtatcaaataacaacatacctgaccactccagcaagtggaagcttctctctcattctgctttattctggaaaaatagcagcaaataaattttatttgcttgtaggccttaatttacttgaaagttgaatatatttcctagcaaacattttgtttttcttcctatttttgtagagtcagtcccctccatggtttctttttcttcagcatttcaaaacagagataaataattttgctaatgcttttagtatttctctgattccttcattaatctccagggacaaccataaacctccgtggctttaaaaacatttcatttttcttgccaaaccaggagaagaatcaaaagaggaagttagttatctttgtactaagttgcccactcttcctctaaaagtttgagagctaccatcagagccttatttatcatccctactaaatcctgttctttgaaccaaaaacaactaaaagacttggatcagttagcttagactgttttgattccctgcagagttcagtttggccccagtcatgtggggagtgtagactagagtcataagaaatactgtctttggatgctcaagtcatcttctgttctagggagctcagagcgttgctaagggagtggtgatggtgtcttctaggtgtgagttgcactgactctccacctgaaagtgttgacactgaggtccacaattgttgcattctgctgcagaagtcttaacagatagttaaattaaactattgagatgaggcctattgatatacaattaacccaagacagttttcttagatatatgtgtatatatacatagaaagaacagataaatttgaatgttggtaacccttgccgtctatgtggggaagcccca

SEQ ID NO: 89479 - DNA, 1053 bp, Homo sapiens
ttctgtctttcctttttttctttctttccttcattccacagatatttattaagttcttctcaagctctcaaatatcctaaacttaatttgtgtaaatattgctacagcccaggtcacagtgaaatcttagactgagacaccaccttctatttacacaggcagcatgaactgttgttgccctatttggtgaatacggcataaagtatccaagaaacagcccagacacggagagaatattttctgagcagtcagcataatgagattgaatgagtcctaaactatgtcagaaaatctatatttaactcccaactttgctattcattctgtcaacctcagacaagtcatctgaactctttctgctacattgtcttcaagtataaaatggaactcatagtttcctctcttatgaactttacagggatgttgggtggtatgagggataacataaatgaaaatggtaccagaaagtgaaggcccccacctccctgaacctggtaacacagattttgccaaataagccgcttccctggtttcccagacctcatcagtgcatggctgctgtccagcctgccaattcattgacttcaccatgccctattaattgattctggggaaccccatcagggaaagaaattaataggtgtagctgtttggagatagccctattctccagagaacctcctgaatgtccctctgagtagatatcagggaaaggacacccttctcaaccttctgtgtgggataggaatagcgtgcaccaggatgcctgtgagacaggtgagctggaagcccttacttgctgcatgtcagtttccttatttgtaaaacgaaaaggtggtgagtcttacttggtggtttttgaacagtgctttccaagtgctgtgtagggcccactctagggtcactgcctggggagaggcagtttggtgcaggatatttgggagtgtttccagctctctgatcccagagttactcagcttttactttctttatttgtttatgctccagctgtgattttatttcaaccaagggttacaaagctttaaaattttt

SEQ ID NO: 89480 - DNA, 1018 bp, Homo sapiens
gatgataagtctctgacctcaaagtacttatagtctaggaaaaggagacagaaaagtacacaaataaatgccacctagcagtataaagactgtgatagatgtctttatgggaggcagtggcaaatacaggaggtatacagagaataagaaattaggctgaaggcagtgaccgtgtttgcagacatgttgcaatacatagatcattgatctcactattgacaaaatgaaatacctgtcgtaaaatgtatgcttcttcattcattcagtggatgtttattgagtgcctactgtgtgccaggtgctctgcctagtacttctgtgatggtgtatacaagcaagaaggggagacaggcatttaattcagttagcacacaaatcaaatgtaaaactaaaactatggtatgtgcaacaaagataagttacatggtttcatgaaaacttataatgggggtatttctataaggtaggggtgtctccctgggattgagctgaagccagaacacgaaaaaaacattaattagggactctgttaggtaccaagagtaagataatggaacagcagagaaaaaaacggtaggagttagggcccaagatcctggcctagcgtcaccatggagcctctctgtggactttggtgcccagaactagaaaagtgatggtggtagaggtgggaaaaaaagaaggccactgcaagtcctgttttacccaggtccaaaagaatcacaccgtttgtcccactttttttttttttttttttttttgagacggagtttcactcttattgcccaggtgcccaggcttgagtgcaagggcacgatctcggctcaccacaacctctacttcccgggttcaagtgattctcctgcctcagcctcccaagtagctgggattacaggcatgcaccaccaagcctggctaattttgtatttttagtagggatgaggtttctccatgttggtcaggctggtcttgaacgcccgacctcaggtgatctgcccgcctcggcctcccaagtact

SEQ ID NO: 89481 - DNA, 1126 bp, Homo sapiens
gggccttggtgacatgcagccttctctgaaccctcccaaggtaggcagtgccagtctgtccagtggtcggctccataagaggaaacacaaacacaagcataagcacaaggaagaccggatcctagggacccatgacaacctgagtggtctttttgcaggcaaagccacaggcttctccagccacatcctgagcgagcggctgagtagcgcagacaaagagctcccgctggtgagtgagaagaacaagcataaggagaaacagaagcaccagcacagcgaagccggccacaaagcttctaagaacaactttgaggtggacaccctgtctacactgtcactttccgacgcccagcattggacacaggccaaggaaaaaggagacttgagcagtgagcctgtggactcatgcacgaaaagatactctggcagtggcggggatggtggcagcacgagatcagagaacctggacgtgttcagtgaaatgaacccttcgaatgacaagtgggacagtgacgtgagtgggagtaaaaggaggagctatgaaggctttggaacgtacagggaaaaggacatccaagccttcaagatgaaccgcaaggagagaagttcttatgactcctccatgtctccaggtaaggctgtttttcttcagaaatggattatcaagttatttcattgctgggctttgcacctcagacacatctgtggcacattgtgttcactagtttgcaaagaggtgggaatcaaattaaaatgggtctccttgcacatttgagtttgctgcacattttgtacattgtttacttggtatttactatcttccttctctcctggagccattgtttgagaaactgtgaagccataaccctaatagctgcctaggctgcagtcgtgcccactatggttatgctttttattaaagatgctgttcttaggtcctcatctgatctaatggtacagtttgctgtttggatacagcctctaaaactcattaggaatactaataagatccaagaatgccaagcctgggaggaaatgactagctaatttatctggcatgccagctccacaagtcacacatctaatgtgagaagtctactgcagagccattagaagctgatgacca

SEQ ID NO: 89482 - DNA, 3780 bp, Homo sapiens
gactacattcagatacttgtcattttcgtgcactaagtggaaggaggcaggctggaaggtgatatgtgcctcctgcttccagcagaccttataactgtgtctctttgcatgcccactagaaagggattttgctcactaatttaaactgaaatgctggttgctactagaaggatcctattccttgtcagttgctggcagaattcccttgccaacctccccaaccacacaaaatccttccctgctgttagggcctcacatttctgcaaaagtatccctttgaccctggccttacatcatatatgataagacccctataaagaccagagaagttagttattaggaaaatagtagaaacttcttacctaggagttgcagaagctaaaaaaaaaaaaaaaaaaaaaaaaacagttcttgtgttccccctgttcccaaatagtataaaaccctccagccaaagcctggctttaaaaaccaatcatccatgtttaaggtttggtgtagcatttcacttctgtttatgatgtgtaccactcacctgtcctctcccttcccagggagcccatatttcctgaaggcaagaatagtctattcatgaagaattagagacattttctaggccagcagatttcaggaagaaatatgattatgaggtagaaaccacttaaagatcgccccagattgccactagcctgtgagttgtagtggtagatgttctccttggttaatgaagaaaccaattagcagtcacatctcctgcatttactaaaggtaataaatgacctacactttgtgtctgcccaaagtggatgtgctcatctgggcttcatcatttctcatcatcagactttgttgaaggtgcttggttttatgcagagtgcaggctaagcccacctgggcaggaggtactaccttgaccttgcatgacatgtgagaaactgatctctttcagcatgatgaaactgattcatgggacttacactagctgtggacagaagatgttcttatttttgtaattttatgagccttatttagctagaaaataatggtgaggggtaattgttaagaacctacacgcaaaaatcctaacttaacagacccaaggagcaagacctcaagaagctaaaaccagacgttgttgcatgttaggtttctcaacgattttacgaggatttgtctgtggccaggctgtgttgctgagtgctggttgacttcataaaatttcccagctggggttcacgtccagtcactgtgtgcccccactctagttatattgcttttcatgtgcttgcatttatatcgcattcatcactttattaaaactcctcctcatccctgtcccatctcatctcatcttcagccagccacttgagatgggaagaaataggtgtcatgacaatgtcatgaaagaaagctggattcaacccgaagaactggatacaaggcccaactctgttactaattctccgtgtgcccttaggcatgggattccacttctttggggtactgtctgcccatctgtaactcatggggttgggccagacctcttgtgtatagtgtgcttccattcttaaagccatttcacataaatttttgtgtaacaccctttgtgcaatgttattagacaggtacttttattcctatattacagatcaggatactgaggctcaaagagatcaagagaactgtccaggttcaaaaaaccactggttttgattctaagcccagaactttgcctgctgcactgaaccttgactgcctgcctgccaccaagctagtgaaagctgtgtttagaacacagctcttggtgcccagtccagtgctcctctatgtcacctctgccctttctttcagaatcccattcatcctcagatcacatacccttccctaaggcatctgcacagtgattgtgtgatgattacaaaagagaatagttaaggaaagaagacactcgtttattcaattcctgaccaatgtagaaggaatccttgtggccttaccttttctgaatatcagcctggagacaccatggacagagcttccacctctgtccttactgaaatccagcactctgagttatttttgccactgctttgtttctatctctgtcctctatgaggttattttttcccagaactttaatgaatcataattgttggtggctgctacatctatatgagctatgcctgatgttcctgcatatcttgttaagtttcttactaagacagaccagattcccccttattcccctcccttccaagccttagcctctcattgcttatatctcgaatgtctccttcatggctgtgcccccaaagcatgagagaaaaatatctttagcatcacatagaatccagtgtcagagtttgtcaagactccctgaagagcattcaccttaatgtgatagactctgaagagtgccaagttccatgaaaagacaggaggcagatgagatgaagctgagcttactagatgcattaagagctttcagtgactttatctgagtggaggtgtctattcagctggatggttctgagggtcatgattggaaataagcacctgcactttctacaacttctctccctccaccttttccttcatcacacttgattcatttccttagcatccaaatgtcctatttcacatgagctattcttctctaaaatagatacagtataaatatagatgtcatcctttttagcctgttgaggatgagaattagaagcagagtcaagagaaggctttgagtgctccctgagatcagagctgatgaaagataccatctaaacgtaagtcattaccattatggagagaggaattagagaccctatttagcaatagcagcagttgcacactccatttcctttttcttgcttggaaaatctttcattctttctctccctgcccagcagatggttgcattgtcttgttagcccacttctaacatacctagggctaggatgcagtacagacttctgaccatttttctgtattttacgcctcctttttttggtttcagaatgcagtagctcttttggcctgttttctaaatgcataccatctgctaaatgtccgtttataaaaatgcttgcctgggaccagaaaatggataaatagtgagaaggtgcaatctcagaattggtataagccttatcagctcctatttgggcctgtctgtcggcaggcattgccttctcttgcacactaacatttagcagagggccagaagagcaaatgcatactccaggggtgacaatgcatagtcagaatgatgccatgtgccctcaaagccaagttttcacaaggtggtggaagagtgatgagtgacattttctattcagaccacttggaaacaatctttgcatactttgacctaaacttatgccagatactgagacctcatgacaactgctgttcaagctcctatcagataattaaaaaaaaaaaatgagaagagtgaatctacatgtgttacctcttagtttagtgccattgttaagaaggtagccatcccaagtccccgaatgttgagtactgtcctcatgatgagtggattctgagaactgattctgagagcacatttcagatatccaaattctgccatgtaggtagctggattccctggcacctggccccctccacctctccttgtagcttctttcttgccctttgccaactcctcttatcagcactgtggaaatttgaggaggcagtctctgctgtcactcactggcaggatatgaatgcccaagccaaaaataatacaaaaacctcctccaagca

SEQ ID NO: 89483 - DNA, 1005 bp, Homo sapiens
aaagtaaatatccaagttattgaccatgttgaccaaatagttagttgttcaatgaagtttgaaaacaggtaccactggttgtatattaatctatgagactcatcccattcatctttagctccagccatttcacttagccattggatttctcctttgcgaaaggtagaactcctagtgcttgagtcccactggctgaaaacatagtcactatctgagacacaaataggttagaacacaaatatgaacatttttatgggaacagacagggcacacttggatttgtatttagactcagcattaaataaatcttaataatgtagtacaaacatctcattttgctgatgagcacactgaggcttaagaaggtcaagtgactcatctaatgatacatatttaattgggtgaagagctcagactgggaagcttcacatcaaggagaagggcagggaaagggagagagagagtgaatacaagaaaaaaacagaaaggtgagtcatgggagagatgttaagctatatgttttcctttgctgtgagctgttgtaaaaggtaagcatctctttgacaatcatttggtttccaggctatctctggggacccatgtctgggactggaaatgatctttgtgggctctgatggaagtcatttttttttcctttcctgtcttaacaattgcacatacttattttattgagcctcccaagtttcctcctaaggtttccttttggaaaccaagaattaatcaaattaaatgatataacccataactttgtagcaacgtaacaaaaaaaaatagctgagactcacagcatatcctttgctacattgaaatcagaaatggagcaattctgcctttggagtttgaagtccccgagccatttatcttcccacagttggcaaatgttctcgtgtcctggtgaaagtttttatttttacctctgtgggattgggaaattatgcagattcaggtgtgggtgcagagaagttacaattttgacagacttgg

SEQ ID NO: 89484 - DNA, 1088 bp, Homo sapiens
tgcaaccttgggcaacttaggctcttagatgtccctttcctagcccgaaaaatgaagctgttaatacccaccacacagagttttatgagagccaaagaagggtaaaatatacacaggagcatccagcacaccacttaccatatagttgtcaataatgttcatttcctttcacttccactttagataatatattcaaacagaaaatacaaaacaacagattggtatagaagtcttctttaaacagcaggctttcctgcccaattacactcttactgggatgaagttaaatccaactctgaatcacacagggaaaggcagaaattagctggaccacagttgtagttcatgatgaagataaggtgtcaggattataccgttatggtggataagtaacaaaatacacatttcacccaaagataacggaaagctcactgagtaggcattatccgtagaacttgggaattctctggaaagggcagtcatcaccatcccttggcatcgggactgtcacggcaagaatgtgtatgactattcagtagcacttgttttgtagaccaatgtatctgctaaccccagccataaaaatgcagtgataagaaaaataatgaaatgtggattggtactctatcattgttgtaacaaaccacagatttagcagtttaaaacaatgcaaacgtgttatttcaccacttcttatgtcagaagtcaagtgggcacaggtgagtactctgtttaaggtcttacggagctgaaatcaggtgtggtcagggttgtgttcctcactaggggccctggagaaggatccacctcagaggtcaatctaattgttgatccactcagttccctgtggttttaggtctgaggccttttgctggcctttgcttctaggggctgcccacattacttctaattttttccatgtggcccgtccagcaacagagtcaaatcactatgagtcttagacattcctcccccaccacaccacagcccctgggaacttcttgctcttctctgaatgcaagtaccacattctcccacaccttctggctttgcacatgccatttctctctctcagaacaccttgcaga

SEQ ID NO: 89485 - DNA, 1154 bp, Homo sapiens
tgagagtgcactagcaagacacaccagcaaccaaaacctgtttgtcatccaggaatagcctgcatgctaggaggaggtggtttggaacatgtgtaaaatcaaaacatttctcactgttaatttcttttcacagttcagaatctctgttctattccatgtgaaaagtaaaataactcctttgctcggatttcttgctgacatttctttttggtgggagtcaggggtgggagttcactctgaatgcttactatacctcctgctacagctctgtggcattttcataaaataccaaccaccaaaattctagtaatcacaaaaacatgtgctttctcctcatatccactgaaattctttctctcattaaaaaatagaagtctcagaaatgtaattagaaagctaaactcgatatctttacattcctttggtttcaaggcgggggaagaaagctgcagtttttctaatttcccttcagttcaatgctactcttgaatggggaaaatgatacaaaacgtctgaagaattgagagtctgacaagaggggaggatttgtatttccttgttattaaaaaagaagaaaaagccctcagttatgtctaatctttaggaacgcagtgccctgtccaacccacgaactgttggcagcatcataactctacacagaatgttcttttaagcttttccctccttcccaagcctttcctgtgaagttataaatctcagcatttagagatattcttatgcaaataaaggagggactttaggttgggacctttcatgttgattctgctgagggcatgctagagaaacagccccaagaaaagcaggcgcacttccatggctaggttctaggtttgactttatttgtgaaaccccatctgtccctcctacaccaagtaccaactccaggaagctgtgatttaatagctctgtgcctagaggaagttttacccaacccctcacaacatcctcctgattgtttggaaagtgaaatgattctgaagatcaaactctaccgcttcttgcactgcctcctcttctgtgtatagctgacctcctcattccacctacacaacactccccttaaactttgttgcagcaggcagagcagtgtggccttaggtgtaggtgcacctggaaaaaccccaaataatgtc

SEQ ID NO: 89486 - DNA, 1060 bp, Homo sapiens
aagcattgttaggtgttctgtgaaaaaaaagagtttgattatcagaatattaaatactcgaataagcaaaaatatatgattactacataacttcgcatagctttcaacataatgaggagtgatatggatctatctataaaggaaaagtcatcttttcccaatttatctgactgcacaactcttgtttctccaaatccacccattaagctatcaaagaatactaacattctgcagaagatggtttgggaaatactaagctaatttaatcccctaaaattaaaaatgccaaaatcaaagctcagagggttaagtgtccttgctgacatgaagcagtagtggccaagcctggaccagaatacaggtctgcaagcctggggctctttctactttctgtctaccttaaggaattatttctcaaaatacctactgccaccttcagcagactgtgcatgtatattcagtgtttagtaagtcgagcttttggggagggatacacacacacacacacacacacacacacacacacacacacacagactcatactcctatgcacatagacaccagagcttctcaacagtattaagtccccttttgcacaaggcccaggaaatgtgctggagcaggaagcaggcggcaggtgctgaggaacagcagaggagagccgccgtgggttttggaggctccttgtttacagtccgtattaaccctgggctgttgcaaaggccaaagcttggctcgcatttgagatatgaagctctgacattcaagaagctccaaagcaaatgaacctgagtgagtaaataaataaaccacaaagaaaaagccagtattaaaaaagatttgcatggtctggtgtaaactcaggaaaggcaggctgctgggaagtaaactggccctcatccgccctgctgtgcctagtctgggcaccagaactcagaagcacatgactgagccatcccgtgtttggggccttagaatggtgacccaggtacatgtcctcagggcaaagatactgctcagggcaaggagggaaataaatgatcatggttatagttagta

SEQ ID NO: 89487 - DNA, 1060 bp, Homo sapiens
tataatacaaccaagttcagttctgaatagccccgacctcccgtgcctctcccgtctcttacaaacggaaactttgtcagaggagggagaggcagggaggttgaggagccttgaaaggctttttcctttttctcaagcactggggctgctcaccttcactgaaggcacagaaggtgcaggcctccagcaggaagacaagagcccatccctgctgccagtttcagaaacagtttccacagctctaggttaaggttatggtcatgtgtagcagggtaagaggttgcaaagcatggtcctagggaagcagtaggagcccaggtttgaaagcaagaaatatgggtcttctagacctagctctcatggacaggctgttggttttggccttcgcagatcagtacttctgcctgggcctcagtttatgcatctgtaaaaagaaagaattgcattaaatcagtggttcccaaagttaaagtggtccccagaccaatagcatctgcctcatttgagaacttgtttgaaatgcaaattctcaggccttatctcagacctattaaatgagaacctctgaagcaggagaacaataatctattaaaaaccgatgcacccttaagtttgagaaacataattctgcgtgatcttcaaggccctcaattccagccgtaacatcctgtgaatccctgaggcagaggcccaaaactgcagccagctcacttgccccgactctcaccgtaatctctcaggttccagcagtttctttctgtctctccttggatccctgagccaagctacagagccagttggcttcaggaggtgactctaactcccagaacatgtacctcccttaaaaaatctatatccagtcttacacggaatcaatgcttacagtcaccttgtatctaagcaaactgaataaagctggaagcaccagcaaacctgcttatttatttcatgacaagggaaacaactttcagttctgtgggacttgacacctttgtcaataaaatctgcagattgcacaatatagagttgttttagaattcatctttctgacaataacagg

SEQ ID NO: 89488 - DNA, 1025 bp, Homo sapiens
tttgagtttatccatacaagtaaaataacagatttagtgagtgataagcgaagtagtcatcaacatagataaatatagagactgaaagctctatcatttatgtatttcttctgcagcagaatatatgatgcttcctcttattttatttctgttcccagtgggtcatataatttctgctggtttatgaaggctaatcttaaaaccctttttgacttctacatttaaaggcttggaagtgagtatgacatcatgggggacactccaagctttagtgaggagtcatgggtttcagtactagtttgctctgctaaacccagtccctggcctgagggcagccgtgtttctatgctgattttatagatggtgacaccaaggcctagaacaattaagggactttacaaggtcatgggatgcttaacttcagccctgactataactgcaattatggtatgtgggccccctgagaagtcaccgaaaacccctgtctaatatttcctgtggaccctcaacctccagaccaccaggccttgtaggtaacttattcagtggaagccaggccaattgagtaaatcatgattatgaacattgaaaaatgagaggagagagaacatgaacagaagcattttagtttatagaatcatagagttggaggcatttcttcaagcagacagattttgtgcgtatcaaaacgtgattggggaaaaacaggtacacgtagcctccttcagatgcattttctgttatggtcaagttcattccaataataattaatttgagggcttgtgaaatgttaggtgctattctaagtgtttcgtatgcataactttatttttccaccaaccagctctaagaactagggacactcttacccccattatacaaatcagggacatgaggcatggagtgaagaagtagatttccaaggtcatagagcccacatggagtagagccaagatttgccccaagcccaattccagagcccatactcctaaccactgtcccattgcccttcttgtaggagcaga

SEQ ID NO: 89489 - DNA, 1014 bp, Homo sapiens
gggactggttttgtggaagacaatttcttcacagacaggcagggcaggggagtggggtgcggagaagggaggataatttcaggaagaaactgttccacctcagatcatcagacattagattctgattaggaatatgcaagctagatccctcacatgggcagttcacaatagggttcaggctcctatgagaatctaatgctgctgttgatctgacaggaggcggagctcaggcggtaatgctcactcctcctgcacctgccgcttaactcttgctgtccagcccaggtcctaacagcataccagtccatggccttgggtttggggacccctgccatatatgctataactacagaatgatgtacaatgatgaagtgatgttggcattattattatatgtcatcaggatgtggtgtggattaaatgaggtcacacctctaaagcatttttctgtcatgttgcctgacatgtaagaggcactatgagttggttggttatcatgttactaattattatcattgctaatgtaccttgcagtgatttaaagtttacatgcttaatttgcagagaaggcacgaattttaagtttacataattcaaagtttacatgcttaggccggacgcagtggttcacatctgtaatctcagcactttgggaggccaaggcgggcagatcacctgaggtcaggagttcgagaccagcccggccaacatggtgaaaccctatctccactaaaaatacaaaaactagccagtcgtggtggcgtgcgcctataatcccagctactcgggaggctgaagcaggagaatcacttgaacccaggaggcggaggttgcagtgagcggagatcatgccattgcactccagactgggcgacagagactgtcgccttttgaacataaaatgtttaaacactgaatgaggtgtaagagatctgtctacatgtgctttcaggttacaaatgtgggtaggggttctgagatgctaaaattgacaagaaagtcttaaaaaaaaaa

SEQ ID NO: 89490 - DNA, 1056 bp, Homo sapiens
aaagaccccggagatttcacttgccctgcacagaataaaattgtatacacataaacccatgtgtctgtttctagtcaaacatatgtaccgttcagtagacatattggctgtattcacagcttccagcgctgatctcaacgactgccgttcctttttcatatacagctagatctgtagatagcgctctaggccgcaattggaagatgcagtagaaatatgctcacccaccaatgtgtcttctgccctcctgtctgtgctgtggagcagtctgaagttaagcactcaggatgatgttggggaaggttggatacggggaagtaaatccacagggatgttggtttatggtgtacccacctacagtactagaactccataaacaatattattcactgctgttttatgagaaacagttctaaaatagccctaacagaaaacacttgttactctaccattttgacatgtcaggtttgatggcttgatgagcaaaaagacatggacagagctttctagacacccagtggaatcagagctactgatgtcttaagctactaatgttaactttatttatttggatgtagaaccgtctggttcttatgtaacaacagaaaacaatcctgatcatccttctggcctcaactaatgcctcattcttctgtaaagcaggtcctactgtctgagctcacagaattttttttttcttttactcctggtgctctggttaccactatgagactcacgtatgtgtgattccaagttatcggatgataaccttaggggtaatagtctggtctccctagtcaggttattagttatttagaatctgaagtcctcatgtgtcacattccttttcagccctatagtggctgacccaggatgcgaaaaaaaagtttccaggaagttatgattttttgacagttaagcattgaagagcctccagaacccagcataagaatgaccctttgaaagtagaaaaatctcattttaatcactcctgttttgttcttaacattttatatattatgcagtgtgcgtgatgggaaggtgaaaagtctgtgg

SEQ ID NO: 89491 - DNA, 1075 bp, Homo sapiens
ctcaagtaactgggactacaggcgcctgccaccacgcccggctaattttttgtatttttagtagagacggggtttcactgtgttagccaggatggtctcaatctcctgacctcatgatctgcccacctcagcctcccaaagtgctgggattacaggtgtgagccactgcacccggccttttttttttttttttttttttttttgagaccgagtctgactctgttgcccaggctggagtgcaatggcatgatctcagctcactgcaagctccacctctcgggttcaagtgattctcctgcctcagcctcctgagtagctgggactacaggcatgcaccaccatgcccagctaagttttgtatttttagtagagacagggtttcaccattttggccaggatggtttcaatctcttgacctcatgatcctcccaccttggcctcctgaagtgctgggattacaggcgtgagccaccatgcccagccaaaaatctttctcaaccagcgtatttcccccatttactcagcacccctacttcatatatgtctgttcctactagcttgttctttaattgttccttgtaggttcgttcagagtctttgcaactgtatcagtttgagatgtagtaaccaagttccacaagctgggggcttaaataactgaaatgtattgtctcacagttctggaggctggaagtccaagatcaaagtgtctgcagaattggttcctttttaggacattgagagaggctgttccatgcttctctccttgcatttggtggtttgctggcaacctctggcattctttggcttatgtatgcatcgcccctaactctgccttcatttcttatggcattcgccctgtgtacaggcctgtgtcaaaattttctcttcttataagaacaacagtcatatcagattagggcccaccctaaagacctcattttactttgattactctataaagactttctccacataaggtcactttccgaggtaataggggttaaaagaccatacatctttttagggggacacaattcaacccacaatagcaactaaaccttaaggtctcaag

SEQ ID NO: 89492 - DNA, 1054 bp, Homo sapiens
cgaggcagcagaacagctagtgtccccttggctgtggagcaggacatggtgcctcacgtggagctggctttcacagatgaacgaacaggagactggggaggcaattgccaccgtgtgctgtggtggcaacatgacttgtaatgagggctcctcagaagtcgtgttctcacatgggaggatgcaggaagaagtgtgttccctcccagccgccaactgtacccacagggcaccggaaggagtttcactctcagcactgggccctgcagccaacctcacaaaatgctttttggagtttgccaacagggaagcttgggctgcagctgcagcagcaggtgctggctgccaggttccctgtggcaacgcagtgtacgccaggttagcagcttagccttggagaaatggcctccatctcggatgcctgtggcccaaagcatggagcggagctgcgtttccccatggtgggaagataatgactgcgctggtttttatggggcattatataacctcaacgagtggttcagcagtagcagtggctttaagagggtatggaagattgtaacatgcttgttgttttttgttcgagggattttttttcacttttgttgtcatcattcagtctgattcattatcattcatgggtttgctcaggcccttggctaatacttttttatgactccaggagggcattgcttctggccacatgataactcaagtctgcatttgtatgttttgcaggaagattcatatctaggatcttaatttgggcctctctatgaaatagaaagaacaagagagagacagattaggaattgctaacctgttctgtttgatgtgcagactgaggctcagagagtgacctgcattgttgcataccatgcctgttctggagctaggaccccagatcagatcttctgagtctcactgccttattctttccaatctaccatgctgctcatgcctcctgctagccctgtgtttttgtttccagttggcagtggactgtttaatcacgtgtcctttcctctgatcggttgtggtcttgcctttggtacac

SEQ ID NO: 89493 - DNA, 1045 bp, Homo sapiens
agtagatggttaacttttaattcttctcaatttaggaggaagcataggcctgggaaattcctaaaagctgataatccccagttacttttgtaaattacatatgtgcacccacacacacaaatgcttcctatagtgtttttctgtaacttcttaggaacttgacagtgatatgtgtcatgacattttttggattaagcaggtgttaaaatgtgtttacattccttaaataaataactaagcacatacaaaggcatcgcagacatttttccaaaacataatgctgaggcagcacgtatctttgatggttctcattggtgttactatgaaaatgatttctagaatttctcctcttaatttacaactaactgaaaacaatgacagtaatactagcaaatactaattgggcatttaccatgagccagacattgtgcttaatactatgcatttataaataaatactcatgttttattcattccttacgacaactctgtaaagttggacactactaatatttacagatgagaaaattcaggcttaaggggattaagtaatttctcgaggtcatggttgtcatagctggtgcggacttattctggagtctaaaggaaagcaaagttctaattttaaaaggcaaatgataattttataactggatattgataggattacatatgatattcagtaagaagacataattcatgtgatcaagtgaaatcaaacaatttactgatatggatgctgtggggatgccaaagaaatacgcagcacagttctaggattaaagagtctacaatctgttaagggtaaataagatataaacacgtgaaaacataaatcacaaatgatgattctgatttgcttggaacaggactacgttgttagaatcatagactcccagggtacaagaaacttgtactccagggatgtatgttgtgtcactaacatgcaccacctatcagacctgagatgggccccccgataaagatctggtcagtgattaaacaaataaaccagcaagatcgtctagataaatctcctctctgg

SEQ ID NO: 89494 - DNA, 1036 bp, Homo sapiens
tcaactatttccaaatctcatttacataatggatgagatgtgaaatgagcccaatgtgaagggagccgcctggaggcactaaagtttatcacaatatgtaagagttcttttagatcattgcattaaatttccactaacaagataacaaattaattgtctgtattactgtactagcccaaagtctattgagtacagagtatcagccgaggaaggcagctggggtttcaagggctacagatgctcagagatgcttaaagggaggtgatgaatactaccttggctttctcctgcccctttaagaaatcccaggcacctctgtaatctgatggtggactttggctttattagtgaagtaagcgaggatgagtaaatcaactgtatcagacaagcctcaggacatctagaaattgatcattctgccgaaataagcactctgtgtttattagctgggagttcatcactatcgcttctcctcatccaattgctaagagatttcaaagacatcatcatggtattagcttgtctgactgaactactagagataaagattaggagatctatctaatgatgggtctgagtttctctgattttttttttcacttctattgcaaagaggagagcttttctagcacacattctgtatctacatgtgcatgcctgcacacaatcactatgtatttgtattctacaggaggaattcaaacagtgaaataaagtaggtggtttgaagaaaggacacccaataaagcacttaaaacaatgcaactttctcatctcaaaagacatgactacttaacaaggggaatgtatgctgaattgatttctcaagccatatacagtgggtgatcttttgctgagaagactaattatattccataaccttatttacaatcccaacatcaatacatggccaaacttctacagatatgtccataaaaggtgaggacatgttgggctaatctttcgcaagccagtaaatgtgcatttatctgtttagacatatatttatgtgcacgcatgcactaagttcctgata

SEQ ID NO: 89495 - DNA, 1035 bp, Homo sapiens
attatagtataaggtgatgtactacatgcagatcataaaggctttggttttaagacttaagtagaaaatccctctcctagcttattacccaacaatattcagataatgagcttttggagaatatctttttcctatcactagaaagatttacctgggaactgtctaaagtctacacacatatttccaaagcctttaaataccaactgcagcatggagagagaggggtggcagaagctgaaatgcctcaaaagccatttaagtgttacgttgcaggattttcagtccttctcgttatgtaaaagtagataaatatagacgttattctcaacactaccctatagtatcacagtggtccaaatgccagagcttacagataatgtcatcacagtgcctagaaactcgaactgtaatatatcgtagcattttcttggtgtttcttaaagtttctttccacaatacaaggtcctctctgcctcttgtttcttggagagttcaccccactgatgagtcttccttccctgttggactcagtcatttggggaacagtcttagaagcacatatcaaccaaggaagaaacttcctggatatctattgcccacttgcccaggtctaataaacactaaaggggggaaattgaaaggagctgccaactggtcaacgtggaagggcggttccaccctagattggtgtctttctttttcttcctttttttaaaaaaaatctatttcttaaataataataaatgcacatgatgtgttaaatatgtacatatatatttcaaaagaaaaaatggggcacaagattgtcttacaagtcgtgctggctaatttttagtttgtattcataagtggtttttaaaagccttttttaaagtgtaatttgcatgttctactttgattgtatgtaaacatattttagaacaaaaaatgtatttgtattttattgaatatagaggcaagaaaattgtacattgtttgaaatgttctttttgtaacagtttttattcataaagcatttttgtacatttaaaatga

SEQ ID NO: 89496 - DNA, 1026 bp, Homo sapiens
attctctgttccctgcttgttttttaacttcaaactcagatgaagccaatggacctgctgaaacacttgtctgtggaaactgggtcaggtcgggagatctactgaaatttggctttttttccatagccacgtgccttctgttgttgacagttcattcattaccaaagcctgtgtgtaactttgccttgttctgtggccatcttcttgctcatgttatttctcctgggaatgagcagtttgacttctgttcccacgttcctcattctatcagctctagatggattttgcctgcatagctggcttaatatgtctttgtgtatgggtagtctgtagcctgagaatatttacctaaaaatgtctaaacagccaccaagaatgtttataggggtataggaatatagttaacagagtgctaatctctcctcaaatgtccttttggaatgcttcccccaaaattgggaagttggtaggagcttttctttactttgaatttctttacttggacagaacgattctgccttaaagacacgctttgcagctctgataaagaacatccctgtttagtctcttgagttttacaggccacaaaatgtccgtctcagagggatctgtctcagcttttcttatttttgcttctctccgttttcaaaattaatcatcttgttctctgtataagaaaatttgagaagctgtggacaatttaatagtctgatctggcaacagcgatttttgtttggaaatattttgtgttttctttgaggaggatataattactgatatcctaggatgtgaaatttttgagtgacagtatgcacattttaaagaaaattatgattaatctgtataatgttttttggtctgtaaaaattataaaaaataaaatcatttatctttggttgtaactgtttaaaaaccaaattatagggatatcacactatcttgtaaagtgtttcagctgttaaagttgctgtaggtttttatgcctgatgtcatttaatttatttgacattgaacttcattaataat

SEQ ID NO: 89497 - DNA, 1025 bp, Homo sapiens
acataaaagtttttggaaaagtttctggcaagtagttagtgtttggttaatgttgttattcttgtagtaaaaaaggaagagtattctgccacaatttgggaaaacatgggccctggtcaaagtgttaccatagatttgcctttcactaggccccttgggccacgtgggactaagtcttcatgtggcttcctgttctgtcccctctactccctacccaagcattcattgcagtgccatgctcccaggaaatatgcagttaacactccttgcttggattcatttgaatgatttttttttttttttttggtcaggatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccggtaagtgaccagtcggaagtcctgtattcattcagtcaatgcattcctgctgtgcgtaaggcactgtgagatcaggaggatgttcaggacactggcactcctctttccagagaagcaatggtcagagaggtgtttggacaccagggactcagcagtggggaaggattgacactggcagatgctgttgggtggtgggcgagactgacctttaagctggacaatgggatctaatgattaggagatatcagagacctttcagtgagcggcatttctagggattttggcttttaactgggagggcacttcagaatcacctgtagacttgtcaagaaactgtgtctggagaaccttctgctcccagcagtttggtggactagacatactgcctgcctctcctgctgaagataactgggtgctggatgaaatatttttaagaaactggaaattaaatttattagtggagtggcaaaaaggtaagggaacctcagaggccagaacctaagtgaaaggagaaacccataaaggtaggtggagttctgaggctgctgtcaccctgaagagttttgctg

SEQ ID NO: 89498 - DNA, 1069 bp, Homo sapiens
acaccacatttagaaaaatccattcatcttttgaaggacacttaggttgtttccatatcttggctattgtgaataatgctgcagtgaacatgggagtgtggttatcccttctccctatcgatttcctttcttttggatatatacccagaagtgagattactggatcatatggtagtctatttttagttttttgacgaacctccatgcctttttccataatggttgtactaatttacactccccccaacagtgtttaagagtttctttctctccagatcctctctaacacttgttatcgttcatcttttcgataacagctatcctaacagctgtgcactgatacattgttgtggttttagtttgcatttctctaatgatcagtgatgctgagcatttcttcatgcacctattggctatttgtatgccttcttttaaaaaatggaacatttccttttgagggattttggatttctcctgagtgccaaatgaatgaagcactaaatgtgtaaaactgaatacatactgagggcaacaagctgtaggagtgtatttcagttaaaaagccatacgtttagaaattttaaagaaaagctgattatttcccacacagcatctgctcattccagttacccgagtgggtaattaaagtaccattctttattactaatctgccagtagtccccttaaccactctccctacatgaaaatctttgaaattgggtcaatcatgagaaccttagattttagacttttagttcaaatttgctttttttttttttttttaaggtaaaccaaaggtcttcagctctattttcttttcacattctagataagctgttgccaggtgatgcaggagccctttggttgcacctgatgcattattgtgaagcatgtacagcacccaaaatgccagagttcattctgtacgctttccatagcacgtaccggaaactgccatggaaggacctgcaccctgaccagatgctcatggaggccttcttcaaagtaagcccttcattcccggcatcgcagcctagagagatctggcttctagggagcagcctggtca

SEQ ID NO: 89499 - DNA, 1043 bp, Homo sapiens
cagtgatattgacaaatgacaaatgatgacctttgttttgtctctaaaactttttagtgctgaaatccctacattcagtaatcattcagctctttaagccatggatcctggttttagaggacaacgaaaggtaaacagttttttagatattcaaattcctttgacgtttgtagacttaaaattctaaatggtatttggtagaagtgatgagttcacagatttaattttttagtgtaaggccatatttaaatttagaaaaggcttcttttcaaaacttaagacattttctatttatggaattgctagtctggatcatcagagatattatcttgataataattttggaacaaaactggacactcatttccagttttccacaataagaggttgaataaactttagtgtttaatttcagaaaaaatgatgctgttcgcttgagggttttatgagactgatttttctctactacatcagttgtgttttggaactaagttggctataaaattattgggtgggaattacctttaaatctaggactcttcaattaaagcattatttcacaagcatttgaaatacttagaggtatagagctgtccaaattcagtgagttgccttctgagtcttttttttccctgaaagtatacaagcagaagctagttgaacttgtcagggttttataaaaattacgacagtggtaaacatcacattataggagttgttttcaaaaacttgaatttgattctgagactcagagaacatgaatgtcaaactcaagtctcatagctggttggttagtgctgaagctgcgactagaactcaggtcttagacttctgtttctagactctttgcattaacccatgatgctttacgagccacttaaggaaagtataaaaggttctgaatgtttgcttttgctagagggctatctgaataatctgcaagcttcaggattttatagtgactgtgtacatatagactgcttaccatagtgctggctgcttgtttatttccagtaagaattaacggaacctatttggatatt

SEQ ID NO: 89500 - DNA, 1048 bp, Homo sapiens
atatgcatttgcatgagaatttatttgaaataatggttccactgatttagaaaaggtttgaaacccactgatggcctggcgcggtggctcatgcctgtaaccccagcactttgggaggccaaggtgggcggatcacttgaggtcagggattcgagaccagcctgggcaacatggtgaaaccctgtctctactaaagaatacaaaaatgagctgggcatggtggtgcacgcctgtagtcccagctactcaggaggctgaggtaggagaatcgcttgaacccaggaagcggaggttgcgatgagccaagatcgtgccactgcactccagcctaggcgacagagcaagactctacctcaaaacaaaaacaaaaacaaaaaaccattgatttatttctcatatgctttatatttttgccactctcttataaagtcaaagacctactatatacacccccatcacagtgtatcataacactttactaaaatacatatttagtaagcattttttgactagttgtctcttccaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacaggtaatatacttctcatgcgatgtggagctaggtgtttggactttccattaagagagatttaaataggcacattaagagatttatattgagtgtcaaggagagaaagtagaaatatatagaacaggcatgagcccatatatgtgtcatatatgtcacaatatatgaatggatatattcattacatagtgaatgtagggtgcttgctatagcttgtctctgcccctcctttgcaggttggggtacagagaggtttcagtttccaaccctttctgtcatttgtcttactaagatggggttctaaatcttatacatttatcttt

SEQ ID NO: 89501 - DNA, 1053 bp, Homo sapiens
ttcagagaaacaggttcagagacactgtgagacttgccaaagtcacatagctagtgagtagctccatcaggattcaagcctgcatatgtctaaattcaagacccctacttttcccattcaatattgccaggtcgttttgcttcagctgtttcagctgcagcttctgaatacttgcagtgtgattctgagcaagctgatcatgacagttaaatctcatgtaaatgaatataggtaccatttcattttctctctgagtctgtataatagtattgccttcttttttcagtgattagagaatttgtgatcttaacattctagattagatcagtttttaaaaattagctttatgggaaatgacttcagattttaaatataattttgaatgactcctttataaagagttcaaattatatcatgaaaatattttattccttaatagattttttctgggaaagaatgtcctggaaatttccagctatctgcaagcgtctgagctatggatagcttgtttggggtatacaaaggcaaatatattttatgggaagtgagacatgcttctttctgtgttctctcttcccagtagaaggctctaacaattcagtgatgttccctggggaaatggggtgatttataattgggttccttttgatgtactttggtattgtgggtatgcttgctgaccccaggattgatttattatcatgtgaaaaatttgttaattccaagaaatgaacgatggaaaagacccactgagggcctcacattattgtaaaaactggctgaaggacatgctttgtccaacttttaaatttagacaaggaaacttttaaatttctgtgtccacttaaaatgactcaagtggaggggcttccaccatgctactttgttctattgtctactacttcttgtaattatgaactgatagacattccattgctctcaccttcattgcagtaaaaaaagaaaactttcaacagtagtgggaacaataaacaaaaataagtagactagaaaataataataatttggggatgttttttgtgagagggtcta

SEQ ID NO: 89502 - DNA, 1042 bp, Homo sapiens
aaatacatagttttatatgtgaatctatgacttgtctgtcagagttaaagtactgtcgttctgtttcaggatctgtggatggagtatttgaacatggagcgcatctatcatgagtttcaggagactgttggtctgtggacacaggccaagcttgagtcccattccacaccctgcagtttgtccgtgcagctggacttcactgatcctttgctgggtgggtcctgggagcacctgccccttcgaatgagtgaatgaatgattgaatcagagccattgagggttgaggctgacatactttattcccccagtgttcatttttcctctggtgctttaaaaagagatttcagttgacttacacaatggtgtaaattgcaactgtaaatgtaattactttgcagttttgaaaatcagaagtctgtctttttcttttataaactcttttcctttgtacctagaacccttaccatacaaatgaatcagattcctgaagtttctaagttacttgtttctcccagtacatttttctagagaaacagtggtataaattaccagttagttttctatcaggccacaaaagcccatttaacctataaagttgctgatatttggggtaacctattaattttaattactgactatatttcaaaaatataggacatatcattgtaaattcaattgttgaccaaaatatttattacaatatatagtgtaagaagacactgaggtgattcagagaaatgcagaataccttcttattccagcttgccactaaccaaaacgcgttagttgtatgaagagagacaaataagaacttctctggacttcacgccattcatctgtaaaatggtgctggctggtttcttctaaggctctaaaatttttccctccaacatttcctctccctgcactttttcttgaaacaataattttttttctgattataaaagatatatattaattttaaatattaaatgatatagaaaggtatatagagaaagggatgaaaattgccctcaagccaacaacgtagattctcattttt

SEQ ID NO: 89503 - DNA, 1051 bp, Homo sapiens
acatcccgggcttttcctctttttgtctctgcctagcggattctcttaccagcatgcctttccctctgacatctacatagaaccttctctgatatagcactttaccttgactcagtcctcgtcactgctcaacttcacattttgcttacttatatattagtcttgtctactccagtagatggaagacttcttaaagacagagcccctgtctggtcctctttcctgtctctcttgcacacagatcttgcctggtaaatatggagttaatgaacatcttgtactaaagtagcctttccaaaggaatgtaacattttccaatgatctattttatttaaatttatatctgcgacaaggatataggtaggtataaaaaggtgttaattttagaaactgcaaatatttgctgattgagcttgagataggaagagatttaaattgtggaatatcaggatgtatttcgtcagtggggcgagctcctccttcccctcccctttatctggtgtcattataggtctggtttgcctggacagtgctcaacatggaatccatctttgaagaggactcccagctccggagagttattgaaggggaattggtgataaactctgctttcacccctgaccaagctctgaaggtacaaatagcagttctgcatttgagtggtagaaggtggcttacactttgatgctgatggattcacccgtagcttttgagcttttgtgttttattttgttgtgaatgtttggaaagctcaacaaccaaaccaatacttaaaactgtgtaattgaagagtacttgcttctcaaggtttgtttaacaagagtctcagcctagtatttgaaggctggatcattgcacatgtgacgggtgttgtcattgcatcccacgtacatcagaattccctggagaacttgttaaaaagcagattcctagacctcatcttctgggatttggagtctctgagtctcgagtgggacaaggaggttattttttgaaactcctagctgattcttaggcttactaatatgtgggaaagactggaataaggctt

SEQ ID NO: 89504 - DNA, 1179 bp, Homo sapiens
ggtgtttttcctctaatgctgtttaacttgcatgtgtttgtgtgtcgtggatctgttcttaatacctctgtgggtagatagaattccttttaacccatgttaaatgtgaaaactttattcttctagaatcccttcttaaatagtgctttggtcgaaaaatgggaccaatttaggaattttctgtttcctcataagtaattagggaaaattctgttgagttctgatcggaaggtaaagtgcgtcctcctgtgtgcttggcaggtttttatcgcatctcctcttgttcctacacttggacagcggtgtccctcagggtgtcacacaacaggtcacccacaaggtggcacagcacctgacaggagccagccatggggacaacgtgaagcttctcaacagcatgatccaggtgagggccttgcaagcccctaagcacactcccgcctgtcttcccaaccaagacctctagcgttagcacacttaggttttagtcatttcagatcacttggcttagtgtgcttttggccaagaaaggcaatagatttgggatttgtagtggaggtagatagcattttgttgctatttaaaaaatgagaggctggttgttatctttcccatcacatgagccttttctccacaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataaggtaattaacctgttagagaatttatctttcagtgattggctagataaagtagctttctaaaaagattcccccaagtacagttttcagttctactctgtggccattaccttctttaagctttgccttaatggtaccttatcccgataatcgtagtccactagcgtagaccctagggaagttggaaaggacagcccaggaagagtcccgcttgttacatttggctgtaatgctctgccttggactattgctgctggtggactcatccttgaaatctctgtcttatcagaatcttgtattgtagtaagacagttgctgatactcttgtaaaggtcattgataagatt

SEQ ID NO: 89505 - DNA, 1018 bp, Homo sapiens
tttttattttttttgtttgagacagagtcttgccctgtcacccaggctggagtgcggtggcactatcttggctcactgcaacctcctcctcccaggttcaagcaattctcctgcatcagcctcctaagtagctaggattacaggtgcatgccaccacacctgactaatttttgtattttttagtagagacagggttttgccatgttggccaggctggtctcgaactcctgacctcaagtgatccaccttgcctcggcttcccaaagtgctggaattacaggcatgagccaccgtgcctggctgtatctgttgttttgtctctggctagttactttagtttctcctaattgcctcttctgcctctcattcctttttctcctgtaatttgtcttgcatgtcattgtcagggttgttttctgaaacactatgcattggttaagagtctgagctctaagccagcctccctgggttctgatcccagttctgccaccttctggctgtgtgactctgagcaagtttcctaaactctttgggccttagttgcttatttgtaaacattcatattaacgagtatacctcaatgtctcacagggttgttttttgttttgttttgagatggagtctcaatatgctgcccaggctggccttgaactcctgggcttaagagagccttctgccgagtagctgggattacaggcgcgtgccactgcgcatagagttgttgtaaaggttaaacaaatgaggaaacacaagatgtttaggatgattcttgccacacattacgtactcagtggtgtggttattattaagggtttgctatgtagcatatatcttcagagatacatttcaagtgattttcactgttaaaagaccttctctgcctctttaccataggccttatttgttagctcttccataagaagattaacatttaaaagggaaaatggtggcaaactcagccctttacacctgtctgacaggttttgttctgagcaagtcatttagtcctggacagcat

SEQ ID NO: 89506 - DNA, 1054 bp, Homo sapiens
tggctcctgtttagcactccctaaatattcagtgaattcaagaacttgaggagtagatgagaaagttgggagtgccattacctcagaaaaggctgtagggaggaaggcactctgaattatccacatcattggtttcttgttactagctatatactagaatcacctgggcaacttgcaaaccttgcccaggcccacacccagacatccaaatagttaaaagcctccctgggggttaaatgtacctttgagttgagaatagctaagttgagaactactgccttaagtagagtttctgaaatgcttgttagccattttagatacataataagagtgtaaaaattgagtggcttaaggaaattatgaatgattttgccttagtcccttgttgaaattgaggtgatatattcttcaggttctcaggatctttttacttccttccctttttaatggtagcgtcctttttaatggtcatgtcctaagggacatgaatcaacttggtttctaaggtgactttagtgctctgtgtcaaacgaaaagaccgcaaagatttcccctatgtaatctttgtgtatgaccactgttatttttatactgcttttggcagcagtaattgacaacagaactttagtcacctatagcaaatgtcaattgcttcgtcttaagtctgttgcatactacatagatcttgattttgggagaagagaattgcagctaacataactttgaactctcatctatggttcttgttttttttgagatggagtctcgttctgtcacccagcctggagtgcaatggtgtgatctcggctcactgcaacctccgactcccaggttcaaataattctcatgccttggcctcctaagttgttgggattacaggtgcatgccaccacatctggctaatttttgtatttttagtagagatggggtttcaccatgttgcccaggctgctcttggactcctgacctcaggtgatctgcccgcctcggccttccaaagtgctgggattataggcatgagccaccgcgcccggcccatctgtggttctttaat

SEQ ID NO: 89507 - DNA, 1056 bp, Homo sapiens
aaactatggcccctgagagttaaatccatttttatagggcctgtgagttaagaatagtctttacatttttaaatggctggaaaaaagtcaagacaatactgttttgtgacatgtgagaattatttgaatttcaaatttcagtgttcctctatcaagttttatgggcacacaagcaccctcactcactgaggttttgtctatggctgctttgccactagagttgagtagagttgcaagagagacgggaggtggccagcaaagtctaaatcatttactacttggccctttactcaaaaagttcgctgccgttcatgtaaaggatcctgcggaaagagaaacttctgtttgacatagtcagcttgcagtctaagcttttgaattttcactccagttttagtaaagatggggagtgcctgggaaggattgcatgatcattatcagtatttaagcgtgtcaggcactgttcaaaacagttagtgtgaattacctgatttaatccccacaatgaggtgggagctgtttatacttcctattttacttatgaggatgcggatgttcaaggcactcaggaagtctttcctacccagctaagattttaatcctgccagtccgggttgtggggataaggctctgtgctcctaatcactatgcatgctgcctcttgccatagtacgacgtctgcaacttagatttccgtaggtcagtgctacagatcatttgctttaggtgagctttcttgaccctccagtgcagaaaccagatctgattagagtacaataggcttgtagcaagaagtaaaaagattataaaaataacaagaacttatctaaaatactttggttttcatttcttacaggagaggacccctcccaattcctaaaagctcaccaggtatgccactaaaaaaggtcttttgaaattcttatattgcaaggcaggcagatcacttgaggtcaggagtttgagaccagcctggtcaacatggtgaaaccctgtctccactaaaaatacaaaaattagctgggtgtggtggtgcgtgcctgtaatcccagctac

SEQ ID NO: 89508 - DNA, 1087 bp, Homo sapiens
agaatcatgctgtcttgaagactttattggagaaggtgtcccattcctttctcttggtttttggtgtcatcagcaatccttggcatgtcctggcttgcagctgtgtaactcccatctcttcctctatcatcctgtggtgttgttcccctgtgtcttcacattgtcttttttttttttttttttcgagatggagtctcactctgtcccccaggctggagttcagtggcatgatctcagctcactgcaacctccacctcccaggttcaagcgattctcctgcctcagcctcctaagtacctgggactacagacgtgcaccactacacccagctaatttttgtacttttagtagagaccgggtttcaccatgttgaccaggctggtcttgaactcctcacctcagctgatccacctgccttggcctcccaaagtgctgggattataggtgtgagctaccatgcccagcccacattgtcttcttataaggacactagtcatgttggattaagaggccaccctactccagtatgaccttatctcaacaattacgtctgcaatgaccctatttccaaataaggtcacagtctaagatgctgggggttgagactgcaacctattttgcgggaggaacacctgtgcccaaaagaatgtactggaagctgagagcatcatgggaaatagagtatcgggatgggagtttagacacctgggtggccttctaatcctggcttcctcactggccagtgctgatattattcaaggccctagacctttctaggttccagtttcgttagccataaaatttggattgtatgagatgttctgtgagagccccttggatctaataacatgggtcttcccaaggaacttatcattcagttgaggtgctgtgaatggcatatacagtaaaattgagcaaaatatttaagtgttaggttttatggcaaaaggatttcatcttttcagttcactctgattttggggcaacctggagcactagattgaggatcatcctgaggctgctttcagacctgatggaaaaggccatatctgatgatgtttgtcatgggttgtttttcttttctttc

SEQ ID NO: 89509 - DNA, 1870 bp, Homo sapiens
ttttggtcaacaagagactgcatatatgatggtggtcccataaaataataatggagttgctttatacagatgtaccatttaaaaacatcctctgtacaagtatttttactataccatttctgtttgatatgtttagatacataatactcaccagtgtgagtattgcctacaatattcaacacagtgacatgccgtacaggtttgtagcctaggagcaataggccataccatatagcctcactgtgtagtaggctacaccatctaggtttgtgtaactacactctgtgatgttcaaataatgacagaatcacctaatgatgcatttcttacaacgtatccccattgttgagtgacatatgattgtagttggagtcatacagtgtgtagccttttcagactggcttcttttacttagcgctatgcatttaagatcccctcatgtcttcttgtggcttgatagctcatttcttcttatcattgattaatgttccattgtatggatgtagcagtttatccactcacctattgaaggatcttggtcgcttccaatttttggcaattatgactacagcttctataaacatttgtgtgcaagtttgtgtgggtataagttttcaactcaatttagttgaggtttagtttcaatgaatcagacttaatggtctggctgaattgaatgtcattttcacatgtgtttcacatcaagatgtttgcatactctgctgtgctgaaaactcatgtaagatgttcattagatcaagctgggtaaaaaatcagcaagttagaggaggagaaaaggcattggacttcgatgaacatgtactgaaagaaacacttcctgtaagtcgcttctaaaatcctaacatttaagacttgcttaattctgaaatttgaatatataaaacatcctcactcccataagttatggacctgaagtaaactgaacttgggctggcctcagtgaaatggcagtagtgaagttagaaataagcttaatctaaaacttaatttaaatgaaaactttggaaaaaaacctcaaggacaacacaaaatgtcagttttataaatagcaagtagaaacaagagtcacatatttcaaggattggagaaggctgacccactgagacatggaaggtgaaaagttcttggaataaacaatggacactggtgttacttatcggaggcaaagttaatcagtctgatgtgtaaacttggagattacttttttgtatttatgtatttttgttcatatgaagagtctaaagattttggtcaacttgcaatctatgcttgtttgttttttcatttgtaaaaagatggaaattaatgatatgattgatctccaagatgtactctacctctgatatcctagcactctaaaactagagcactgtaggaaagtaaatagactctttgattacttagaacatttaggagatgggataatcttagtaattgtaccttctgattcatcgataatgaacactgattcatttctggttcaaaaagtattagaaactgtaaatctacttttgtctgggaaaatccaagtgtgaagaacagaagggaatttgttttggaggattctttcaattatgctttgggatttgaagatggataagatgggagaaactgaatgggaatgaatgcactgaggtcaggttttaccttagaaaaagtttttttttttaaattaacattaaacattttctattaacttgcaatttcttgggataaagaggtaagccaaggttccccagttagcagctgtgaaatgcatcccagcctttacagggttgtggttaggtcttcaaagttatatggtgtcataagccttcaatatttgttgtactttgcttatctggctcaa

SEQ ID NO: 89510 - DNA, 1545 bp, Homo sapiens
aggccaggagttcgagaccaccctgggcaacatagtgagactctgtctgtctctacaaaaaaatcttaaaaattagctgggcatggtggtgcatgcctgtagatatagttacttgggaggctgaggcaagaggattgcttgaggccaggagtttgaggttgcagtgagctatgatcacatcactgcactccagcctggacgacagagtgatttgtgtttgtctcaaaaacgaacaaacaaacaaacccaaccaaacaacacaatcctcagtatttagccacagttttagcactggcaaggctaaggccaggcgggcgctaagcccctccccaccagcctccacccctcagccccatgccagggatgctggatacggggaggtcttagcggagagggtgacagggtgaagacagggttccaggccacagagtttgcagtattttaatatcttcacagccagtacaaacatgtcagtgagtactctctaatgtctggtgggtgacatgcagggtttgaggggctggtggagatggccccgccccttgggaagatgtccagttttgagagcttaccgaacagcatgaagcctctgaggtgggctgcccgggcttgaatccagttctgccccttactagctaggtgaccctgggcagcctgcttccgcccccaagcctcagtttttccatacataaaaatggggataataacagtgtctactccttaggaccgttgggaggattaaacttgagagtttagtacagtgcctgacacacagagagcacctatagttgccagctattattatcagcagtagaggtgacaagtaaaagaagtgagtgatggttattcaaggagaaagaatgaagagatcggaagtccacaaagaagcactcttagtgcatgcctctattgatggaggaggagaaaggggacagagaaatagaggaagagatgaagggatacaaccaggaaagagctatcacaggcccaagagagggacattccaaggaaggtgagaggactgtggtcaaacgtgtttgtacatgttcctgaaaaagtatgagtcaatacacacttcataaatgaatgtatttaaatgcttcatgaaaatatttatttaaagaaatcttcgatgaatctgcttcaaaagggaataatcagtgtttaaaactgggcttggagctggcgtgtgcctgtagtcccagctactaaggaggctgggcaacatagtgagaccctgtctctaaaaatcattttaaaataaatgaataaaactgggattggcccccaatgaatttgcctgctattggtacatacctgtgtgttgtttctctcccacccttccctgtttataccttctttgtggcactttggttaagcagtgctgtataatttctcttggttaactttgattgtatcttgtcagaataagacagtgaccacagtttccaaagatccagggaaacagccaggccacaatgagaaaaaattccagtttttgggatgatcagacaccagtgtccttcagatacgggcatgcacggg

SEQ ID NO: 89511 - DNA, 1080 bp, Homo sapiens
aagaaataactgttttctgtcaggggtgggaggaaggattattaagtggagttctaggtcattgatattgtgaagaatagataatttacagggacatgttaggaattggagaaaaagtaagttttcctgaccttggtaacatggcattcatttctttgagcaactcacttggcattcttcttgtatcttttcagctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcaggtatgaatgcaattgttggcatctttttttaaagttatgtttaagatatgaagttaaaattattttcaaatctgtagttaggctagtcattaaaactttttccaggtcagaacttacgacctgcttttatttccaaatagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagttgttttctgtcatttgtgttattctttaaaaccaagatcaaattgagaaattggtaagcaaatgcttcttgatctattttacttgaatattggtacagtcaactgggctagataattcaaggctgagctctttgtaagttttttttttgtttttttttttgagactgattctcactctgtcactgaggctggagtgcagtggcaccctgtcggcccactgcaacctccgtctccgggttcaagcaattctcttgcctcagcctcccacgtagctgggattacaggtgcccaccaccacgcctggctagttttttagtatttttagtagagacggggtttcaccatgttggccaggccggtcacgaactcctgacct

SEQ ID NO: 89512 - DNA, 3056 bp, Homo sapiens
caggtctttcccttcccacgaggccatatctcaggctgtctcagtggggagaaaccttgcacaatacccaggctttattgggcagagggccctgcagccttccacagtgcattgtgtccctgggtactcgagactggagaatggcgatgacttttacgaagtatactgcctgcaaacacatttttaccaaagcacatcctgcacagccctaaatccgttaaaccttaagtcaacacagcacatgtttctgcgagcacagggttggggctatggttacagactaacagcatctcaaggcagaagaatttttcttagtacagaacaaaatggagtttcttatgtcttcttctttctgcatagacacagtaacagtctgatctctctttctttcccccacagggaagtccttttaagtttaggaagatttatatttactttctctttttaaaggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcaggtattaaaagaaatttagtcccattgctattatcttaagtcccattgctgctgattgtagaatagcttctacttaatgaaggcatattttaattacttcctaatgggctgaactttttaatacaaatcagtaggtaagacaatgtaaaacagtagtacatttaaaggttttgttggtttctttaaagtggaagctgtttgattctgattaactctttttttgttgtttgagacggagtttcactcttgttgcccaggctggagtgcgatggcacgatctcagctcactgcaacctctgcctcctgggttcaagcgattctcctgtctcagcctcccgagtagctgggattacaggtgcatgccaccacgtccggctaatttttgtatttttagtagagacggagtttcctcatattggtcaggctggtctcgaactcctgacctcaggtgatcacccgcctagggcctcccaaagtgctgggattacaggcatgagccactgcgcctggcctgattaactcttaatggtaaatatttttagcacttaggtaatttttatagtagcctccaatttaaaaccacaatattgataaaattgtaaaatatattttctcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggtcaaaggaaataaatttttagaatccatttatttgtactgaagtaaaagttcacatatgcaacttctatttaataggttaacttcacaaacctattctgtaccataggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacaggtattattttaatgattaaaagaaatgttaaaaaagatttggataattctaaggcattggttgagactaatggtatattgactgatttgctaaatgcattttactttttattatggaaaatttcaaatacatagaaaagttaggagaatggcatagtgaaaccccatgtatctgtcacccagttattgcatagagtagcatgtttcgttctagtttcatttttaaccactactgttctcccttctagataattttgaatcaaatagaaattatatcacttcatttgtatgtatttcagtataaatatgttgcctattatgtttttttctcatctcatgcacatctcctaattgcagcaataaaatatacaggtcaggtcgtgaaagatttggggtactgatgctttgcattgttaggttttgagtttcagctttttggcataatgacttaaatttgaagatagttgatttcttactttaagcttgctagcgtgcgtatttccttacattatagatcttcttggaaacagaattgttctacaaaggtatccgccctgcaattaacgttggtctgtctgtatctcgtgtcggatccgctgcccaaaccagggctatgaagcaggtaattttgcatcactttggcagtaagggggctatcattagattagcatcttaaggtattaatatattaactatatttgtatagtgctctgtgtcactgagttacagtacagtaatttctgtattgcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattgtaagttgttcttttcttcatttggtcaggttcctattgtgtatcagggtcttcccaggcctacagagctgcatcacatatcacggcctgtactacgtgttgttatctgttatctttcatcaaaggcacttttacttaaactacatttgttttttgatttttgatttttttttttttttgagacgaagtttcattcttacggcctaggctgaagtgcaatggcgcaaccttggctcattgcaacctccacctcctggattcacgcgattctcctgcctcagcctccttagtagctcggattacaggtgtgagccaccacgcccgactaatttttgtatttttagtagagacagggtttcaccatgttggccaggctggtctcgaactcctgacctcaggtaatccaccctgcctcagcctcccaaagtgctgggattacaggtgtgagcccccatgcccgg

SEQ ID NO: 89513 - DNA, 1107 bp, Homo sapiens
taatttttgaaactgtttatggagcttctcacacataaataagatgataatcaaatttgtcttaagatttccatttggccttcatcactttatttcatactgatcacccagcccaagaatcattgccaaagaaaatacagtggaaaaaagcttattaacctgtccaatttctttgcttctgtaatagttatttgaggatatgatagtgagcatattaggcttatcaatgtgctgtcctaagattattcaaaatagcaattttaaaagtcttaatcagagagggttgtttgttagttggaaaagtactcaagaataaaccaggtgaaaaggacaatactgcttccccccccaccccccgactattttcttatgtagtattggtgtatggggaggagtgcccattcagcttcattgatgttcaattgtgtcttttgtgcagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaaggtaggtttaatgttcgttagatatagttgcagcttctaacaaacatcaaaactgattatgcttagggtttttctttttattttttaacagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggtaaagactcaaaagcatattaaaagttctaactaaaatttgctcaatggaaggattatattttagtcttggaatggtaaatggtaatggggacattagaatctaatacgaggattaatagtaaaatttcagctgggaagtgaagggggccagcccctccacacctgtgggtatttctcatcaggtgggacgagctagctcagtcggtagagcatgggactcttaatcccagggtcg

SEQ ID NO: 89514 - DNA, 1164 bp, Homo sapiens
cactgtggctagcgtgagccactgtgctgggtctgtagaatatatttggattattatgatcacaaaactagttttttgttgttgagaaatgggctttgaaaagatccgaggaccagatttttattattattattattattattattattattattattattattattattttgagatggagtttttgcccttgttacccaggcttgagtgcaatggtgtgatttcagctcaccgcaacctccgcctcctgggttcaagcgattcttctgcctcagcctccgcctcccgagtagctgggattacaggcatgtgccaccatgcccagctaattttgtatttttagtagagacagggttctccatgttggtcaggctggtctcaaactcctgcccttaggtgatctgcctgcctcagcctccaaaagtgctgggattacagctgtgagccactgtgcctggcccagattatttttttaattgaattgaattgtcttccatagggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaaggtaaattataaaataagattttggtgttttaggatctaagtcttctcagttattcatttagcgattcaaagattgtatcagatttttaaaaaactttgtcttaatttgcctcagatttttttcttgttattatcatagattgtaaagagaataaacttaagggtttgaattagccaagtttttttactctagggactgatttatacataacttgtagccactggctccaaaatataaaattgaataaactttcaccccaaatccaagaagtttaagtctgttctgtcttgctgttaagattattttatacaaaagcaaagcatttgataacttcaacaaaatttttctggtggaaattggaagtccgtgactttgtatttctagtgagtagacatattgttcaaaggcgagttttggtgtagctatcagaagctctctaatgtaagtctactttgtattgggttgagcctcatctgtcagggtatgagaaataag

SEQ ID NO: 89515 - DNA, 1252 bp, Homo sapiens
tttgggaggccaaggcgggtggatcacttgaggtcaggagttcgagaccagcctggccagcatggtgaaaccccgtctctactaaaaatataaaaaattaacctggtggaggtggcgcacccctgtagtcccagctactcgggaggctgagaatcgcttgagactaggaggtggaggatgcagtgagccgtctcaaaaaaacaataataataaagtacagactgcattttaaaaatatgcgagtgtttactgtgtactaggagctgtataaaaggttttcacatatatcaaaagctactttcccatttgacattttaaacaaaatgctttatatgtaattagcattttcaccagtactttgatcacactaagctggcatttgtttaagcttgtaagttttataaaggctttgttaaaaatcaaatttttaagaatacttttgcactaggtctccagaaatgctttgggttcatctttcattgctgcaaggaacttccatgcctctaacactcatcttcaaaagactggtaagttattatttctcagtctacgccgcacttactagatgaagatataaattacatacatcgtataactgtggtgagttgtttttcatttgttagttttttctctagtttgtatagactctcaggttcttaaaccatattgttaccatttagccctgtcatggttctcttgttatagtcaaatgaactactgttacatatttttcttttgatattagtatggcttctttgttctggtaatggcccttgggtagaaacagaaagaacatacactaggtaatggaatctttgtgacctctggaagacttcctttttccttttctaaaaggcattagaaaaaatgtaagttcttattgataggttttcttattcgttttctttttttttgagacagaatcttgctctgtcgccaggctggagtgcagtggcaagatctcggctcactgcaacctctgtctcctgagttcaagcaattctactgcctcagtctcctgactagctgggattacaggcatgcaccaccatgcccggctaattttttgtattttagtagagacaaggtttcaccatgttggccaggatggtctcgatctcctgaccttgtgatatgcctgcctcggcctcccaaagtgctgggattaaaggcgtgagccactgcaccggtccactgataggttttattttttcaaaggcagtagctactagatatttggcaatctgtgaac

SEQ ID NO: 89516 - DNA, 1722 bp, Homo sapiens
acgggctccgtgggaggctccctgctggtggccagtcccggggtttagctgttcactgttgctactcgtgctaaaccacggtctaacactaccgacactattaatcgccctggtcctcaagacagccgcgaccccagacgggtgaggccctcatcctctagcaccagatggggcctgggaactgctgcttagcagattcagctacccacgtggtcacccggggcaaccacaaggtcgactcaaaagaccaaaataaatgtataacgaatgccaggaccaaagccggaatatatctaatcattcattttgaggtttaaacttaaaaatgttacataaaaaaataagtaacctgccaaaaaatgcagagtggcggcgggggcggggggagaggtggtgaacgcgaggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtgagcaccgaaggccggcatgatgcaggcggccgggtggggctgcagggtggtggtgcgccggctcgggcgctctctgcaggagggcgaggggctgtggcgaatgccgccatcttgcacccgtggcttctccggctggacagagcaggcgacacaggtgcccttttgctcgtcacctgcgcagaggcagaatggtacagggcagacagttaactcgatggtgtccagagacagggcctcaagattcctgtcttcggctgacagcggccctagaagggggatcttgggtgaaggtcagggcttgggcgctagctctccgaggcctgttctgaatcggtgaggttcctctctttcgattcttagggtcgcgtcccgctgaaggtcagaaaactgctgtcagctcttgttgaagctagtcagtggagtctgacattgtgtgaaggtcagcaggcccagcatttcacctctgcctggagctcagtttagaggaaaggaataaatgaaggtggtttttggaatacttacgtaggctttctcttagtgctgaatacgaaacgaccgtgaaaacgtcctgcaggtgcaaagaaccatttcatgtggccagcactgtgacaacagtgaagctggtttctaaattgtctctccggcagagtgtgtgctttgtggcacttggacgtgtttaaagaatttgtccttgagttttccacctggttttgagtaatttttagtgatggagaattcaagtaaaagagaacaaggttggaaaatggctgtaaggattaatacccttcgttatttgtttcccttgaaattaacatgatttcagtgtaaacgcattgacactgacactttttttttgttctaaaagtaatctcaatttgaaaggtgaaataaacatgttggctgttttgctgccttaacaaccgctggtagcatcttgggtttctgttaacaaaaaagcatttttaacggttttcatctagctcctatggaaggtagaggcttcagaattgacagtgaccagtcgcagtattacaacttgaaggagaaactgaaggaagttccaggtggctgcaggatttgttgagagagtaaaataagtccacatgccacaactcttggtttctaatctaactc

SEQ ID NO: 89517 - DNA, 1101 bp, Homo sapiens
gccgacagcgggtctcctgtgcgcgccacgtctacttttctctcccctattccacacatccgtcttttagtgccgccgtcactatctgcaagccccccgtgcttagactctcctgaaggcctttcccttcctgcccgggcctccccttgtttggatctggcccgggagaggcgttgagcagcccgtgtccacagactctggagtgggacttatgaagccaaacccgccttccggttcgctgctcagcccggcggcttccacatctgaactgcttccgcgccctgcatcccaacactgggagcctcccggcgcggcggggcttctggtgatcgagggacaattgcttttttcagaccatgcacggtctaataatgcgttcgcattattatggtctattaagctttaaggtttttcaagcgaggcaaattgttagcctgtaccgcttttgcagatttggaaaagaacggattgttctctggtaattttcagtattgtacgtttctttgtgtacttgctcactttttatttcctgatatctagtatctccctaaagacaagtgaggttgtgaagtaggactccaaaatagtcacagaaagcatttagtttgcttttgatcacttctttgtcatattctcatcgagccattacagtaaacaaggcttataatatttgtctttcttttaatggttaggttgctgcgtggttaaaaaaaatatttggagatcatcctattccacagtatgaggtgaacccacggaccacagagattttacatcacctttcagaacgcaacagggtccgggacagggatgtctacctggtaatagaggacttgaagcagaaagcaagtgaatacgagtcagaaggtgagattaagtccagagttttgaacgagaataaatagaggtaaccaaattttataacactaaagtatacaggattaatttactgtagactacttgttttgctcctttatttttcccagattttcttccactctgttatagtagtaactttattgttttatgtttatatatatgtatatgtatgtgtgtgtgtgtgtgtgtgtgtgtgtgtgtgtgtgtgtgtgtatatatttt

SEQ ID NO: 89518 - DNA, 1045 bp, Homo sapiens
tgccctcccctcccccagccccttcctcaggtttcaattaactagctgcccatagattgcagcaaatttattctccctgaaatagaagtgacccataacaaggcttaatgagatcatcccccaaggaatttaataagggacaatccctttagccagtcagatgagcgtgtcagctgtgtgtgagggagtattgggggagggaaggcagacagtgggtgccccacctctggggtgtgttggtggtccgggcccctggggcaggcggcagcgggtgtgggaagcagagagacctggcagaccggctgggtgggacagcacagaagcacaagctcacctacttcagaagtgtgccaagagctagcaggaaacctgatgccctccctgactcagcttcccaggagctccccagggcagtcctagaggtcacaagcccaagagttttaggtatcatgggaggaagattgcagagtggaccctttgccccccagtaaattaacagaggtggggatggatgcccagcatggttgcacgtcccttacagagcaggggaaagaggacatttgtttttcctgctcttgaaagctgatcgcctctgcagccaggcgtggtgccagttgtggtcagcgtctagcctgctggcagatgggtcatcaaggactcagggtgagtcctcagctgtctgcattttgcagcagccacctcaacgacacacctccttggcacccacagccccccacatgagagcactagcctgctcacccattagagaacgattcttccttctcacaacggtgcagcactcagcatctgcccatacagagtctccaaaagctagagcctgagaggctcctaggtgtgacccggttcaaccatttccctaatttacagatgcacaactgggacccagggaggttaagagacttccctaatgtactggctttctgtgttgcccacaaatcatctaaaaatgattgtcatatagcagattaaaatagcacatacttagcgtcatttctatgggtcaggaacctgagctcagcttagc

SEQ ID NO: 89519 - DNA, 1108 bp, Homo sapiens
caactgaggagaagacaaagcaaccataaacagtccttgtttcagggagagacgtgagcagggcagaggcagcccttcagcagccggggcctctgccgaactcctagaactggctagggtgagaataagccctgaaatgtacagagttcttgctgctacaagactctggcaggcccactggcaggaatgagtggccctggcagtaactgtacattcccacccccttgtagcctggggcaatctcttttgggcctcccatgatgataagctgtctcctgagcattcctgactcttccagttcaacaataccaatttagagtttctagctgagaacacacctctcccaaagggcaggctgaaggaacaggattataaaagggtcatgacctgctagaatggaaacaagtttcctacagttcttgtggcagtggccccccaagttagggttaaggttgctccccgccatcaatatagcccccaggattggatggatttgaggagatggattctaggagcttctgaaattaagtggaaatctttggaaaagtaagaaaagggttccaggggaaccttttcagtaccctttgtaaaggcctggaacattccatacttgtattctatctacactttagacccagtcttatcccacaatagtgtgggactctttccacactatgagtccattgtgggctcatttccacaatgatcttttccctttgtgaattaatatagctctaataatatcaatgcacagatttagctttagctctcaatggtcctcttttttaaaatttaatttttttatgtttatgttttagagaagatgtcttgctctgtcatccagaactagagtgcagtggagcaatcatagctcactgcagcctcgaactcctggtctcaagtgatcctcctgcctcagcctccagagtagctaataggtatggaccactgcacccagctcaattgtcttcttattgttcttttcctttaagttattcttgtctttttgtattataaattctagagttaaattagcagggcatggtggtgcatgtctatagtcccagctcctcaggaggctgaggcaggagaatcacttgtacccagg

SEQ ID NO: 89520 - DNA, 1053 bp, Homo sapiens
ttataatttgaggattctataaaacctggcttgggggccaggtacggtggctgacacctgtaatcccagcactttgggaggccgaggcgggtgggtcatctgaggtcaggagtttgagaccagcctgaccaatatggtgaaatcccgtctttactaaaattacaaaagttagtcgggcatgatggtgtgtgcctgtagtcccagctactagggaggctgagacaggagaattccttgagcctgggaggcagaggttgcagtgaggaaaaaacaaaacaaaaaacctggcttgggaagtcgagactgtggttagctgtgatcgccactgcactccagcctgggcaacagagtgagaccatcttaaacaaaaacaaaacaaaacaaaacaaaacaaaaaatgtgactcaacaaaaagatctccctctcccgagctgagctgccttactctttgaaattcctaccctgtatgccactccttgactgcctctagagaagtgtttgttttagacagacagagtattttgtcacctgggaagggcagtatattagccagctaccactctagtaagaattagtttctgtaattaatcgttgttaagacatggagtatggaagccttagagattgagtcctaggccaggaaggtttggttattggaagtgaggaggggcaaagagggctaaggtcctggggccttgaatgatgagagaaggcactggctgggtttaagaggtcatgagcatagcagggaaggacacaccaaagacaaactttgggttcatatatttgcttaggtaaggcttcctgtagtgaaggcaactcattcaggaaactgctgtttgtttcttttttctttttttgaaacagggtcttactgtgttacctaggcttagcacaatggtgagatcatggctcactgcagccccaacattccaggcccaagtgatcctcacacctcagtctccagaatagttgggactacaggcacacaccatcatgcccagctaattttttttgtagagatgacagtgtctccctatgttgcccagactg

SEQ ID NO: 89521 - DNA, 1056 bp, Homo sapiens
agtgaagtgggggaactaaggggcctggtctgaagggggagactgatatttaggggagtgcggacccagtggtgtgagattttcagaatctcctcttgacgggtctcatccgaggttccagcacagctctgtaaaggtaaagaccgtttacattttcctcctcaaagctttattattattatttttcttctcaaaacactgctttgctttgggggagcgcgggtccttggccagatcttgagtcttgagatatgtcttcagcatctcctgctcctccttgggaaacgctccacccgccagtgggcctgcgccctcctccccttcttcggggttcgggtccacctcgtttcccccaccctccccagggctgactgcaaatcggagggcgactgcagaggcggaattcggggcagagcggggtctccccagcgggccacgtcccaccagcaggtggcggtcgatctgcaaggcctgcaaggtgcccggacagaaacttgagcagatattggtgccgctgcccgagaagagctcagccgagtctccccgagcccagctatcggcatccgcgaaaaagcggggagagaagggcacgggctctccgctggagcgactctgggattcagacaccgcaagctgctttcggaagggcttcaggagggggtgagtactgagcagcgcacagaaaagggagcgctgtcctttgctgaaggcattgtccttggcttgcattgagtggctttcccaccccccgggaaagacatttcgggaaggtgacggtctcaacagaaggagggagcgcgggaaagaagcccggggagccggcgccttcacgccccgcggtctgcagcgggaggagcgcgggttccatcgcgccagatggcgctgtctggcttttctcgggcctcgggcgccagtctccagaggtctccggcgcagctgcctctctagccggccgacgcgggctctgtgtttccgggcggaagtgaggcgcccagcggaacggcctctggtgacattttcttgggggcggcgcggacgactgaagggacttggtgg

SEQ ID NO: 89522 - DNA, 1905 bp, Homo sapiens
agtggcggcaactccgccagctccgagagtagggggtctggcgccgacacctgcccctgcagcggagagctccggcgccgcggccgcagtggccttggtggagggagaaaaggctttcttataggcttggcgccgcctgcctctcggcgcttccactaccttcggtcggcaggcgcctccagtcaatgcgagagatgtgtcagtctccaaaatagaccgcttctggggagtttgtcaactttatttcaaaaccggcgaggatgtacactgacgaacccgtgttaaagactatcgcctttacgcaagccattcattctcactttaaaattgtccacccccccgccccgacccccgtccccggcagcccccatcacaaaattgatgctcacaggttgaagtagagaacatcggtacgagccctaccagatccttgagcagtttctgtttggatgggtttttcgttttttgcctgaccttttgctttctgaatcctcttacccagtagaattaaaatcctactgatgatacttcgtcaaggttggacctcttaattacaaaaacatctgccaattttgcttaggcttttattgtgtagtattgggtacatgctaacagaatcactccctttcttctcttgggatattttaaggatggaagctattaactttctaatgtagttttgctgatcttggcaatctagattcctccagtaatcagagcattgccttttggtttaacaagcatttttagaggcctacaattgatagttactgcctgatgtcctgaggagtctcaggacaaaaaaaaaaaaaacacatggttcaagcagttatcctgcctcagcctcccgagtagctgggattacgggcacgcgccaccacgcccagctaatttttgtatttttagtagagacggggttttaccacgttggccaagctggtcttgacctcctgacctcgtgatctgcccgccttggcttcccaaagtgctgggattacaggcgtgagccgtggcgcctggactgaatcagatttcttaatgggaaaaaaaattttttctgacaactttttgtggaaaataggatggactggatattggagctggaaactttctccattgttagaataagttcaccgtgtagttgttacttattcactttatatttaacatgcatttatgtgagagtaactgtcataatactctttgttttatggttatgattaattcaaaacccatatagtaaagataaattcagctttaggttctaatttaatgcagttccattagaactgagggctaatgcgtgtccttcaaaggtttcttgcttctaatattaatagtgatattggtactttcagtctctttattgtgtgactagtaaattctgtgcgcttctgtagttactcattatacaagaagttgttttgttgggattcccaatcttacagctttttttgacacgtgcatgaacagacttgataaataggcaatttcagtattcttctttctaaagtttggaattcatgtacactagagacccaaacctttggtaaatcatcttagatcttcctcattttcctgcacataactgaggatatggaaatagcatgtattcatgtttactgaatagacagtacttgagaaaaacctgtaaaggtgaaaaatgtgtgtgtgtgtgcttttttttttttttttaaagacactcttgctctgtcacccaggctggagtgcagtggcatgatcacagctcactgcagcctcaacctcccgagctcaagcattcctcccacctcagcctccgaagtagctgagaccacaggctcacgccaccacactcagctaatttttaattttttttttttttgagatggagttttgctcttgttgcccaggctggagtgcaat

SEQ ID NO: 89523 - DNA, 1870 bp, Homo sapiens
ttagctgggattacaggcatgtgccaccacgcctggctaattttgtatttttagtagagacgggttttctctgtgttggtcaggctggtctcgaactcctgacctcaggcaatctgcctgcctcggctcccagagtgctgggattacaggtgtgagccaccacggctggctaatttttaaattttttgtagagatggagtctccctatgttgcccagacttgtcttgaactcttgggctcaggcagtcctcctgccttggcctcccaaagtgttgggattagagttgtgagcaactgcacccggcctaaatgttggatttttaatgtgttcctttaaggaatagtgatttcattatcttctgttattttaggaaagagtttgggaccaaataaagtttcttgggttactgtaattctctaggcaaaatgaagtacatatgatactatgaataaaaagttgtgagactataaaaggggagagctatatagaagggggatagaaaatagagtggataaaatatttgtaaggggctgggcacagtggctcacacctctaatcccagcattttgggaggctgagacgggaggatcagttgaactcaggagtttgagatcagcctgggcaacatagtgagagcccctttctttttcttcttttgttcgtttgttctttctttttttctttacttttttttttttttttttttgatggagtcttactctgttgcccaggctggagtacagtggcgcggtcttggctcactgcaaactctgccttccgggttcaaatgattcttccatgtcagcctcccaagtagctaagacaggcgcctgccaccacgcctgactaattttttatttttagtagagatgtggtttcaccatgttggccaggttggtctcgaattcctgacctcaagtgatcacctgcctcggcctcccaaagtgctgggattacaggtgtgagccaccgtgcccggccttgagagcccatttctataaaaaatttaaaaacttagctgggtggggtggtatgcatctttagtccctgctgcttgtggggctgaggtggaaggatcgctcaggaggttgaggctacagtgagctgtgactgtgccgctgcactccagcctgggcaacaaagtgagaccttgtttcaaaaaataataattcatatggagagtctttattctcacaacaacaatttattgagtgtttactgtgtgccagcagtgctctagttgcaggaactatagtggtgaataagaccaacaaggccacctggtgcttaaggagcttagacatttaaacctgaggttcgagttggatttccaggtgagcatgccaggctagggcagcctaaccaaagtcatgattatcagtgcacttgaatggttaagtggggccagtgccttgagttttcaaaaggaatggatagggcagatggagatagggccaagttgcaaaggtaccttattagtccgctaatgggttgggaattttcttctttttggaggaaagaattccaggtagaatgtgaagaatgagataggcattccttttatttttatttatttattttttttgagacagagtctcactgcgatgcccaggctggagtgcaatggcacaatctccgctcactgcaatctccaccttctgggttcaagtgattctcctgcctcagcctcccgagtagttgggattgcaggcatgtgccgtcatgccaggctaatttttgtatttggtagagacagggtttcaccatgttggccaggctggtctcgaactcctgacctcgggtgatgcaccacctcggcctcccaaagtgttgggattataggcgggagccaccatgcctggccctgac

SEQ ID NO: 89524 - DNA, 2757 bp, Homo sapiens
ggcttatgcctgtaatcccagcactttgggaggctgaggcggcggatcatgaggtcaggagatcgagaccatcctggctaacgtggtgaaaccccgtctctactaaaaatacaaaaaattagccagacgtggtggcgggcacctgtagtcccagctactcgggaggtttgaggcaggagaatggcatgaacccaggaggaggagcttgcagtgagccaagatcgcgccactgcactccagcctgggcgacagagcgagactccgtctcaaaaaaaaacaaaaaactagaattgtgcttgggtagtctagaaattaagtttattttgattgattgattgattgattgagatggggtcttactatgttggccaggctggtctccaactcctgggcccaagtgatcctcccatttcagcctctcatagtgctgggattacagatgtgagccactgtgcctggctgaaattaagtttttattagcataattagcattagagaaacaagatactgaccaaagtgaccagtagaagttatttttttactgagttgactagtttaaaaaaatgacctttacaataatgtctggagtctgcattttgttaggtgccttataattagagaaaggtattgtcggggatagggaagttgggtgtggactaaaatttaaggaaaacaggattgtttttctttctgtattaagaacaaaaacttcatgtggttaaaattttaagcagtatcctgtctgccttagttttaacctagcatagaatcatagcttgttcttaaatcaacagtttagtgtcaagggtttcttactatttttctctgctgaaatcaactaagcactttgcagtgagcctgaaggtgtgtatagtggagagaattttggcagcttttatcttgggacctcagttcctggcatgtggttatccatctttatgtgaattgtcttctgaaggagatagaaaatgaccagggcagaaatcttggagaaaatttagaacctttgttttagggccaggcatggtagctcacacctgtaatctcagcaccttgggaggcagagttgggagggtagcttgagcccaggagttttagaccagccggggcaacaaagtgaaaccctgtctctattaaaaaattatttttaaaaattaaaagaacctctgttttaaattattcttgatttacactgatgatgcttttgagtactttagagagtcattagccacagtgctttttttttttttttttttttgcatttgataacttctttggcttcttacttgatgctagtttattcacagccctggtgcaggtccaggtacatgccagaagtagtaatatctgcaatatgaagtgatttgagcagccattatcacctttgacctatttatagagtttatatcagtggagaaaaagttggctggcaagcaagcaaagctgatctctggtggttgcaatctcacaatttatatttaagttccgggtaggccaaattcagtgcattatggacagatccattcagctgtattaatattagagttccctttctgtactctaactttttagcactccagtttcccagtcagcttcactgttgaaggaaagaaaaccgaaaaacttaccacactaaaaaaaaaaaggaagagttccttaatgtaatatgatagtcagtgttcagatttccctcttatctcataaatgtgtcagatcaagagccaaataaggtctctgcattgttttgtaatctgtaggttccccctccatttcttttccctagcagattattagttacaaaagaagttttcccagtgtggatttagcagttacattcctttggatttctgtggtggtggtggtaaacgtttttctctgacccctgggtttctagttaattggtattagatttagaagcttgatcagattgtttctataatatatattctttctcttgcttcttttgcaggggatgaggggaatactttatagatggtacttggatcagtaggtgcataatatttggttccctgtgatgttagtagctgttggtgatcgttgcccagttgtgttaatttgttactcataattccttactctgaatggggcatcctctctcatcagtcctagtttgagtcttttatgcttgtttatagcttcttcaaacttttctttcttttgaggattaagggaagggatgagttgctgtggagaaaagggctctttctactatattgtatttctgtaagtgttttttattttagtcctaatctttggttcttgcattgtctgcattgtctatgctgcagcttcttggtgggaaaactgactcaaaatcccagcaaataattgaaagaagtccttcaaaaccaaatttttaaaaaaatttttttctgagttagagtcttgctctgtcgcccaggctggagtgcagtggcgcgatctcagctcactgcaacctccgtctcccgggttcaagcgattctcctgcctcagcctcctgagtagctaggattacaggtgtgtgccaccatgcctggctaatttttgtattttatttttgagacggagcctcacagtgtcacccgggctggtgtgcagtggcatgatctcagctacttgcaacctctgcctcctgggttcaagcgattttcctgcctcagcctcctgagtagctaggattacaggtgcctaccaccacgcttggctaatttttggtatttttagtagagacggggtttcactaggttggccagg

SEQ ID NO: 89525 - DNA, 1072 bp, Homo sapiens
accctcccacctctgcctcccaaagtgctgggattacaggcatgagccactgcccccagtagagacctgtgttatgaggattatccagtccaaatccaagttgattatttctctaccaccaaacttttttttttctttttttttctttgctctgtctcctaggctggagtgcagtgccatgatcatggctcactgcagcctcaacctctgaggctcaagtgatcttcccatctcagttccctgagtagctgagactaccagcatgcaccattacacacggctagttttttaattttttgtagatatggagtctcactatgtttcccaggctggtctggaactcctggccttaagagagcctcccacctctacctcccaaagtgccgggattataggggtgagccactgcttggctgtaccaccaaactttttactcttcctgtagtctacctgtagtcccccaaagagtggtcttcagccccattttttctcttttagagaacttccctgatctgtgatgaaaacttgtctcctctctctttaaaatatcttctctcaaatctgactttactgatactgtttgatctcatttatgggtaatttaaataatcatttcatctcagacattaaacactaactctttgagaatcactcagctgagttgttggggatacttaaaacacagtccttgttttgtttttttccccctgctatcaaacattgaatttattacttttatcttaccgtatgttagtaccttttaacccacttctcttcattctcctcctctctctgccatagccctttcttttatttttatttttttgagacagggcctcactctgtcacccaggctggagtgcagtggcataatcacagctcactgcggtcttgacctcccaggctcaagccatcttcccacctcagcctcccaagtagctgggctgcaggcatgcaccaccatgcccaactaatttttaatttttttgtagagacagggtctcactgtgttgcccaggctggtcttgaactcttggattcaagcaatcctcccactttgatttcccaaagt

SEQ ID NO: 89526 - DNA, 1025 bp, Homo sapiens
aatgtatcttttttcattaaaattgcgtgagaactgtttcttacctctctatataaagtgctttctcatttttttaatggccacattgtatgaacataccatgatgagctaacttttgtcctgtttgtggtcaatactagtcttttgtgattgatttgagcatatttaagtggttttgactgcaataccggttactaatttaggtagtataaattaaatctcagttaacactcaaatttaaggaacttgaaagataatcattaaattgaatgatgtgccatattgtcatttttttttaacagggaaaaacaatctagatttacctgttttatccacacaacttatttcttgaagaaacaagcgttgtatggtcattttaacaaatttactttttagtctgatgctgtattatgtactttgaaaatatccagtgctgccttctttcacaaattgagacttttgatgcttgtcctatatagctgacattaattccatctgagtatattttctcagatattttagctttaagaagaattttttttttttttttttttttttttttggagactaagtctcactctgtcgcccaggctggagtgcagtggcgggacctcggctcactgcaagctccacctcccgggttcaagtgattctcctgcttcagcctcctaagtagctgagattacaggtgcctgccaccacgcctggctaatttttgtatttttagtagagatgggctttgaccatctcggccaggctggtcttgaactcctgatctcgtgatccacctgcctcggcctcccaaagtgctgggaatacaaacgtgagccaccgtgcccagccttaagaagaatcattattccagaatatacaatttgaatctccataatagaattaactctcatttttattcagttagaaaatctttgtcccccccactgctaaatttgactggcttaaaaaaaagaacttgggtttattcctcatacctgggggtattttgtatctgtgaatattttatttcg

SEQ ID NO: 89527 - DNA, 3953 bp, Homo sapiens
tatatcaaagtcaatgaatgcatattaattatatcagagttttgaagatttctttgtagaacactttaaataaaattgtaaacttgaaaatgttcattacatgttggcctttcaagttagaggattaatattatggcatttttagtagctcagtatgcttagattttgaccgtattaagtcctttgaatttgactgttgatcaaacaagcagataataatatatatatattttaaaggcctgtgtaatagtaagttttgccccacccacttagaaaggtaggcatgttgtgttgactaaataatctggcattctgtttattgactttgtgtgtttttgtacaggttgctttcctgttgcatctttgatatcatttcctagactctactccatgatttaacttgaaattctgaaatgaagatggaggaggcagtgggaaaagttgaagaactcattgagtccgaagccccaccaaaagcatctgaacaagagacagccaaggaggaagatggatctgtagaactggaatctcaagttcagaaagatggtgtagcggattctacagttatttcttcaatgccctgcttgttgatggaactgagaagggactcttctgagtctcagttagcatccacagagagtgacaagcctacaactggccgagtttatgagagtgactcctctaatcactgcatgctttccccttcctctagtggtcacctggctgattcagatacgttgtcttccgcagaagagaatgaaccctctcaggcagaaacggcggtagaaggagacccttcaggagtgtctggtgccacagttgggcgcaagtctaggcggtcccgatctgaaagtgaaacttccactatggctgccaagaaaaaccggcaatccagtgataaacagaatggccgagtcgccaaggttaaaggtcatcggagccaaaagcacaaggagaggatcaggctactgaggcagaaacgggaggctgctgcaaggaagaaatataacctgctgcaggacagtagtaccagtgatagtgacctgacttgtgactcaagcacgagctcatcagatgatgatgaagaggtttcagggagcagcaagacaatcactgcagagataccaggtagaggatgttttttaaactgactgtaaagtacctgatggcatttctcagctatcaggttcagttagatgagtgacacttgaaaaaatccaggagacctgcagctctgtgtaaatttgaagactgcagtctattaacaagacatggccaatttataaaacctgttctgaggtttccagtgaactttagcacatcaggaaaaacaaaattaaagggttaatgatagggacaagattatttttaagtaatggaatttctcataagtctgtctgtaacacattacctgaactcccaatcattgcctttttggcactgcttagatttaatactcactgttcggcatcattactgagtacattctcctcaggaataggcaccttgctttattatatagccactgcacttgagcttatagtgtctgaaataacacattctatcttttgttaaagttttctaataatttttcctccaaaaacagtagttttatgtgtttcccccatattcaatgcatgagaagctagttatccttgttacaaatctttctatcctcacgttgaaaagaatgtctttctgaaaaatttcccattagttccccaagttttaaaaaagtttgttagaaatccgcttgttctagctctcattggtataagggtctgtaacttattacatatttggtaaatctgctttccccattcttattgcatctggtactgtgtactataatacaaaggcagtcttgagatttcatagtggaagaaagatgtatctgaatggttcttaagtagtgaattcttattatccaagagatccttacaatatgatcaggaacattttgtaaactgtatggcattgaataggtcatggcagtattgtttattgccacattgaagaggggcaagtttgggttttctaaagttttatgggtgactatgttttttctctccctgttttctgaaagctttctgtttctacatgtgaagacagcatattgctgatatacaaagaacatttcaagagaaatcatattggttaatggaatctatagcttcccaaacttatataaattcagtaacaagaatgattggttttaaagcactttataggtgttcaagttctgataataagtcttgtccatataatataaatatgagtctcaaacgatctttagaaatgctttttactgttttaatatctctattggattcctttgctattgttccttgtaataaaactaccgggagggggatttcaatgaagctcatcagttaaatgtatgagagaaacagactttggggttgttctaaggcaggttttaggtatatattttagttttacatgtattaatatttttaaaaaaaccttattaatacctgtaaaattgtgcattcctatatcctcttctaacctcttaatcaagaccttgatggaactcttaatacaatacttacttccacttactaagcaggattttatgtaactaccccaatactttgcctttttgtggaaaggaagaaggtgggtaaacaaaatttaaagtcagaaccctattgtaaggtggcttgagaaatgtcttcataggcactttccctgttttgcttaaataggttagatgtgctttgttcatattttcctaatcttctttctaattgagtatcttgaccactgcttaaaacttaaaacaccagtgtctgtttcttgtctcttctgaattgtgtactaactgaacaccaaagtaaattaatttgaatctatagtttggtttctattgttcacaccatttagtaactttgtggcttttgaaaatacacatagttttctaaggtaatcctggagaatcaaatggtagattgaggtacagggtcactgtatgtgactgcctgtgtgtgtgctggcagttttgggaggtcttatggtatacctgccattcccataagacaggtatgaatgatctttactggaattatgcaaagcagcaaaaatggaacaacttagagttcaaatattaggaatttcatttcaattgtccatattgttgtctcttgaaaaattgtgacattgtgaatttttaatgtaacagtgatgtatctttcagtttactgagtcaccttatgactttggggaagagaggaggcacgttcaaccttatagtaagagcagttgtcgaaaagttgcctaaattgtaaaggtaggataaattatgaactgacttgagttcaacaacatggacattcaggtgaacttaagctggatgggcctaacagaatctcttggatgtcggaatgttaattcagctgtttacacagaatggaaaccaagtggaaaagtaaaaaccgattattgccatactctttcattaaggtacaaccaatttagtaattcagaaaatgctctttataagcttttgtttgggctcagcttaaaagttgaaggcattatcctaaataattcctgttaggatatcctaataccttaatcctaaatgttatgccaaataattgtaactgttaatgcatattcttttagagagtgcaaataattaataatgcagaccagtgtagtgcatgatcatactttaattgagtttgatatctgggcaacagatgtttatgacgattttttaaagttagcagttaactgacaggcagcttagtatcggcactagatcatctctctttgaagtttttggaaatatattgatgttttaagaatctgtttggaggtatcatatcaaaataatgctggcagtactttcatttggcagacttagagttgagtaaagggcattttatagtaaatttataatattttatagtgaattcatgtaa

SEQ ID NO: 89528 - DNA, 1037 bp, Homo sapiens
tggttatcttgagtatcaaggctttttatcaagtgatttctttttttttttttttgagaccgagtcttgctctgtcaccaggctggagtgcagtggcgcgatctctgctcactgcaacctccgcctcccaggttcaagcgattctcctgcctcagcctcccaagtagctgtgactacaggcgtgtgccaccatgcccagctaatttttttgtatttttagtagagacggggtttcaccatgttggccaggatggtcttgatctcctgaccttgtgatccgcttgccttggcctcccaagtgctgtgattacaggtgtgagccaccacgcccggccattatcaagtggtttccttatgcattatctttttgtgctttgatcatgctctgcagttttatgattagagtattactgttcatggggggtcagtttctctgtaaaagcagttttgagactagctctataaaatctgtagttggagggattttgattttaatgtaaataatggacattagccttcattcagtttgaaaaagttaattttttgaacatactaacatacgtgcatcggtgtacatggtcagtggggaaaagtttttccagtaactgtttttcataaatatttagcagagtggacctccatacagggtagctttatcttgtcttgtctttaatgacctgctttgtggttaaatgcttattcacaccgaagttccaaaaataatacccctcgtggcaggtaagagtcggttgtcttggtttgtttgcctttgaaaatctcatttcttttggagaatgtcattgaggctactgaggacagctgtttaagtttacttgaattctcaatccatgcagccaggctagaccagctcagccccacttcaagacaaaatctcagcacccattactcaccatacatatttatgcagtgagctgcatcatgaccagctatcatcttacctcatagtttttttctctggtagagataattaacttattatgcttgatcagttaactcttgcttagaaatttaaaaaa

SEQ ID NO: 89529 - DNA, 1200 bp, Homo sapiens
aaaaaaaaaaggtattttgatgttaatttgcatttctttgatcactagtgaaattgaaaaacgtttagctatttgtattcctttggtaaagtctgttcatattctttgcacatttttcttctgacgtgttttttcttactaatttttgaggctttttaaccttttgggggtttaattgcttggcaaattttaaatataaggcagtgaggaggattcatggttgaagatcccaaacccacatagtgaatccatgaagcgcagtaattgacctttttcctagattgaatatcaaaggatttcagtggctaaaagcctcatgtccctattttaagccttttgtaatctggttgtagtttggtagctatttaagagactcacaaaatacattgataacaaaacactgacacagaataatcaggtaaaaactgtctattttcagattggtaaatgcaaatcagatgggtaaaatacatatggtttgcaatctggctatgtattagaatcagctgggtggtatttaaaccatctgatgcccagaccccactttagccccattcaatcagaatctttggggtctgaccccaggcatcagctttaaatgattgaccttaggtgatgacactgagtagccagggctcagaaccgctcagttaagcagtgatatgttaagtttcctgtatctgaaaatcactgtgaaactggtagtctggttcaattaagttctcttactgctaatgggtatcaagttctaaacagtggagtctggtttttttgaaattacattagttataaatcacagcacagttctatattaattaacaagcattaagtgccctcttttacttcatttaagcgattatttgaaaagcatgcaatgtctaaatgtggttttctgtacgctacaaggtctagatgatgttaattaaaaagctttgaagtcttactggtgggtatcctttggcaatttctcatgttgaagcaccaagatactatttttggcctgcttattttctgaagtgagtgcctatattaactttgtaaaaggaaaaggtctttttctcaaaataggatatatcttagtgttaataaaagagcatgtgtgtgtttaaggtgagaatgtggtccctttttttgtcattgttttttaatagattttgcttctagagcagttttaagttcgtagcaaaatcgagcagagga

SEQ ID NO: 89530 - DNA, 1862 bp, Homo sapiens
gcactagaatggacatttgttacaattatgaacctacattgacacatcattatcacccaaagtctgtagtttactgttagggttcactcttggtgttgtaagttctgtgggctttgataaatgcgtaagtggttcctgtttttaagggctcaaaatgtcttgcttatcagtgattattgcttgtaggaatctatgaggctacaacttatctcactgcccccagcataaatgttcttataccattatcagcttttaaatacccatttttagtattcattgagaaataagtaatgcgagaatctaaagcagatcaaaggagccatccgatttcctgtcctatgcttaagtttgcccagcacttataatggggcttaaaggaagttaaactttagatttcatttagtctttttttccataagctaaacatactaacctttggggaaaggtatgtccttcttgagggagttttcgtataaacaaaacttttttaaaaagtgaaaacagcataggggatggagtaatcagaggaaaaggaacattatgaaattaggcagaggttggtgaccgacttcatgaggtttttgtttgctggatagagctgggctaaatgtttgtctcacagccttttaggcattgaaaataggtggcctgactgatttaaacattcttttttatctaggagaaacagttatatttgatagtgagacaggggaaacttctctttgcatcttcataaaaggccactatgtgataaagcaaaccatgttttcacaaattagtttaacaaatgctcaatagagcatttcataagagcattatttataagactcttgatgtaggttgatggtataaggctaagattggttgattccatcaatcattcttttattcagcaagtatctgagcacccagtccattggctttggggatacaacagtgaaagaagtctctgttgtcatggaacttaatctttcatgaggagacaataaatgaatttatcatatgttatcaggtagggatatatgatgtgaataataataaagcaggatataagagataaagattaggaatggggtagaaaagctattttagtcaagaatgatctgaggaagtaacatttttattaggtcccttagaatgaagagttcaatatagttattttattagagacccaaactataggtgacccaaaccaaagataatctagcctagttcaaggatgaaattatatatatatggggccatatcctaaactggaccactatgctactgggtattaatagttgtacacatgttcaggtgtttggaaagtgctggattatgtgttaacagatgccttttgttttaaaccacagggcacttcagccattaatgaatgtgctctccagaggggaaggatgtgatttgtagtatatcccaaacttaactacatttttttgtgtgtgtgtatggcatgcattttaacacttcacacagaccagcgtttgtaaaagctgacccagaggtattctgtatcatctccttcctgtggttttccataagaattaaaaaaaaattaaaacagatcttttgtgtgataagaatcatcacctaagagtgattgtgtaatgattgagtatgggccagctgacaaaacaactttttagaattttaaagtgaaaggagttaaaatactcaagaatgtagtggttctcaactaaggacatacattaaaatcacctggggagcttaaaccgaaacaaatcttagaagacttggagccaccctaggttttggtatttgttaagccactccagttcttattgttcagcaaaggttggaaactactgttaaagattcagtcagttgtattcagtctgtgt

SEQ ID NO: 89531 - DNA, 1014 bp, Homo sapiens
ttttcctgagtaagtgtgtcttaataaaaatacaatttccgaagcaataatgttttatgaaatggcctcagtgtctttaaaggtgccttcagtcatgctgcgggatctgaaggagtgcccagggaagttacaggattacttgacaggggtactgtgtgataggaactgcacaggcagtggcctagaagaggccaggagctgtttttccaagatgcagaggcagacagagaagttccacgtgtggatggaaaaggtaactcatcttgacactggcgaagagaacaagcagctactggaacccaggggacctaagatgcaactagttggccaaagaattttccctgtcaccccatcaagtgcttacatggcagatgcctgatttccaagtactgccacagcagccctttggttcttacctgacttgtccaaatattgacagtatgtcagagttcccaaagatgtataattgcaattttctagttaacgttgctggaaatggaaatattacagaacaacctttgaatctatcacaaaattaattgtattgacaatctgcgttttggattgtgtaagaaataatatgcttttgcccattgtaagtttcttttgatgatgttgctgtttttttttgagacgaagtctcgctttgtcgcgcaggctggagtgcaatggcgcgatctcggcccactgcaaactccgcctcctgggttcaagcgattctcctgtctcagcctcccgagtatctgggattccaggagcccgccaccacgcctggctaattttctttgtatttttagtagagacagggtttcactatgttggtcaagctggtctcgaactcctgacctcgtgctccgcccaccttagcctcccaaagtgctgggattacaggcttgagccaccgagcccagccctgatgatgttttaaaagctgcagtagtaaacagtttcttttttaaaaattaggtattcacaacagaaagccccagaatttggtaaattttagcttgagtt

SEQ ID NO: 89532 - DNA, 1830 bp, Homo sapiens
atattccgtattacttgtatgcaggaagaacacaattcgtttctgagcaaatatttgctatgtgcctactatgcaagataatgtaggaaaagcagattagactgcagcttgatttcatgcatgagaaaaatagtatttttcattgatatggagatggatttttattttgagctttaatttaaagctcagtgcccaaggcaataatctggtaggcatcagccagtggaatttctggtactctgttgtaaaggatacctgtagagggtaaagataaaatggtcactatatcaagggtatgtattgggtggggttttaaattgctagtgactaagtttattaatgaatgtactaccagtttaattttgttttcaatcctcaaactaaaaataaatgggccttagttatgttaaagagctcatagagtgtgtcaaaagatagaaaataccacaggattgaaggtcttgcaacatgatagatgtttttatgtgcagcctgggattggtaaatgctggcattttatcttttaaagatttctagtaatactgtgagacacagctaaattaggatgacagtcttcaataggaatttgtaagtttgctgacactaagtggttttttaaaactgggttttccactggatttacttttttttttttttttttgagatggagtttcgctcttgttgcccaggctggagtgcaatggtgggatcttggcccactgcaacctctgcctccggggttcaagtagttctcctgcctcagcctcccaagtagctgggattgcaggcgcctgccaccatgcccagctaatttttgtattttaagtagagatgggggtttcaccatgttggccaggctgatctcgaactcctgacctcaggtgatccacccacctccacctcccaaagtgttgggattacaggcatgagccactgcgcctggcctggatttatttttgagaggaaattattctttcacatttataataacatcaatatgaaaaaggttcattttatttaatgaagttgccactttggaaaaaaacgtaattctgcatgtgttttttaagaggaagtataggcggtatatttagagtcgtatataaacaatcaagatcttcgatgtctcaatatttcttaggaacgttactcagaaaaaatgtcaccactttgttttaattcagttctatatccacatatttgtaacttgtaaattaccagtaatagactgaaccacattttttccttttctggttttgaattgaaaaattactgctttatttgtttttttccttttagaactggttttatgagaattggaagttaactttggggatggcttatttctgtgctcagtttttgtttagggatatatacatccttgtataaggatacatatataaatatatacatatgactagaggtctctgcattttttttttccattttttgagatggagttttgctctcgttgcccaggctggaatgcaatggcacgaacccgactcactgcaacttccgcctcccaggttcaagtgattctcctgcctcagcctcctaagtagttgggattacaagcatgtgctaccatgcctggctaatttttgtatttttagtagagatggggtttctccatgttggtcaggccggtcttgaactcccaacctcaggtgatctgcctgcctcagcctcccaaagtgctgggattataggcgtgagccactgtgcctggccgatctcttttttttgtgtgtaatgatttttagattttctgaacttaattttgaccagtagaggtaaggtttgaacaccaagcaacttacaataaat

SEQ ID NO: 89533 - DNA, 1119 bp, Homo sapiens
atgtcctactaaactgtcctattaaaaattgatggatatttggaaaaatagcaaaatttagactgattcaaggagaaatcaaaaggctagaatgtggaatggatgactctttagcagggtacatagacatagggatgtggctaatatatctaaattttgtgctctttcttgctgtatgtagtacagatattttagtttttttatctatggatctaaatcctcaaagcagtaggtcatggatttgtccctgaaatagataaattgaaagatggtgacctcttcaggtgcctcatttctgtatttatagcttctcttaaatatccagatgaattacctgagttatcttccaaataaccccacttgaatcagaggcttcataactttatagttagtggtgacacattaaattgttttttcttttgatcagcttttccattactctgataatcttggatctttgcttttacctcttttgatcttttcaaaatggtaaacccttcatgaatatcataaatagctttcctgggtggacaaaatgatgtaacatttaccagtataaggacaaatgtaatccttaaaatcttattttcatcttggaaactttataataaaaagtttaaatttttaataattgagtataatggaaaaagtacaaaatacattcatttggttttattttaaaaacgacttaattccgaaacaaagtttcagtgcatattgctgcatttcgtttccatgtagccctatcttagacatttttccttttactgaaataattttctgatgttattctgaagaaaataatacacatgtagtttttggtatttaaggcttttttctggaaatggccctttatagatttttatcttttgttgatgaaattcttcttttctaagagatgttttgaaaatgactgctttcttttcaaattattctgcatgtattttctattttcttgattgatatttttacacttgatcttagttaaaaggccgagaagcgatgattggtatttttattactattttttctctttcttttttgagatggagtcttgctctgttgccaaggctggagtgcagtggcgcaatcttggcttactgcaacctctgcctccca

SEQ ID NO: 89534 - DNA, 1045 bp, Homo sapiens
gcactggcctaggcactgatgttcctcagagcttcttgcatgccagtggtgtacagcagagtatacatgcaaaagtaagcaaacaaacaacaaaatagggcaggtgctaagtataatggaaaggtagggcagtggaccaatatttaaattgcttttgtgttctttgttaacgtcttctttaaccctcaccataactccgtgaagacactgaggagtgaaatagtttaccagggtctatgtagctaagagagagtaggcaaggctttaacttgtgtctgctgccaaaaatctgtacttcctatgctgctaccagtctcatcctgtatattcttctttccttcaacaatgagaacaattatagtctattgtggtttcacctaattaggactcaaattttcatctgtaaaatgagagtagtgtttgtttagttttaaaatcttgtgcttctgattgtcaaacctggaaaggggaatttgtcatgggataaacagtaaaggaaaagttaggttttgttttgatttgtttttgtgattcaaattttctaatgagatttagaacatacttgaaaaggaaactaattcgtaaaattaaacatttgatggcaacaacgaagaaggcttaaggtcataagagggtagacctcactgtatcaggaatatgtgacaacacagatacttctatattttggtatttgaaaagttcgaacctatttattataggatagaagcttagtgagacagtacaaatccatttctagcataaaatggatgacttgatgtttttaaataaaaagtagttggtagattttttaaaaattctaaaattttattttatcgttattattttttaatagtagaaatggggttttgctgtgttgcccaggctagtctcgaactcctgggctcaagcagtcctcctgcctcgtcctcccaaagtgctgggattataggcatgaggcactgtgcccagccattcgtgggtttttgacctttaacttttcttgtgttgtgattgtaacagcaaacatttcaaaagaatttgatca

SEQ ID NO: 89535 - DNA, 2646 bp, Homo sapiens
tactaaatttaagctaagttataaggtgtgctgtttggaaatatggaagaaacaagaatgaagccagataacaagtttatgcttgtatttcctactgatgaagactttcagacgagttattttcatgggtaggtgatgtcactctgcatgtatacacttatacttttttgcatgattatacatgtaggagtggtacaattttgacttgactgttgacctgttgcctcaatttgggggtaggggtggagaatatgagggcaagaggctctgaatggtattagtcatataaattttaaaataactcactaaaataacttagtacaaacacctaagaaaaagcccttaaaaaatagaacatatggtcaaatagtcaatattgtacttggcccttatatcttctgtatccaagtatttggacatcacacagtatcttgattccataataatcattttgaactctgacgagaacgccattgaatattgcagctttcttttctttttttagaaaagaaaaacctgaaacacgaatcattttcttgctatttaaactaaaatcaattaccaactgataccaaggccacactgttgaattttatggtcattgaacttgatttaccccttaaggggatctggaaattatttttaagtagtcaactaaagttgtcatgatcgtcagaatttcatattgtgacatgtctgttctttatacagtggcacctaacaactcatttacttttatgtttggtcattttttatttaaaaaatattactacataaacctgtggtttggtagtttagttttaagggatcactacccaaagtgtgtttttgttcagtgacaattgacacaatggatatttgtattaaaatagtaatacttcattgtgttacatttttatgattcattggcacagatgcattccttcatagtcaagagtttcataaaataggtgtgtttaatattcatttgttggatgatatcttaaaaaccttaatggaaatagtttgcttgcgcttcataaatagcctttgggggagaaaacagcattcgtttatttctgctttatattaaaataggggtagtagagggatttcttacttgaaggaaaactttatgtttgctttttgctgttaacgtttttcttaaaaaaggggtagaattagcattttaaagcatgtatctattctacaagcatgaatattgacttattttagcatgaattgctgcagtgtaattaatttactttgaaactcagctgcctttttcagccagttagggggatttgagggtggaagggtcctcttccagtaagaacttcaatattttcttgtaaaatcacccataagattgcatattgtttagttggagtatgagctggttgtctttcttaaggaaaaggaaatagaaatatccctcataagatatccaaagcaaaatcctgaaaatggatttgttgtattgtctttttacagaatgtcataaagtgtataacatccctgtttttataaaaggactttactggaaatagatatgttagtcaaacagagctctagtgttaaccttatttctttaggacataggaaaatatatttgattttcttttctgaatctactagagactttttatattacccagtaagagaaagaactagattcattcttttaaaaaatataaattgggttttaataatttgcatcagttttttcctttaagaaatcagttccactttctctgtggagtcatcctttttttcttaatcttgctctttaaaagtatgacaggaattcagtgtaacattgttgagtatagtcttgtcttctgttcttcatagtaacactccttttcctccttccaaaatgtgtccatcatctttgtaagcttggattatctttttcactttcacattttgtacaaaatattagatctataaagtgcagcttttctgatgagatagaataatgaaggcaactgacattagagggctcttactagtttcagaagtatttttcaccccacacgttagatacaagtatacattttctttcctccctagatggacctccagttgtagctcattatgatatgtctgacaccaactctgacccagaagtggtaaatgtggacaatttattggcggctgcagtagttcaagagcacagtaattctgtaggcggccaggacacaggagctacctggaggaccagcgggcttctagaggagctgaatgcagaggcaggttggtcttccccatcccccttctctaacggtgtaatatgcatgtgtcctggagctgttttccttgtagtggaccctgatgaggagaacaggtcataccagagacatctggcattgaatgattggttgtgactatccaggctgccatttatacctgaaacaatttggatagcttgtcattcatctttcctactcagaaggaagtagaaataagagcatttaagacattaattgtaggtattggtaggtttcagtaggcatatttcttggattaaaaatgcccaatatttgcaaaaatgacccagatatgctcatattctttggccagttctttctctcactttaattctgggtagtgaccttgcagcttggatagggaatcgttgaatctctccctgtggggctggct

SEQ ID NO: 89536 - DNA, 1023 bp, Homo sapiens
ctgctttttccttttccacgtaggcttttctatactctttatttttgtttgtttgtttgtttgtttttttgagacggagtcttgctctgtcaccaggctggagtgcagtggcacgatcttggctcactactgaaacctccgcctcctgggttcaagcgattctcctgcctcagcatccggagtagcagggactacaggcatgtgccaccacacccagctaatttttgtatttttagtagagatggggtttcactctgttggctaggatggtctccatctcttgacctcatgatctgcctgccttggcctcccaaagtggtgggattacaggcgtgagccactgcgcctggcctctatactcttacgcagctacttccaccacactacttttctacttcattggaccaatcccccatccctttatcagtcctctcccagcttcctgtccttccctatcaagcctatataggcccagctgtcctttgccaatgtcacttatagagttgactttcctgttgtacttacctggcagagtctgatccctggatgcacactttgagcctgtatcccccatgctaagcatagctggagaaaatcactttgtcacagagttaaaggttgccttaatttcctagtctgcggcttcatccaggctctcagcgcttcccagaaactcccccttttccttaggcagcattctttttttttactttttttgagacggagtcttgctctgtcacccaggctggagtgcagcggcgccatctcagctcactgcaagctctgcctcccaggttcacgccattctcctgcctcagcctcctgagcagctgggactacaggcgcccgccaccacgcccggctaatttttttttgtatttttagtagagacgcggtttcactgtgttagtcagaatggtctcgatctcctgacctcgtgatccacccgcctcggcctcccaaagtgctgggattacaggcttgagccaccacgcccggccttgcattctttctccgtagtgg

SEQ ID NO: 89537 - DNA, 1016 bp, Homo sapiens
ttacccccaaatctcaccaaacttttataccttaaaggacaacagaatgttctgtatgccacttcccctcatctgtgcctactcttccttgagaacccagcttccctgattaccctcaagtctggtgaatgttccctatcagagcagttttcaagccatggtgcaatagactgctttttattatctctgcatatatcgcaggttcattgagggtagagactatgcctgccttgttccccatagtatttctagcacttagcacagtgcatagcatgtcgcaagtatttattgtaggtacaaacaaataaagtaaacagtaaagactgtttgaattattgaatatggaaaagttgaaggctataaagaagagagtctgtgattttgtattcttccttagcagtacagttggaacagtgtgcatgaggataggaataactaaaacattgaagtagaacttggatgaagacttggccacaagcaaggtattggggatcagagcaagaatctaggtttacgaaagcaagacttaaccaattccatttaagcagcctccctagatttaataaaacagagttttatctggtgaatgccaccttttgtatgcttatagggtccagatatgtgcccactgctagtgccacataatctggattacaaacccacgcaaactgtgatatataatctcaatcactggtttatctaggagccattctaagcattaaaaatttttcacatatatgcatcattttcagtcgaagaataaaaggtaaaaatagtactaaagaattatgaaaaagacccacaatcatattcaaacttgattatttttcacagctttactcagaatctacatatttttatagtgttatgtgtaatactttatatgttagtatacatttttccaagttgctacatagcactgtaatgaatatctttggatataacattttgcttatttaaaggctaaggagtaaattattagggatgggtttacagggtcagaaggtataaaaatt

SEQ ID NO: 89538 - DNA, 1038 bp, Homo sapiens
gtatttttagtagagatggggtttcaaccatgttggccaggatggtcttgatctcttgaccttgtgatccgcccaccttggcctcccaaagtgctgggattacaggcatgagccaaaattttattttatttacattggtttagtttagattaggtgttgtgtagattttttttttaaatatgggaaataattttgtatcagatcacaatatatttaaataaaaataccctttagagggtaaatgagaatttgtactcattgcaactctgtttattctatgttaactcctaggtattctaaaattcagccttttaaatcagaacattcaagagctggtacataggccgaattattttagctcttgctagaattgtttttagagccatgtactttgatgccatgccattagccattattgagagttctgtgaagctcatgttttctgtgatgttggagaatgtattttattgcatcatataatacgtgctttgggaagactcttgtaaagaagtccttacatcccccagtgccacaaactgttatgtttttccagagtgtgtggtttgtttctaaggagaactctcagcaatgtacaagttacatttcagttgctcagagccaaaattgtgatttacctccagccttcctttttagatgtagttttgggtcagattttgtcaaatctatgtttctttagagaggacatgtgctaaatctttcacaaagcatctcagtataaatatggtattagtgattacttctattattctatatgtgcctttgggcttttctggtttagagtttggttctattaaaatgataagcagtagagagccccactgccttctaggtggttacgcaggtcgtttaaaagctgactggagttgaatgcaaaaagcattacagcataaaatatatagagtttgttatggtttaggtagacagatataggtatttaccaaagcatttaaatttttttatcctaaggagtagcgagtgagagactttgagttcatacttttatgtactgccatgttg

SEQ ID NO: 89539 - DNA, 1090 bp, Homo sapiens
cggctggtcgcgaactcctgagctcagacgatctgcccgcctcggcctcccaaagtgctgggattacaggcgtgagccaccatgcccaggcctgttgctaatattaactccaaaaaaaactagtgatacagatgagtgtttccctacaatcacaaggattcatttcctcttcagttaggaaaaagaagtagaaatgttatctaagaggtcaccttcaggctgtctgtaaatgagagtaaaattgattaattttaatgttgttttcttagaatggtaagctaactatatcaaaagttgaccgtcagagcctgctgtgtgtgcgcgcacacacttcatttccactgtgcagcctttctattgatattagtgtatgaagaacaggaaattattctatcaaaccatattatttataattattttttcctaacattttgggaagcaagacccaagcattttcttggttataaaatgcaaagtatggctctaggttgtgtttcatacctgtcaccaattgcatgcaggttaaacactttgtgagaacaaagcctgtatctgcactaatacagattagtaatacaattgattggaccaattaaaaaccagctgagtatgttcctacctcatgtctttcatgatacagaaaaagcatatgtgataatacatgaaactatttttttttatgttgcgtcacaaaatttcgagcctcttgcatccattataggaccactccagaggcttaacaaccattgtgctccctctttctcctgaatttttttccctatctggtataaatttttgtgtaatgtatattctcttataaaatagttgaaatatttctctagcacccttctgtttactagattgactgttttttccctctgtagttaaaaaaaaatgtgttaaaagccttgttctgtcctcatccatctcctaactcccattttattcagtgtgtttgagatcattaaagtaaataatttttgtgaatattttattggctaataacacatacagataactaataacgtaccttttttgcaaactgcttatacccaagtaacaagcactcagatcagaacacagaagtcac

SEQ ID NO: 89540 - DNA, 1033 bp, Homo sapiens
gcagcctcgaccgccaaggctcaagccatcctcccacctcagccttccgagtagctgggactatgggtgcccactaccccacccagctactgtgtgtgtgtgtgtgtgtgtgtgtgtgtgtgtgtgtgtgtttgacagagatggggtttcaccatggtgcccaggctggtgtcgaacttgtgagctcaagtgatcctcccgtctgtgtgtgtgtgtgcgacagagatggggtttcaccatggtgcccaggctggtgtcgaacttgtgagctcaagtgatcctcccgtctcaccctcccagagtgctgggattacagtcatgatccactgtgccagcctattctgacttttattgatagttttgcctgtttttgaacaaatcttaaagtcactgttgagcttggagggcatcttaaaattttccttaacattcctgacagatgcctcagcaattacttgagtacttaaaaggcaattcattccatttcttagtggctttgttctatagcaatgattatctgaaacttgccttctagaaactgattcatggttctaagcatgctctcagtggtttgcctcgagcatgaaatagtacctttcatggtggcttccacctcacagtgattctccctttgggaattccatgtacaactattaataattagagttaggaaagcttttgaccgaagatagtatcatcacattctccagataatctaaaattttgaagtaggagaaatagagagggttaggggttgttccatcatcttaggctctttgaggtgcccagtgtcctactaataaattctcttcattgtttaaagtagcctaagctggtttttggtaactggaaccatttgtaacataacttcagaagtgatctatttttagatagttgaagtgccctgtctcctattctctctccttcagccattcctcagtaggaaataaggtctctaaacctctcactctcctagttcttttcctatgccagacactttctaaactcttctttgccgcttattgaatggccc

SEQ ID NO: 89541 - DNA, 5467 bp, Homo sapiens
ttacagattgtcaaacagctgctcaggagccactgtggtagtttagtgactagactcatgccacttgttacttctcacataagctacctgagggctggtcaggaagtttagatgagaggacatagcattgatcacatgagttgcctgccttcctctcatttgagtcagaacttagtgttttggcctggaggttcacaattctatcatttgactggactgtggaattcaaactgtcagtgtttctgaaacaattttatttcagtgaactcttggtgtgacttgctaacaaggcagttctctccctccgatagaacccttttagtggatctaaactgaagattcagctgtgttactttcacggaaccaaattataagcgattctgttgaatgaaccaagtgcttctgttgtgaccttcaggacaagggaaattgatcctttattcatgatctattacttacagacttttagaaatttaatctgtgaaagggtattactgtcactgtctttgaaggcattattaccaattataaagcttattttaagaacaagttttaactatttttcttactgtttgatttgttcagactaagattgtttgggcatcttaactttgttctggatttatgtgttgccctatcatgaagatcccagaggtgtaaatgagtccagagaaacatcctgtcacccatggtcagtgacacaactcaggagtttctggctgagataagacccttggcctttttaaggctaaactgagagagggaccaagtggggtgtggtggggtagggagagagggagacagagatggagggaaggatattgattgtgggttttatgaacttgcatactaggtttatcttagtaaaaatgttgataagtacaactgaggtcatattgtcttctgtttttcctgtggtggaattaaccatgcttttgttcttcatctcaattgcaggtgtgttcatcctcgaggtggtgtgattcagagtgtttcttcatggaagcatggctcgggcacgcagtatgttagcaccaggcaaacacagtcatggactgctgtgactccccagcagacttgggcttcaccagcagaagttgttgaccttaccttggatgaggatagcaggcgtaaatacctactgtaatacaatgtcactgtgtttcctctgcactgttcccttccacttcctcatcctctttgtgacatggaagttcattgtcatagcttcagcttcagaagctgtttgtggcatttgtaggattcaaactcatggaaaattccctcctcttcccccctttttttaattaaaagaagtcacttaggaaaataacatcacagagaaaagaatttcttctttccctcagtaggaatatagaatgatgaattttattagacaactttattttacttggtgacttttaatcttaggaaactctgccttccttttagaataatattttaattgccaggcaaaatgggtttcagtttttgaatcttgtatttatttttctgtataatgaaattaatatctagacttgaccactatctgcccaccccattggcactcccatcttagggcattcgcacacatatcagtcaggtccttattggcacctagtagggcatgtgcatttaaaaacttgtccttaaaaatagaagacagaagtattaaaattatattttcttttattttaagtcttctgccttctttcttgagtttgctcctgttgacttcccacagcacagataattgacatgtccctttgtgtttataaatactactaaggtgacctagttgttctccttgttgcaataattaataactctttgcaaaatgtctcctttgagacagaggcatttcagatagatacccaccatgaggtgttctgggcatctgaaggtattaagagttcagtgggaaaaatctctctccctcgcctttttttctggtttagtcaaataacgggtgaacatagaaacctgttgggaagaatatgaaaagttatgtggcctctgaggctacaggcacttgcaaatccgagaggaaagtgccgtctttcatagctggtctctgtataaagagtatgtagcaacaactgtttaacatccgagatgaagtggacctgatgctgtatttgggtatttttctcctctaccttctaaaaaaaaataccataagaagaatcagaatgtaccataagaaatcagatgcaaagcacgttaatgtcattggtaagttttacagagtctaaaaggattagcaaagggtagcaggagcttcagggaattcaggaaatgccagcattggaattttgtggcattagttactaccttctttcttataatatgttgtagttactagtgaattcttttaaaagcaatacctagagttagaacactatgtactctgcacagggggagtgaagtaatattggcttagaagacttcaccttttgtttttcatggtttttgtttgttttgtttttgtttttgtttccattgttaccgttgctatggccctttgcctgtctctccaaatcccctggtggctcttcttatcattaagagtatgagaattaccattttcagttttcattcagcaaacaaatttaccaagtgcctgctctgcataaggcactgtgaggggtgggtgctctgggggctgctgagatgaatgacacacaccgcacatacacatgcatcagtgtctgcctgcctccacctgcccagcctgttcttcttcttcttcttcatcttcttcttttttttttttttttgtaaagacaagtttattcctttacgcttcttgttgcattagttctcctgtatgttccttcttccacaggaatgtatttgtgcatatgttctttgatcttctctgatagcatctcatttgatctggcctctgtccttcatcagcttttattttttttatttttattttctgcttttgttagataaggcttttaagatcatgaacctccagctttagcaactcatatatcagtctctcacatggccacaattctagacaaaaaccaaagacccagaggccagagcaaagtaggaccttctgaagattcactactggtgtatccttggaccttcacattttactttaggattaatttattgaattttactgttacacatagtttttgacttgaattaaaatactagacaaagcagaaatgtacaatttctggtctgtgttttccaggaaattcatagagaagagaatagagtggatgatgtgacttgaagtttttgcagcttattttttcccccactgtcagggcagaggcccattttaatgaatgtttttgcatgacctgttcttatgttaaccacatattttttttcccaattccacacagcaggtgatttcccgtgtgacatattttcttcatagtccctaatatagtcatcctctacagagttggcgtgctgtgtgcactgtggattaggaacagagtggagctgtaaccagtctcttctctggccctttgcctttatgtcagcttgcacttttgcctcacttattcctagtccagctcccaactgcctgacttaatggaccagaacggagatttggatattaagatgcagagggggaggggaagggatggtagagatagacagctctcccctactaggttgggtcatttcccctaataactatagagagactgtgtttcaactctcttttcattgctgtttccagaagagtggagagtgtggtttcaggcaaggtattaatgatacaattccgtggtatacagctcctgtgacatttgaagtttcttttaaaggggtttttcttaatcaaagttttacatttggtagcataagtagttctttatgcttcacaggacattgtcttcagagtaatctctctgctaaaatggtacatgtgggtcacagattggtttatgccactgacttggttaagtttccaccccctccaatttgtgaaaaacagagcagtgacctagctgttgcatcatcatgactgccatgtaacctgtaattgctgctctccagtaattgtcttttcattttgatggtaggggccagactgaatgaataatgcattcttttttattcaatttatttcattcagtttattcttggcaatcaaacatcccataaactttgcttttattatcaattatgaatatgaattgtctggtttactaatgtagtcatttgttcatctttacttttagcagattagcaccataactaacttaaaactaagtttgttacctgctttttatactgtcacaaaggtttttgaaaaagctggggacactattttgtcttttagttttaaacttttttaaggcaaagcaagctccccaatccctgttctccaatatgtgtatgatgtgacttccatgtagatataaaaatgattgtgccctaaccaaacttcctcagattgtgcactgtttgtttaaaataatcacgtattttagtctgatgctgttgtattttttcattttatttaaaacactacttacttcttattctcttaacaaattttaaaaggtagtgatcttaaaaaaaaatcactggataactaggaaatatttttgttgttgttttgtttcttaaagagtacagaggccattgaagccttttgctcctcttaccgtgaaaatgaaatgttagccattgtatggctaggaaccaatgcacttggcagttaatggatctgctgttgctggagtgtgagcgtggacttgatgcagtgatgacaaatcattgcttagaattaatgttttcaaatgtgcaactctagtttttaaaacaaaatttggttctttacattcattatttcgtttttgtttccctttagtatttaatggtctttggagaaaaaataataaaacagagtgttatatatatattttttggtgcaagataagattttctgttttttgaaataagtctgtagcataaaggttaaactattttaagacaaaataaaatagagtgtatttaaacaatgatatcttctgaggtttttttttttttttctttgtccctatctgcttcagttaattaggtggtacctggagcaatttccaagttaccttttaaatgtgaaagtggattctattttgttaacaagtcttatctttataagatgtctgagttttcaaagcaagagctgtatccttgcaaggttacttgcaaaactactcccaagaagttttgcaagtaaccttggataattgttggatgttgataaaaatagctttgcattagctttcctgtaaccccacctgagatttcaaagagggccaaagacttattgttctgggcacctttactcctggcaacaaaacttcactgctggttattactttgcagagatcagagagtcaaggtaagatgctgcaacggcatgcactttgcatgtggttaaacattgaagcaggtatagggtgtttga

SEQ ID NO: 89542 - DNA, 1964 bp, Homo sapiens
ggtgggcggatcatctgaggtcaggagttcgacaccagcctggccaacatggcgaaaccccgcctctactaaaaatacaaaaattagctgggtgtggtggcgtgtgcctgtaatcccagctactcaggaggctgaagcaggagaatcgcttaaacccaggaggcagaggttgcagtgagccaggatcgcgccagtgcactctagcctgggcaacaagagcaagactctgtctcaaaaaacaaaaaataaaaataaaaaaaggaaaactcttctttgactctagaaggaaactgtttacctaggatctcacgtttgaacccttttgcccttggatactgcttttgaagaagaaactaggcacaagtaagtaatataacctgtagctagtgctttatgtcatttgggctgcttctttctgttcttttgcaggcatttggcctttccttcccttactgttttgtttttcagagtagataccaactatttataattatagtctaattacagataaagaatctttaccaaatatatatgtatcttttcagctccatttttgcaacctaagtaaagtgaatttcttctaggttttgttttaaccacacttggaaccaagtgctctatgaaagagcgatcctcctaggtcattggtaggcacgatttttttttttttttcatgattccatgattgaaagcactgattcatagaattagagaggttctggcctatagtggaactttggctgggagaatctgcctggagcagaagaaagcaacagtaagtagtggtaggagcagtgagttcagaaaaagatgcaagtaatgatcatgagtgtcagaaatttggaaggagcacccattcacctgatactctctgttggtttaattcattgtacacgtgacatgccttctaggtggtgatggctttaggcagggatctctctgtgtgatgaggattccctgccaagccttgaggacccatttgatagggtagtgtgaatgatgagagtgagtgctggcagcgaagtcagccctcagaaaggaagtgtggcagcagcagctggtataatctgctcatagaccctggcctgctgttgggaacacaccttggttgtaaattatatctgtctagcttcttaccctttagtgaaggaagctatttggtgccaactttttcttttttattaaaatttttttttccccattggccttgctgaagcttttagaagataccagctttttcttttgtgctttggtaattgacatctcagagtcacatctgttcccctttcatgattgctccatcccgagagtggaaaggtaaagtgtagtggactgttgagccctcacttttgtgactgattctaaagcaagcaaatctgacttgaggatggatcttgaattctgcagcatgagagggttagatcagaggccaggtgagtgagtttaggcctgacccagggaacaggagatcccagaaaggccaagtgactgctataggatttagtttctgcacctgtaaaatgaagaatgtcttgggtttcttttttgaaagtaaaaggctatgtgattttaggggatgattcattgttctgcagagccatcaggcttttcaagcagtaactcaagagagctgcttactccaaaaaactgctcaaaagactgtagttctgtcatctcacttaagccttgggaaggctttggatgactaacaccaacagaaccttgaatttctacaagcgattttcaaagttttaaaagaatgtttatttcaaaagtttcacatggggtaagaagtacagattattatcctaattttacagatgggaaaactggtaacagaagaataactgtgtatttggatttacataggtagactttgtgagagtagatgttttaaaaaaatgactcaaattagtaccttttaactgttcagaaaaacaaaacctcaattttctggttttcct

SEQ ID NO: 89543 - DNA, 1049 bp, Homo sapiens
ggtatcgctttttcctttcggggtctgcttcggagcgtggatcgccgcaggcaccggggcgggggcgggcgccgcgggcggccgggggctcagggcacacccgcgaggacgcagggcgagcggtggcttccccccaccccattttagggggacccccgagggtgggggcggccgccctcgtgggagcttttgtagtgaagttagggtttggcgaatttgggtcccttcctccccagccccattttttattttttgcggcggacgtggttcccccaaatcacagccccttcccctaatacctagccctgtatgatcgaaaggagaaagatacatgaccgtgtgtgtgtgtgtgtgtgtgtgtgtgtgtgtgtgtgtgtgtgtgagagagagagagagcgcgcgcgcgagagcatgcttggttttctgtggtttgctttttttgaggtatatgtgtgttttgtgttatgtgtgttttgtattcattttttgttcattagtaccgatggctggctagctgggacctgggtctctgccctatcccatgccccagcccccaccctctcgtgggcacttgcacgattttccatcccatccttttttcgtctttaaccctttttgtgcatcgcccttgtgctattgccctgctcaccccgccccccgcaactgtctttgtatgacagttgcatacacgggttcaagatgcttgggcgcgtgtgtgtgtgtgtgtgtgtgtctgtatgtgtgtgtgcatgtgtgcgagtgtgcgcgcgcgcctcggagagtcagacctgcgctgctgtgccctccttgggtccggctggagcggggcgtccggcccttgggtgttgtgctgtgtgtgaggatgaggtgggaagctgcccccacgccaggcctttgccccgggcagcggttgacaaagcagcgggccggcgcgggctttgtttttaactgtgataaatggggtgtgtttgcacggtcccctttccccacatcccctctccctcacattctgctacaacaatagcttgattttcccctcttctccccac

SEQ ID NO: 89544 - DNA, 1050 bp, Homo sapiens
ggcccagcctttttttttgtatcgtgtgcatgacgacattgttacacacagaatccactaatactaatatacaatctctcaataaagaactagttttcctatattaacctagtgtgctttttctcttgctgttttcccatttattgtcgtatcctgctgtttagattttccccccttgcttttctatccccaccctcacccacccaccactcccacctcccattgtaagatttgagtgaatgccttttctttttactttacttttttttttttgtggtacagatatggtgactttaatctcatttagtccatatcttttcacaatagatgtctggagcgataggaggggccagttgtcctgttacactgaaacagttcacctgcctagagagaacccctacctttggccgcctgtgtactcagtagcttccacatttcatcttagttttcaagatacatgggcactgggtttatgatgctggtgaagagaaggggatataacacttaggttgagaaaagggatactgttcttaactagcaatcttgtagcatttcagactcgcctaaaaacccattttgagttgtgttttaacttttctgtttgctgtctcattgatttactgtccttataaatcatgctgggggtgacatgttacatgtagctgaagccatgatctggaattttaaagtaccctcttctatgtgcatatttaaatttttaggacttgcaatataagttttgcattgagatcctggataaggaagatgtttgaaacagaagctgactcaggccactcccacccctatccagggccagcagcggacctgttactgtaggaataagagggtctgtgccctctgcaggctgtgagccagttaaagctgattatagcctagtttcctgacagctgcttcatctacggccctagggcctctcttaagagaaagacagctaagatctcagccattgtctaagtgtgtgtgttgaggtggggaagggggaaggggaaatcaggagtaaagtcaggacctaaccccaaattgagttga

SEQ ID NO: 89545 - DNA, 1041 bp, Homo sapiens
tcatcattttggagctgctcctcttttggccgatgtgccttgtccttgctcccctgggctgactgactccccggctcaccctgctcctcgctggcgggtgcacccctgcctgaccacagcgcttccttgccttctttgtggcttcatgcaactctcctctccccccatggctgccctctctgctctggccctctttgttctcgtgctcttcccagcctggatgggaaagctgagctgatttactgtgacacatggacacacatggatgttcccagtggaggctctgctgtagtttgtgcaagaggagagatacaggtttacaaggctagtcctctgaagattttgtttgtttcgttttcttctttttaaattttcatttacaggagacttagaaagcctccaatccaacctcaacaataataaaactaccctgaattgagtgatcactctcatatttgccctagagaacagtggctcattagatcaatcttaaccaattccaggatttcatttttctaaatttttgttaagtatgtcagaattgtttgagaatacattttgaggatgattagtaacctagtaataatatagcaagctgtgggttaatgggaaatcatgttttagcaatgtatgcagtgtatttaatgtttgacccagattgtctgaactaaacacttacatattaaggagactttccctgtgactggacgattcaggaactacaaggccattgttctttatatttattctctcaaccacctgacacatgtctgttttagcaccttgacttcaggattttggaaaccccatcagttcagtgaatcctatgtcataggctttgtaataagatggaacacagttcttctttctgaacaagagaacttctctcttgaaactagcatcagaaagacccactaagttaatgagttttctttaataataattttccgcaaaccagcaaatactattagttactcaaatttagggaaaagaccaccaaaagtgttgaggccctaatgtgcaaatgtcagggcctgggcc

SEQ ID NO: 89546 - DNA, 1053 bp, Homo sapiens
cagggagcaccgggatcattgtcctgtctttgaatggctctcctcagagcacaactctaggagttaagcagcacgaggtctggagaatgtgggagaaaaggcttgaagaggttttgaagccagtttctgaaggcctctggagagtttggactggcttctttggcctttgggagctctgaggggagagggctgtttaaacagtttattctgcagctgatgacagagggatggggctaagggctgaggtcagggaggggggtgggacaggcgtggggggtagggaggagaagatggctcacatcagggagtttactgtaaggtggagtaagcaggattgagtctatgtggaaggggctgaggggcaggaggtctttggggtgctttggagagtagaagaccatgaagacaaacggggaacatgggaggaacagtccattttggtgagaattgagtttagtgtacagataagcacatagaacttcagacgccagaatggcagatggaaggggattgtggcaacgtctgggagttgagacttctagtcctttacatacagattcctggttggggtaggaaatgaacttcaacaataaaaattcctcatactcacatgacttgtcccccccagactctctgttgatgcctgaaacccttgtgatgttattcacatgtgtctttactggcttaggtcaccccttgagcaagctttcttacaatatgaactcctcccggagttgtaccaatcagtatcccgaaatctgagttggaacaagttttatcaaactttgtctttcttgaaaagacagaccccaaagtgggcaagtaccaggagctttgcctccactactttgcaaaaggccatccctacacatgggagcagggggaacgggagggagcccgacccagtagcgtattgggagaggagagggcagggagtagggactgaggacaaggacaggggctctgatctcaagattggtcctgtctgcaaagaggggttttttcgcaattcaaagctctctcttccattatcttatttcctccttggcacag

SEQ ID NO: 89547 - DNA, 1094 bp, Homo sapiens
gctgtgccccctctgaagctgagtgggagggaaggggtggaggcgctctccatgtcttcccccttctccccccgcccccagctagcttgcttagctccagccttcctcccccatgccaccccctcctcaaaagctcaggggccccctccgggctgcctgtgcccgaggaccacccacctcctagaacacctgcttctactcctcaaattccctcgagctaatgggagaatgtgcccactcccacccccagcgtggagacactggccttccttaagccgaaggatggcccttccccaggggaccttggcctccacaggggacctcggcatccacagtgggctcattccctggaggggcaggcatggactcaggggaagggaccatacctgccccctctgcctgtgacgtttgggacttctgaccagacctgaaaagtcagattctgggaaggtgagggagtgacagtgggggacttgggcccaaagaactggtcctcgcatggcccagaggtgtgtgtgtccccaacctctgtgctgaggagagagacagcggaggtagctgggccagagccttggcttggttctgtcagcactctccagagttcctcatcttggacaccagggtggtgggctgtggcccaggcctcccctctggtgggctcatgtccctcaggacggagggggacatcagacctgtctccctccctaagggctgggtcaggagggaagctgagcttgggaggcagctcctgcctcgctccttctggccaagctgatgctgaggctgcttcggggcaggggtgcctgggatgcaggggtgcctgcgatgcagggctgctggctgccacctgccacggaaccagagggatagggcagcaagggacaactggaaggaagtttgcgcccgctggaacctgaagagtccagccctcttcctgccaggaggaaaggaactaaaggagggggtgagggaagagaggtcatctggggtgagggggcagcagccagcccccagcttggtcttccccgggcaggtgcggtgggagtgttgattgaggtgggagagaaggccagatgacaacctgagatggcaca

SEQ ID NO: 89548 - DNA, 1864 bp, Homo sapiens
cctctctgagcctcagtctcttctaaaaaaatggaaataattgatgtaaataccagtgtcacagagtggtgaggatgaaagagagttctcactcatataaagtacgagacacccgaaatcctgggaagtgtttagaaaagatggccatttcccaactcccaccacacaccccacttcccccatgcaaacacacctctgcttgttcaggcctgggacagttttaggggtcttaggggagtgcaaagcaggcccttgggcagtcagggaagggctgggcatatttcagcttaattgtgtaagcagttactgagaacctgctttggcacagacagcctgtgacctgtagcctaactggggagacccccgaacactcctgatgtgggtggagaatgggcaacaagaatggccaaacagtggtcatgctggccagaaagtgtggcctagcagggagatatcttagcgcacgggatggggagaggtcactgaggcctggagaaaatcaggagggcctcccggaggaggcaggactggagctgttccccgaggaggaagagctgtagctctgctgccttggggagtgatcgggtcagccctgctccctgcgcctctcccatgtaggcccagatctgatccaagaggtaaatgtcagagtcctgtggctgtcaccctcgtctgaattttctttttcttttctggagcatcgggccctctcatttcattgtcatccctcccattccagtctccatcctccctgccatcccctggccctggccatcctgctgaaattctctgcctcctctcctgcccctctgcccagccgagctgcctgagtgctccaatgggtcatcgtgccgcccctggaaagagagtcacgtggaggggtcgctgctcgagggagctgggggcttcgtgtcctccctctgaagcgggcaaccctcttggggcactggttctgctctttgcagaaaagggtactcattcttacctgccaggtgagtttaatcctcatctggattaaacgagacggtggatgtaatgtacccaccgtgagtggctcctggcacagagtaggggctacactaattgttctatatggctatctgctagggagttgccatgcacagagtccccctgcctgctcctaggaggcactttgaattttataagggaaataaaaggaagggggaaactgagcctcagtgttcttatctgtaaaatgggaataattacagcaagtcccccggcagggtgatagtgaggctcagatttgatcatggatttgttcagctcatctaacacatacccactgagcacctgtgttggaccaggccccgtgcaggcatgggggacacaaggataataataataaccataagggcagtagcagatgctcacgtagcacttactctgtgccaggcaccctcctaagcactttgcctgccttaaaaatactgaacctcgtgggaaacagacagacgcaggaacagcatggccctaaggtatgtgctgggtgttctcttagcctgcggcagacatcctggggagggcaatgcctgggggagctgatgcctgggtgagtcttaaaggaactggttgcccaggaaggggtggggtgagggcgttgtgggccaaggggctggggggggtgaggggaggggaagggcaggctgagaaggagagtcatgcagaggggtcactgggacagggagctgggggactgatggcatgcagggaagctaaggctttgttggccctcctggtcaacatggcagctttgcctattggccagcgttgctggtggttgattgtcttttgtcaagaataaagtgcacagaacctctgtgtgtcctgagctaagggctga

SEQ ID NO: 89549 - DNA, 1067 bp, Homo sapiens
cgaggggtgtcaagaggggcaagcatggtcaggagcgcccccaaccccaagaacccctgcagcagttacagcaacatttgggtagaggtggaggaagaagcagcagggccaggaaatggccagaagctctctgctggcgttcctcctgccacgctcggtggtggcactgacacctggctgaggtcaccagtagctgagagactccttagctagtgctcagctgtcacactgggggaatgaaagagatcatatgatactaatgtcactgttctgctttataaagtgtcctaacaagctggcgagccaggcacactcagtcttatttacggccaatattatatctctgacatagagattaatttgacgatagctgtttataagctctttcatcatcagatgggcccattacctgggaggagaagagggccgggtttaatttgtgaacagtgtgctgagtccctctgcccctggcgtgtgtgcaggaggtgcagccataaatcatggcagacgccagcagcgctgagaccagagggctgggagctgccctagcgggcagaccccagagctcacgtgtggcagaggggctccctggcaggtatgccagtctgcagagcccgggagggaggcagggatgcacaatcttctttgctgggaggaggccctggaagatcaccctgccaaggagcttcccactggagtcgacactaaattagaatcatctggaagcttgttaaaatacagatgacctagccctacagagtcaccacctctgtgagtggagctcgggacttccctccagtctgaagtttgagggctgggggcagggatgggctgtgagatgggctggagcagttccctccaggtgcccctagttccaagcaaaggcgtcccttccgtggatatctgagcagaaaaagacaagatcaagagctggcaaataatagacctggagcaaaaagctaaagagattgggtccttgagccaaatggtaaggtttgctaaggctgtctccttgcacctgcagagccgccctgccattgtcctccctcagcagcccagccccttcc

SEQ ID NO: 89550 - DNA, 1191 bp, Homo sapiens
caagatcattcagctggggagaagacaagctccccacatctcagtctccactctcactctaaaccaggaaggcaggagccacaacgttcaccaggctccccaattctctcctcttccttttgcccaaatttatgaattgtttcatttcttcccacactgcagtccctatgtccagcgaaggcccagggaagggcatgtatgttagcagagatgccagcaccagagacaggggacacctcttgaaggaggtagctgtgatgtaggggagctttgctaggccagggattgggggtctgggctcagctctacaagtgtgggcagaattggacacacctcccagcattagagtgattaactgatgcaggtttgtacactgccagggcccatgcacacactcaggctgtaatgatggggggtcctcatgcacgaagtgcaggattggagaacacatgatcagggcccataggcgcccaaacccagtagtgctgctgacaagatggagttctcagctcccttagaggccgaacttgagaaacctttacaagagacttgagagctggttagaatatctccagggtctctgcccgatcctctctagagttttcaaagactgtaccttccctgccagccacagcatcagcaccatgctaagatgcatgcgctttcacatttcacatcttggaaactgggatgcgccttataaatgacagtttgtcctagtttaattgcctcttaaaaatcttttagtggttcataaagcgatggtccactgtgcaatagatggccttttagggctgctgacatttgacattcattttgtgtgtgctccatacacaaagctttggggcctataagtaaatctattgactctttaaagacaaacatcagtgccaagtttgtgatttatgagacctagatttctttttcaccatagacacactccttcattttgcttttaatatatacatattttttgagactgagtctcactctgtcacccaggctggagtgcagtggtacaatctcagctcactgcagcctccacctcccaggttcaagcaattatcttgccttagcctccggagtagctaggactacgggaacatgccaccatgcctggctaatttttgttttttttttagtagagacagggtttcaccatgttggccaggttggtctggaactcctgac

SEQ ID NO: 89551 - DNA, 1054 bp, Homo sapiens
ctcagtgcctgcctggcttcctggcagagctgtggctcccctctatctctccacccatcatgtgcacacatgccccctcaagaccttctccaaacccagctttgcacatgatccaaagccttgcatggcacccctgtgcctggaggacccttaaatatccagtatggccctgccatgttgggtatgtgactgccgtggatgatgacgacaatggtgatgatgatgatgatgatgatgcagatgggcctctgtagtgggcggaggcatggctgagggatggggctgctgggccaagccacccgtctggtccttggcagcattcccgtggccctcagccctcggccaggacgaacttggctccatgcaggcccctggcccaaatctccacctttcttcccttattctctcctttattgactactgaagtattaattaagccctcactctgtgatatgcagaagctgaaaaacaaattgccttattgtccatttattcattcattctgcaaatgtcaatccgtgaccagccgaccctgttccaggtgtgttctaggtgcggaggatgcagcattgaacaatcacctgattttaagaagcttgcattctagtggggaaggcagacagcaaacaagcaggccaataggtagcacatcagaggtgacatgtgccatggtgcaaaatagcgcagggtcaaagggtggtgatgctggagtgggggtggggaggtgcttattttatgcctggcactcagaaagagccttgctgtcagtgtgatatttaccagagccctgagcctgagggcagagagagagggagccctgcagatcccaggggttgattcttgcctctgttgtcctgggcaggcacggaatgcgtacttcttgcctccagatcagggactaactactcactctgaacacacagaagggagtattcagattccatcatgggttcccacatgtccagccccagacacaggcagctgaaggttgagagggtgcctggggcttagcaccctctcccagggctccacctccccaaagcccttctgatgg

SEQ ID NO: 89552 - DNA, 1006 bp, Homo sapiens
tgtgtcttgctggaaggaacagattttctaacactggcttagggcccagtcatcccgttggacttctgagattcacaacaagaggaaattcatcgtatacttagtttccaagaaaaaatcaccaagcaaaataacgctatggacctcataaagcaaacacaacaggaagacactggagttgggtggatgaaaggctcctaccggctgcccatctgctgggggatgtgggatctcttcttacggatgaagagttttgggggttttccaagagccttatgcaatatttagcttcttattcaactggttcaattctgctccgcctcccatcctggctgtcatacctggctttccaggtatagggtagaccagatgacctctgaggtttccatttgctttaaaagtcaacagttcagtgattttcaggataatctagggtctgagcacaaattggaggattgcatttatgttcagtgtgggaggtaggaaacaatttgtccatagtagtgacctgaaaaagaagccgtctccttcttggaaaagaagtggctctggttctgttcatttgtgccaaagccttgcattgacattctttgaggcagggtagaattggttattgaataataggtgggtctattggacccattgccttgtgccctcataatcaggctgtctcagtgaagaggtggactgtaacttgggtcttaaaacccacattgcctaaagcttctgacatggaacaagttgtattcatatgacttttggcaagttactctaccaaactggcctcggtgtccccaccagtagcctgtgactttgtgctttagtcaagatcagagcccagatcccctgaatgttaggttagaggtatggctctcaagccttcttgagtgtcagaatcacttcagtgcttgagacaattcggatttctcggctctgcttctggatattcattgcagttggtgtgggatggtgcaggcatctgtactttgaaccactttcctccatg

SEQ ID NO: 89553 - DNA, 1049 bp, Homo sapiens
atcatgagaacagtacaggggaaacagctcccatgaatcaattatctccacctggccctgcccttgacacgtgaggattattacaattcaagacgagatttgcatggggacacagccaaaccctatcaggaggtcaggggagacaggagcctagcattcccctggccaacgagatggcccactgcaaggagggtcacggggtctgataaggaggaagcacagcccaggccagcgaggaggctctgacaatgcaacctcatcccagggatgacccaggccctgactggattctcagtcatctcagagagactcagtgagattctctggttaagggagaagttaaaggagattggacattttaaaagcatttctgaccaaaagaggattttgagcaaacaagatctttatgaagcttggatgatatcctgggcatgaagcccccacctgggcacctggtacccagaagacagcagctgttagtattgatgataagcctctctgggaaatgagagctgaaacaatggtttgagaacccttctgagaagcactggtgtttcccagcttcaggtgcgctttcttcccagtgatacagatgaggagaccaaggaccaaagagactagtgactgggtcaaagtcaaacagtgacaaagtggcaggtggaatttacctgtgtccaaggccctttctattgtactgcagcatcctcgctgttcagatagacttagacataggctgggacattcatgggttcatcatttactcttatccattcaactaacagctgtttattaaatactgactcctaacgtactagacttggtcccatgtcacttccgagagctgactgtagggtcctggatgggccatatcaggagatgtcctgaagatgaggcccacagttcctttagggtagaagaaagggactggcatccacacagatgtgaaccctgatgacagtgctggtggctggaggttggctgcagggccttaggagctggacggggctatacctcaatactgccaagttcagaggcactgaagggtcctc

SEQ ID NO: 89554 - DNA, 1030 bp, Homo sapiens
aggggcagcgtgagaagtgatgggcttttgcaccgctttctgtaagtcaccacccaaactggaaaggcttcggggagcttggagaaagcccagaggtgtcagatgatccctccatttgatgtatggtccaattgttccagtttcatttaggatgaggccagcaggcagggccactgtttatcaaataggagtttgatgaacaaaggttgagagcattctgggcagagggagtggcatgaacccataaatacacattctacttaaggtgtggtgctcaggccaccatgtctagggcagagggtgcaagagggtggggcttggcatcacgaagcatccaagaggaagttctggagaggagcgctgctatggatggtggggagctgcacaacggagggggtgcaggatagagaggtgcccctcctatgaagcaccccgctatggtcctgtctaacccaccttccactcttcctccccagtgtggctctgatgaataagcagctgaaacaaaccatatgtcaaatgaagggacctcactgtccccagggctcacctgctcctaattaggcctggagtagggaaggagcggggcaccagagggcatcagccagcatctgttcctcagagtgtgtgggtgttgggggcaatgaaggaaagggaaggcttgggggcctcgttttccctgctgggagcccccaggccccccaaccctctgattttatcctgtcatacaagagttgctggaaacgctatcattctggcaagtcactcagtcaaggaaaacctctttaatctcttttggggtgcatctagtccacaggtttttaagcttattgaccgtacttgtctccactttgacaaacacaaaaccctctccttaaacttaacttgaaatttaaaagaacaaatcaatctcacgagactaagcgctggtttcttttcagggctcatatcttattcttccagattctaaaggcctctacttaccctcacacccaccttccctccccgagtccattttacagatgaggga

SEQ ID NO: 89555 - DNA, 1061 bp, Homo sapiens
aaaattagctaggcgtaatagcaagtgcttgtagtcccagctacactggaggttgaggtgggaggatcgcttgagcccaggatattgaggctacagtgagctaggattctaccactgcaccctaatctgggtgacagagcgagaccctgtctcaaaaaaaaaaagatgcttaggaataaaactccaaaggtggggtttcaggcaccaccggcgagcaggtgtctttggagagatgtgcgactcccttgctctctggcacgggctttggcttaagcacccgcagggcctcccttctcttaggtctcaggggtgagatgctctgcaggagccccacagcagtgccgggagatggaactttgcagctggagcaggctctcttccctcctgcctcagcctgggcatctgtagagccaggttggctttgggggctgggctcttaaattagaggccatgagggtttcaaacatggcaaggtctggtatctgaacacttggttgttggtaacacccatccctcctggacggtctgtcatcttcccctcctgctgaggacaggtcccatggaggcaggggttgcttagatctgcatctggggaggaaatcaggcagtgcaggagcccgtgcctggcccatgctgtcagaccctcatggcccacaggctctgtccagcttcagatttactacatagctcagagccctgggttggtcctggctgggtctgagtctgcaaacctgtggttttcagagatgagttgtttaccattttcttttcatcacaaagaggaatccctccccttatatgcaatgaatgttttaaaaatcaatacattcatctagtgtcagtctcttattttctcactgcttattttacttactactgagagtaaaaccctacctgccccatgaatctcagcaggctcagttagccttgcatgacttaagtttcccattttcccaaccatcctctgtctattgtccatctcctctgatgtccaccacagccccgtgaagttaggcaggtgtgatttcctctgtgtgcagggaaagaaagacaggctcatg

SEQ ID NO: 89556 - DNA, 1058 bp, Homo sapiens
gtgtgagtgtgcgtgtgcatatgtgtgcagggagggattctgaagaggaaggtgttgcacaaggatgtccaggttgaaacccaggagcttttctagcgtggctctactgactctagtggacagagaacaggctctggagctccaaatcccccagattctgctcctgtctgctgataggtagaagcaggaacaaaacttactttgaaatgcacagacagaaaatcttaatacaagccccacagcccctgatctagaagtgtcagctgtccccctttggagcatgaactgagccctcaccagctcttcccagagcttctgtgcccctccccagcctcttgctccaagcctgcacttttggcaggaccccctcgaggcagttaattaaaaaatcagtgtttgcctttatattggaaaagagatttttgccccctctgtaagtgataagtgtttcagctgagcctggtgaggtatctggggctggaagagttgcttttactaatacatgccaagaagactgtaatgctgtcttcataaaataaggggatggggctagatgacctcatggcggtgtgtggtggttctgatgctctggccccaagaaccccttgtctccggaagggagttgcttccaaccatctgggcctctttctcagctgttttgccaaaaataaagtattggggttcaccctcagttttgtgaggccttagaagcaaatgccaaggcccatctgtccaggggccatgttctcagggaaatgctgttagctacctacatgccagggtttctcttcctctggctgcctcatttcttacactggcgagggagctgaatgaaagccttctctgcacatacaaagatctgtagactgtccgacacccttctactctttaatcatcagcattgtcatcgttgccttcatctctgacatttgtacaaatctgatggcttaccaggtaccatcaaatatatagtcatttcatttgagacacaagctccccttatggtggagctggggcaggtgtaaacttcattgttttataggaagcagaggcagagg

SEQ ID NO: 89557 - DNA, 1023 bp, Homo sapiens
accaggccttagggaaaaaaaaattgatattaacccctctgcctctgcttcctataaaacaatgaagtttacacctgccccagctccaccataaggggagcttgtgtctcaaatgaaatgactatatatttgatggtacctggtaagccatcagatttgtacaaatgtcagagatgaaggcaacgatgacaatgctgatgattaaagagtagaagggtgtcggacagtctacagatctttgtatgtgcagagaaggctttcattcagctccctcgccagtgtaagaaatgaggcagccagaggaagagaaaccctggcatgtaggtagctaacagcatttccctgagaacatggcccctggacagatgggccttggcatttgcttctaaggcctcacaaaactgagggtgaaccccaatactttatttttggcaaaacagctgagaaagaggcccagatggttggaagcaactcccttccggagacaaggggttcttggggccagagcatcagaaccaccacacaccgccatgaggtcatctagccccatccccttattttatgaagacagcattacagtcttcttggcatgtattagtaaaagcaactcttccagccccagatacctcaccaggctcagctgaaacacttatcacttacagagggggcaaaaatctcttttccaatataaaggcaaacactgattttttaattaactgcctcgagggggtcctgccaaaagtgcaggcttggagcaagaggctggggaggggcacagaagctctgggaagagctggtgagggctcagttcatgctccaaagggggacagctgacacttctagatcaggggctgtggggcttgtattaagattttctgtctgtgcatttcaaagtaagttttgttcctgcttctacctatcagcagacaggagcagaatctgggggatttggagctccagagcctgttctctgtccactagagtcagtagagccacgctagaaaagctcctgggtttcaacct

SEQ ID NO: 89558 - DNA, 1029 bp, Homo sapiens
actcatacagtatgcaaaagacttggaaaggttgcaaacctggagaagttggcaggaaacaaaacaaaacaaaacaaaaaccttgtttaactttttcaactttataatgtttccatgcacttcttagatacatttgatcctgggacccttcagtgacctagcagctgctcaatcctgtggaacaatttgttcctgaaacacatgttgggacctgcacgtttagcaggagatcgggcagcaagacacacacaactctgtttttgtggtgcaccttggccatgatcaagggcgcaggaagcacacggggttggcactgaaccaagctgccctcaattgggatctggggagcgatggacctctgtgacttcttttcactcgggaggtttaggttcctcaagacatgaagaaggggcttggggctgggcatgggtttactcaccaatcctagacaacaggaaaaagcagctttttcagaaggtgggctcaggataaatcaaagcaatttccatttcccgagtgaggggtaaacgtagagaactcagaggtgtgtttttgtggagaggtgggtgtgggtgaaaatttcacaccccacttaggggcagttaaaaacagacctaagaacacagagataaagaaaaaaaaagacacgaaacattgaagcaattgccatgaagctcatgtacttaactctgtggctgtttattggatttctttaatagcttattgactctcggttcacgaggaattctaccagaatcagggtcctatcttggctcaaggtccacaacagattgggaacaactattggagggggaagacaggcttagggaccacagagcagatagctgagaggagtgggcacatacccatcttgtctcataagtcaccatcaggtagtgaggaccacaaggaaacagggaaacatccactgtatttattcacctctgaaggaaccaagaaagttaagtgcacgagcatttaggaaaggtttccaaactgaaagatagagattcaatgggtaaatttctg

SEQ ID NO: 89559 - DNA, 1272 bp, Homo sapiens
attggggctcactcagacacgtgtggcttgctgctcttggctgggctctgtcacatggccttggctggaatgaccaggcagacttggcgttgttctgtgtggtctctcatggtccagcaggttagctcagcttgctcacatagcaaaggcaggaatcttagagacacagagaccaagagaaatatgcaagaccctttggggcttaggcttggagctagaacagtcacttccaccttcttctattggccaaagcaagtcacaaagccagcccacattcaaagatggggaaatagactctacctcttgactgagagagctgcagagtcacatcacaagggagcagaagtgaagaggagggaatggaggccatttttgtagttgttgtctcatagtgctcatctggtcttctggctcagttcctggaagctcgtggcccatcagtgagagagagaagtgaagcgttagtgggttcaggctcttgcagagacattctacctgcccagacacagagcaggtctcctgtcacctctcaggatggtgaactccatgacagtatgggccttattcatccctgagtcccaagacctagcaggtgcctggcacacagtagcttttcagataatagttggtaaatgtgaaattatttcaatttgttttcttgaactcaattcagtggtctttggtaagtatctactgtccactgagctcagccctattgaatccaagggagtcagagattttgttcacttctcggcctggctgtcgggaccatgaaccaaagcttaggcacaattgataggggactgcagagaagggacaccagcagccttcatggtgctggccatgtgcaccacgcctatgtcgggacagctcagggcatccaaggacgggcgtggtggggccctgtctctggaaactcttcccaggttcttggcatgacgtgggttgggtggattttccgctaattgtccaactggctcagttcagtcacatccagctgtgcctgggcagcctggggggttcccctttcctttgcaagcccaatcgctctggaagggtggcctatggctcccttctacctcagtgctggctgtgcgagcgtggcccagattcttagaagcaggaagctttcttctgtcaggagtccgtgaggttggcttcccctgggcccggcctggaacccaggcttggtgttgtctgggagggccctgccggaggcgtcccctctttctgcactccaacttggaggaggagggttggccttaggtagat

SEQ ID NO: 89560 - DNA, 1036 bp, Homo sapiens
aagaatccccagggagctcttgttaaagggcaggctcctgggtgtggccgccagagatcctgattctgtgagttaccacgacacccgggagtctgcagttcaacatggtcccaggagatcaggagaaactgtcgtttttctatgactgacaagataccttcaactatagggtctcctcagaacttgctgctgcccacgaggttggccaagcagaggtagctgtgcttatcttttgggtgaggacagtgaatccttcgaggagaaggtctccttagggtcacacaggcggtgggggtgggactggtactctggacgtccagggcagtgctccggcagcttgggcaaaaggacaaagcttggacgtgggctgcgcttgcatggggatcacgcgggcatcaaaggatgctggggtgctggccccttccctccatcatgtgtcccccgccccccattttaggctgggccaggccatggggcctccagggaatgtgtgcatttgtactgggcctcggcacgtgacctcctgtgaggagccggttttatgggatttgctcgtgttgctgtggttactgatgtagtggagaacagagtcagggggccagggcaggatgagtggactttgatgggaaaacggtgaggcaatgatgggagggtgggctggcaatgagtgtccagtgctgcctggccaggcctgccctcttactgctggggccaccagcgctctaggagcagtagactatagcaatgggaggcatctcatttcacaggtgaggaactgagaggcagaggaggacagtgtccggcccgaggccctgccctttcttcagagcagactcagagtctgtgccatcctcctcccctcaccaggccctgctcttattcttctccttcaggtctggctgtttctctgattttctctctaattccctgagggtggcccctcacaacccacatggcaggtggcttttccaaagcacttcagtgtgcatcttcacatgaaaccctgcaaggtgatcagggcaagtggctcaggttt

SEQ ID NO: 89561 - DNA, 1087 bp, Homo sapiens
aacagcagatgtttataaaaaatcattagccttccaaaccagggctctgtgtaggtgctgcttacaggcagacctgactaaccccagcaggccatggggcaggttgtggagactcagaccacagctgctctctgtgtgtgcacacacacacgtgcagacatacatgtacacacacacacatcacaggtgccacaacatgcatgtacatgcacatatccatgaatagacatatacctgcacatgaacacgttcacacaaatcccacagacacatgctcgcacatgcccatatccatacctacaccatgcacacacacatgcttatacattcatgatcatgccacgtaccacacaatacacacatacacagatgcacgctcacagacacatgcacatacacacagccttgagactccagaagggcaaacacagcacgtggaatcctggtcctcaggtcctcctttgccccagtgcggagggcaggttgcagaggcctctgggaaaggccatatgagtggccgtgttagattcattgggagccatttcacccctaggaaacattttcattttgtgtcatcacagccttgtgaatggggagcgtgcacttccacccagggctgcaggaggatgtgtgagggagtaggggctgagctaagccgcagtcctgctgggcctttattctcagctcatggacactccatcggcttcagataacatctggagccaaagcccaggaaatgggcaggggagggagcagaagccaagtcagcctgtgcgctgctgcagtttcagggcctggtggagtccctgtgtcagtccagagtgtcccctccccaggcctacatgacctctgccagagtttgactgacactcatcgaaatgtgaatacccacgtgagccccaaggcagtgaccttaccagtaagttgctgaaggaaggcgaggcacagtggttcacacctgtaatcccaacactttgggaggccgaggtgggcggatcacgaggtcaggagatggagaccaccctggctaacacggtgaaaccccatctctactaaaaatacaaaaaattttttatatttataggca

SEQ ID NO: 89562 - DNA, 1010 bp, Homo sapiens
ctcctctaaccttctttctttcctgtcttcctttctcatgtatttccactgacgtccaccgtctctttttctctcatgcacacctcccctccccaataccccagagtgctagacagggctgccccatgagcagtgatggttgggaatctaattttactgaccctggctccctctgaaagcaagcagatatccactcactgatgtgatctgatttcaggggcgtgtggaggtcaactcccatggcgcctccactcaccggctgctgtctgaaatcccaccattagaacttcatagcaccagctccttaaaacgtaaccactcctgagaaaagccatggtccaagctcttcttctaaactcttccccatcatcacacatcagaatggatggcttcgggagccaggcttggggcagaacagaggagggcacaggagaaaggggcatcagacgaaacaattctcccaggagaaatgggaggcagaggaataaagctactctctgtcctgtccaccgtattcacagggccgggcttgtgtaagcatactgtgtgttctgcacacctcaataggaaggggccccatcgaagtggctttctgaactgggtcccctccttttggcaccagacaatgctaacgtggtccaggtagccaccctagcatgtcttgaaagttattggggtttgggccagatgcggtggctcacgcctgtaatctcagcactttgggaggctgaggagggtggatcacctgagttcaggagttcgagaccagcctggccaacatggtgaaaccccatctctactaaaaatacaaaaattagccaggtgtggtggtgtgtgcctgtaatcccagttactcaggaggctgaggcaggagaattgcttgaacccaggaggtggaggttgcagtgagcctagatcgcatcattgtactctagcctgggcaacaagagcaggactccatcttaaaaaaaaaaagaaagaaagttattggggtttggagatttgctttt

SEQ ID NO: 89563 - DNA, 1041 bp, Homo sapiens
aacccaggtgggatcctgaaggcactagctgacagacgggcccctcaatcctgtcctctgaaggattgtatatatacctctcgaccacgtaggaaccatgtaggggtctctagctatttctgtggatggcagccggagcatgttagcttaagaaaaatgttgtgtgtggtgctctagtcatcttgtggtggacatgtcgctattaccgaattcgcaccaaatatttctcattgagtttcttgttttggtgcctgaccgaaccaacgacagccccaatcttcccgtctttatgagagaaaaggaaaaaggaatcaaaggtggaagaaaaaaaaagccaaattctgtttacggtgaaaaaggattttgtttttcacccaatttgggaggcgggaggggggggttctcgttttatttttgtttttgtttttaccttggcttttgtttttctcatgtttacagtgcacggagtgtggaagggggtctaggagagggagagctggaaaaggagctgatggggtcttatcctggcctctgagggttcagcggaggtgaggaaggcagcagagctccagcaggtgaagggagagttcatctaggcggggctccccaggcccagggctcaacttcatggccccagctatatccccccagttccacactaaaccagggagggctcggccctcagctactggtacccaatgtgttcctgggagccgagagacccatggtcactccaactccttcctttaggctgtgctcttgcctgtcacaaagaggcaacgtagccactgcctccctatgcaaaaaattaaccagatgatgcagataagacagcataggtgatggctgcttggtcttggccacagtgctctcagccagcactaagggctgaggtcaataccgcagaccttggggaggaagctgagcatcccccgggatgtctccagtcctgacacagtccctcagagatggccctggctctgaggtcacatcagctaggtttgggaggcccctcagcttggtttgggagtgcccgtgttc

SEQ ID NO: 89564 - DNA, 1035 bp, Homo sapiens
gaatgtttgtatggtgcctttgtatcaactggtgtgctccttcccattctacctccgtttccccctgaaggtatcgctaccttgaattgagtacttaatcattctctcattgttaaaaattgttttgtcatatgtagatgtacccctgaacaatgtattgttaaactatgcttgtttagggccgtattcgtttcctattgctgctataaaaaaataccaccaaattagtggtttaaacaacacagattttattatcttacagtcttggaggtcagaagtctcactggactaaaatcaagatgtctgcagaactgcattcctttctggaggctctcagggagaatttgtttcctttttcatttcctagaagctccttgcattccttggctcatggcaaagcccacagtggagtatctttcagtctctttctctgactccaattctgttgccacatactttcttctctctccctggttgtcacatcgtctcttataaagacccttgtgatgacactggactcccccagataactcagggcaatggctccatctcaagatcctaaacttcattgcagctgcagagtcccttctgccacgtaaggctgcatagtcacaggttccagggattaggacatggacacctttgggggctattactcttcctactatggggctttctacaaatggtggcaacttgcttttgcatgcaatatgtgttgcatttctaagatgcatcttcgaacatatcgcatgtttatgtagctcttctcctgccacaggacatttgctcaattcctccttcagacctctgctcaagcattgcttcctcagggaagtcttggctccctaggaaaggagatgctccccagccacctgtcctctaagagccataatcccatcctccaaaggtccagggactacccaagcttgtaactgcattttacaaccagtgatttctctgccccatgtgtctggaacttcagcaaggcctgttggctgtcctagtgcctgataaggagcagaaggaccactgtct

SEQ ID NO: 89565 - DNA, 1417 bp, Homo sapiens
actactattgggtatctccttttgtaacttgttccccccccacccgtgccatttaataatgagtgtcttgctaagtcatcatattttctgctcagtagtccctcgcttctatagtcctgggaggggactgccatgtgaagggacatggggtctcaccatgggtaggaggatgacagtgtggctggctagctgacccttcatgcatgctgtgggaagaagtctagctggttagactattttttaaggacccatgagtttcgtagcagactcctgggctggacattgatttgatatgtttgtgaactaactagtttgcaaaatctcgggtggaaatattactgttttcttggcctctaggctgtttggtaaagacttttaggagtagaagcatttagagttagccctcggtttaaatcttagcttagctacttgttacttgggcaagctactaaacctctctaagctgcatatttcatcagctgtaaatggagataatgagattttctttcttccttcctttctttctctcttttccttccttccttccttccttccttccttccttccttccttccttccttccttccttcctctctctctttcttcctttctttcgtcttgctctgtcacccaggctggagtgcagtggcatgatctctcctcactgcaatctctgcctcccgggttcaagtgattctcatgcctcagcctcccagagtagctgtgattacaggcacgcaccaccatgcccagctaatttttgtatatttagtagacatggggtttcaccatgttggctaggctggtctcgaactcctgacctcaagtgatccacccacctcggtttcccaaaattctgggattacaggtgtgagccaccatgcttggcccgatcatgagattttctgcatgaggcgtttgtaggaattgagaccatttatgtaaagggccgggttcataataggtgctcaaagtgtctctcttctgaataaaccaaacccaaattttctccaagaaataccttggtgatctctttgaaaggaaacaaccacttcaataaataaataaatggataaatgaataactattgaatcagaaccagaccggagcccttctgtgttttgaatggactaagaactggacaggcattttgctttggcttcggcctctgccctgtgagttgtaccttttcctctgagctccccactgctgtggagcctggagagtatgagaacagggtctactgttactcagcaaagcatcgctggagcacttcatgtgtgcagcagagagctgctggcagggccccaaggggcctcctcagcccagggtctggctgggagactaagctgacacacacgtaggaggtgagctagacttctgaagagggaggtgcgtgggcatcatagaagaaggc

SEQ ID NO: 89566 - DNA, 1002 bp, Homo sapiens
cgaatgtgggagaggctccaggcatggacccagcactggaagggccttcttatacccttatttttacagatgagtctgagacccagagagggaaagcaacttgttcatggccacacagcatgctgacagtgtaaactgaaccaaaaatccaggtcctgtctctggtcacatgttcttttcatgccatatggcctgtgctctctcttgctctcctagccaagcttgtcctcggagttaccagtgtcatcccagtagggtcctggggcctcctcacacagcgccacctctgactactgttaagagtcttgagagtcagtaggacggtgatgaagcctcacctgaagcttcttctgggctcagtccttgtcctggagccgctgcctgctatgcatggctgtgaggctgaccccaagtggtggtggttattttaagtaattcacgttggagggaggaagtgactgaggaaaatgtgaaaatgagtagctattgcaagatgtgtgtgataaatgaaacagggaacataaagacagatgaagaggcacatctgttatttttgctcctttttatagcaacctctaagtttgacttttcacactaagtaggaaccctttagttcctgagcaatttcctgacccagtccctcattagctcagtgggagcagaggaggatggagggggccagggccctgagagccaatgtgagtccctagaaaagagtcccccaccccagtcctccaggttccccaagtgtggcaggaattggaggctttgtgcagacgaggtttggtgggctgagaatcccagctcttctctggcttctgcttctcctccctttactgaaggatggtgtggctgacctcagtcagtccctaaacccaagacatccgtactcaggctgttcctagcaaagcagcctggttgcaaaggagatgctttctgtaagaatatggacactttctttttaacatgggacaatactggcattctctcctgagtcatttt

SEQ ID NO: 89567 - DNA, 1017 bp, Homo sapiens
ctgtaatcccagcactttgggaagccaaggcaggcaaatcacttgaggccaggagtttgagaccagcctggccaacttggtaaaaccccatctctactaaaaatacaaaaaattagggcatgatggctcatgtctgtaatcccagctacttgggaggctgagggatgagaattgcttgaacctgagaggcggaggttgcagtgactcaggatcatgaccctgtactccagcctgggtgacagagtgagaccaaaaaaaaaaaaaaaaaaaaaaaaaaaaagtaacaggcattgtgcaaagaattttccaagaatgtctcattcttgcaatggcttctcagaggaaagtggtgttattccccattttacaaatgaaacaggtttaggtaagtttcccaaggtcacagtgaatgagtagtggacttgggagtctgacctagacttaccccaaaagctctctgcgtaaactgaagtgacgttaattagctgtgctatctaggagactgatatgggaatctagacttaaaattatgagaactggtttcagatgatggccagagtaataaggaaggagtggatgctgaagccatttcaaaggaagactcaagattcagtgactgaatataggagtaagggttgagtgcatttttcatccatttttcaagcctgggtaacttggatgttaatggcactatctacagagacaggaggcagtttagagtgaagacgaatcatgtatgggagacagtgatgaatgttaagcatgggatttcagaaatgaagcatccatgaggctcattcctggtttttctgcagtcttttaaataaaagtacaaacctcccttgtcatccatttttgccttcacttatctccattctgtattatgttctagtcacgccccagtcactgatcccttcctaggccatacttggctacatcttagccttttcttttgatttttctcttcactgccttgcccattacaaatttggctgccacctgaggccctgccatacc

SEQ ID NO: 89568 - DNA, 1370 bp, Homo sapiens
tgggatttacaggcgtgagccaccgcgcctggccaaaataaaatgtttttatctttcttcacttagaactatgaaggccttttcttgttctggtaaccccccacagtgtaattggtgctgaaaatagtttcgtgcctgaggtctgttgtcactcactcactttctgacaattaggtgagccacttgaggattttctggcctgaagttataaaaacttggcatctgtcctaaggtaattgtaaaggcaaaatgaaagcattgaggtgaatttaggttatatggcatttatctggtaatgtgtttcagaaaagctagaatgaaaatgtgatgtaagggatagcaagtgtaggttgattcataattcttggtataaaaccaagttttccttagtcttgaggaatttgaagaaaggtaaaatgttggattttaagcaaagtaggattgaccagagactgttctgactttgacattcagacctttcagatgttcttccttcagaccagtccaagacactcagcatttccagccaagttgtcttttttttctgccaataaagtattcattagttgacgtttgtttgtattttaagtaaagtcaattttttttaaagcattaatttaattcacgggtatgcctttcatttctctggccttcagttggtttaaaaaaaaaaaaaaaaaaaaaagcacttagccggaccattctttctttagtaaacatttttattttcttaatttttcctgaaagattttcttcattttcatggaatgtcataatgacactaccattattttctagctctttgcataatagaaaaatgtagagcagtgcaccatttaaacacgtctgacattggatttagtggtcctaggttcatgtgatttgggagccttaagttgttatttagattgattcagcctgattcaccatcttttttactacagttctacatgaatgtggtgaaacaggtagaagaaaattaagcatttctctgcttttggagtctaatgttcctgcctagtgactggtttgtaacacccccctcacccctactttgttaggaacctgcaattcctaaaagaaataaataaagctgtacccaatgtccattctttaatgcttgcctggttgaataatgtttgttttttctgtttatgtcagtagtacatgcttattgtggaaaatttagacaatacagaaaagtataacaattaattgcctatgattctgtcaccagaaaaaatcacttgatatttttgcatcttccttgccattgtctttgctacttctgcatatttttacttagtttcatcattctcagtgtaatttatatcttggggtttttccccgcaacctacaggcattattcc

SEQ ID NO: 89569 - DNA, 1277 bp, Homo sapiens
cctgtctcaatccatgctaccccaaacactccagggaacctctgaggttttattgggtgcactttgaaaatttctcttctatagtgtgtttgtttgattttaaatcacagagaaaactgggttttactcttagagaaacattttcatccagttttttagtttgcttcatttgacttcctaaatcatttttgagttcacaaggatttggtacttttctgtttagctttctctctctaagctttatctaccttaaaaacaaagtcctttttttaatggccagtccaaccaattgatttctcaaactgaagtgcccaggtgtggactcatcaatttccgttagaatagggacatcctacttaagagttggtgcagctccaaggagctgacttgtccttgcttggggttttttttttttttctttcaccttctcaagtttccatggcctttgtgtgttctttttatgttgatttaaattcatatggttttccacaaatcccttctttggctacattgtctccttattcaatggattatccctttgtgggggctgcttattttaaagatgttgggggggaaacaaacccaaatctacgagcagtagttgcacatagttgccagttttaccttcttagtcattagatttccaaaccatgttgcagttttttggtccagatatagtatttctttctaataaagttttatgttgctgctctaaatacagatgcaatatttattgactctgtaatcagatagaaaaaacttaacttggtttgtgtggtatgacttataaagaaatgatgtatatttgttattttgttaccctttagattgtcagagactcccccaatttaatcaacaaagttttataaagtaaatgaaaatattaatagaaattagtttatttacttggttcttataactgatatctctgtgcttttataattgtgatttgtttttttgtttttttttctattttctgtgaacagttttaatgttcggttttggtgttttacactgaaattacatataaatttttaatttatttcatacaggcaacttgcattttaaaaaatacactttgaagtttatcatcttgaaattggggcttacgttgtttatctgtcttgagcattagtactttatgactttggccttatggcaacatcatgattattaatccgtcagcctttaatgtggtcactgtttcttatccagaccctgactttctagtagtttattttgctagcccagatttctgcttaaccaaatataaggga

SEQ ID NO: 89570 - DNA, 5255 bp, Homo sapiens
aatgattggtgctatagcttgtatcacttgataagcatttttgtaatacccttatttggagattataagagaataaatatacttaaattttttgagttataaattcatactggttagtagatattttaaatgtacccactgatattctctattttgcataaaagcataatgtcagactttctctgtgtggtggttatattcggggtgtctctgaatgccagcataaaaattcacggaattgaatagaaattggcctgtcttaatgacctatggtttcttttttaatgttttgaaataattaaagagagtttagtcacacagggaggtctaggtgaactgatgttgaagtttattactagacttttcagacctaaaaattttatttattgttattacttgaatatgtcaaaagtatattactggacaaccttttacacattcctctttctaaaatcgaattggacaattacagttctctggttcagaaaattacattagctcagaacccagtaacccttgataaccctgttagcgcagcaattcccgagtgtgtgctttgtgcagagcgttggactatgtactgctcttgatgtggggacagcggggacagagagctgtcattgaaatagacatctgtttaagaagcgatacttagatgaacctctgtatttctgaaaaataaatgtgaaatatcttaagagcttaagtatgtttttttttttagatggttcaaatccagatcattagctcatcatttttattgcttctcattctgttaagcggcaaagggggaaatatttgttttgactagtccttcactggaaagttttggacttctgcatttgagtctctgggagctagtttttccagttgttttatcagagaatatattcatctttgggttttaaacacttcaaatatcactgatcatggtatagaacttctctgtgacagagtggtaagcacttaccacaaatgttttgtgatttgtgataaagatgatttagggaaataattctggtctcccaaaatatgagacaactattaacaaagcatttttgttttaggtttggattttctttcccttattccagttgatccccaggtatgtatcctgaatttaagcaactaatttgtatttgattgttggttatgtcatactaactaaaaatgaccagttgcataaaatcaggacagtcatctctgaattacttacattgatggaaaggaagtactgtgcaaatatttcacaattttatttgaaggaataaagttgttttcagtttatgatttttgtctttaatatctaaattttaaattctgttttatttagcttaatcagttggcatctcctacaagcatttgaatgattagaatgaatagaagcagtgctgggtggctagaagttaaaattttacaaatacagttttattttttagctaaaacattctgtatatagaaaatcaatagctaaacctgattagacagacttgactcattaacttgattcttcattgtttttaaagacattcagatttggactttggggaggccccagtttaaagttgctatatgtcaatcatccccgttttctctgtcaaagatgagaaaccctagtagctcggtgtcccaacatgaagaccttgcagtgagcctggattgcacagacaggcttatagcagaggcagagcagaggaggagaaggcatgagaaaagtgaagggagaaaatgacatagaacaaaagactttgagaggagttgagtatagggagggatagaggaagaaccacgggtcactgcttcatgggctgctcagtcagctaagcacaagtcctgtatcagcctcctgtttcagtactctgtatctgattacatgaacagcagcagaaatttgggcccaaggtaatgtgcagactgaggaatttcttatcattcggagttgacctcattacagcagtatatataacgaaggtacctagtgaaagtgtctatgtatttttctaggaaatggattcttcagatgtgaggattactaatttttatgtgaccagttcttttaaaaaaaattatcttggaacctagaggtttttatttcatagctctgttttgtatatttagtagtggtctaagttatttggtgagtcagtagtagaagggtgatgtggggccttcagtttgccatagaatccttaggttttactacttgacctccatattatcccttaattcttgtcattgtagctacaattagggatgcagggttagaacttaagtggctgcaatctgaatactactaagaattcaacgcacagagcctgttgatggcagcactgtagcatctagcacaactttcatgaatgagtatctttttcctataaggcaatcaaaaactacctgagaggcagcaggaataaaatgtaagtttctgggctttgttctagatttaccccccagttttagtggaaagttagaaattgatttgattttagaaaagagttttaatactggacaattcaaccatctttagagctccttggaagctctttaagaactgttctccctgtaactaatgtcccttgactctgtatgtggcattcattttattgatgaaccaaaacagttatctatccaaagcattaaataacttgttcttttgaagagcagtctgaattttacttgttgctgtccctctggctggcaacttaaacctgggactgttgttcctgttttattcaccggccttggaaatcatgtagtctaaacaacttgacttaaattcctgttccataatccagtgtctctaatgataagctgcataatctttagaatggggaatatgaatcagatatccttactgatctttcatacagttgaactaatgacaaacttaaaccatctcttgcaggatatcactagacctcttgttttactaaagtcagtgcagtcgtttctcacataaaaatattctatactgatataatgcttttggcttgtctctcttcactcctctgttaatattagagtagtacattcaggtttgtacttgtttgggatcagtaatgggatcagtaaccaggattgtaaggggacttgtgaaatatgagcactaggaaaggggtgttaagcaggcatcacgagaagattaggttagatcttctttaacatttattgcaaaacttggtgattacctgagataattttctgtcctgaggatcctgtgatagctagctaccgtgtagtctgtgttttagaatgaatgttgtcattctgatgacacaagtattttacgtttatgtacaaaggagtccaatgccatcattcagctggtcagccttaacattcataaaggatctgtttgatactcaatccataccgggaaaggctaacaaatacttttaaaaatgttattaagcaaaaatgctggtgtaagatcaacaattctttcaaaattgacacccaactaaatacagttagggagcaaattctttttgagattagggccaatatttagtattaaatgacttcagttattgttgacattgtacttttacctttgtatgtggtcagcaaacaagttccacaagtttagagagaatcaagaatatatgctgcattctctaaataatgtaaaatagctaaattcatgctatcttccacccaaagatgtgaagttttgagcaatttttaaatcccactgggatttaaatatgtgactattgcttgtgcatatctaataatttctagtctctttatttaaaatcaagtagcctcttcctcattggcatcattgtttgtttcaagcagtactgtcctcctatgtttttggatagtctcacctcacccttaacagcaagcagtacgtctgtcaccaccaccagctcccatgaaagcagtactcatgttagttcatccagcagcaggagtgagacaggggtcataaccagcagtggaagtaacattcctgacatcatctcattggactaaaggaggactcacttgattctgggaatcattcatcagaactgctttttcttggatctctagtctgtggaaacgttcttttttttttttttttaataatttggtatttattgaaagtcagatggattcttttgctttctgaggggtgaacacagaagactgcaacaagaaccaaatgacatgcaaggatttttcttaattatgctgtactctcagcatcagatacattcaaccataactgtatcttcctgagagatggatttcactttcatacgttaatggatggagtctacaaatcagtgaaaaaagtttttgttaaaataaagagcaataaaattatgtaaatattcaagtaaccttttttctaattaaaaaaaaaattgtaatcactgattctagaatgacagcaacttctgtttaaccttacgtgaaggaaaaaaaatatatggaaagaacttaatgtttgctgaatgagtcctttccatggagatttgctctgtttcattgaagtaatgaagtttcagtacgtggccaaagcttggattccacttttcgtcctgcatttccacttttcttcgtgattgcatcaaagaaaaatggcattcgtgttacttggtttttttcctgcttatcatttacactttgacgttgtttgctaatgagtgctgtgtgaagttctgggatttggctactcttcattggtgattatgtttaaaagcactatgcagattctgccctgacataaagtgtgttattatgtttttagtaattgtacatttttcattctagagttttctataaatttgaggcttgccttctcaaaaaagaaactatgcagccattgaatgaaatgtctttggggtacggtgtgactggaatgtttgttagaaatttgttcacactatcaaatattgatatcttggagccagcagaagagcagattttgggaggtggtaataacaaaatttaatttcttcccaacaacttaattttctcatttattttacagaatagtagtgaaatatttgatgaaactttgtattttggtagcactacatagaaaatgtgttttagatttatgatgatcatatttctcaccaatgtaatttcagtctcagcagtgattttcaaacttagggaaagggacagcattagattttttttttttttcatttttttaaaatgatatcttacctgaaactacaaacgacaaaagagaattagaaatgtttgaattaaagtgaagaagggttgggggagatgggcctgaaccc

SEQ ID NO: 89571 - DNA, 2898 bp, Homo sapiens
ttttccatgtgatattttctgactgcagttgaccacaggtaactgcaatcacagaacgcaaaatcttggataagggggaatctactgtaaaatattaaggttgctagaattaccttagtatcaggacttctgcaaccaaggccatattacaaaatttaaacttccctcctttactcttcttccctctccatagctattgcttttgcagacatttctgtcaattatatttgagcaagttagaaccagtacattcatgacttcccttctctccgaaggcccttttagtggaatacaattctctcctcctgttactagttttcttctctaggtttatgaagttaattttgacctatgatttattttttttctccccttagtgaggtctttattttaagcacaatgcttatcctgttggtgaaagtttatgttactgaaacaattgataattggctcggtataattttgccacttgaaatttgtttagattatgtgaataaaatttagtggaaaagaatagacattttatagtatccatagaaaaaaatggcttttaaagttattctttgcttcttagatatagttactccacatgtaatttgggagttggtattttaagaagttctttgtagacccagctagcacaaattgtaaagtatttgtaaagtatatacaaagtctaatgccaaggtacaggtgaggattcatgtcggtgacaaagatggaaattcagagattcttaattcccaactgccttttatggctgtaacatgggttgttggaagagtgtctgcatgtcatctcagtatgtgttataagcaagcattctgaaaggatttgtttcctaaagaccttgaattaaaaattaatcctgaaaaaaggtaatgagcatttctgttcattaaagtgatcctaccatttagcagtagcatagacacaatttaccaatcacttgccctgttagtttttcagttctctgaacctggattaatttttaattgggggaaatttacattatttcagaatttgggcataaagtgagactttatttctttttagaaatgtgcaaacttgagaaaaatgcagtaaaatatgtctgaactggctatttggtaaaaatgtgtttcaagctgatattgagcaaacaagactaatatccaaggctgatatttagccagtattaacagttatggtgatactggttgttattattgaaaagctttcttaccagttgataactgaatagaataggatctattttgctttagaagaattgctagtttatcatcatgtatgaattatgtagcagttactatatctaaatagtttagttttactttgattttattgttaatgtgctcttttgtgattagtaatttggttttatttttatgcataatttttatgtagttagtcatactgtgaagagttttggtattgataaacttaataatttataataaaatattaaatagaacaccaagaatggagagataacaaagttttaatacatttcttaacattccttttaaacatcataaacatgaatcttctgaatctgcaggagaacaaagaagaaatgatattaataatgaactgaagcttggaacatcttctgatactgtgcaacagtgaatacaaaataaaacaaataatttgtatttatggagtggaaaacagcttatttcaaggaaaaatatgactgccttattattgctagtgccatattgtcaggtgcgaatggtgctcaaaagttgtatcattaaaatttgaaagtgctaaacatttacatatttaatcatgtagcagttatgttttgttaaaagtttatgactcaaataaggaaaatgtgttgtcatcaatgagaaaaaatctaatgagtcaatttcacagtgaagcacttaaaatttttaaattaaaattttatcagtgttaataaaataatgttaacactacctgctttttagttaaaagtaattgagcattttcaaccatgaaatacttcggagggcataaaaatatatcagtatgacacgctgcagttgaaacttatggtgaaataagaaacagcattttgctaaacttacgaaacaaggcagtaaaattttaatcactactgatgaaacttgattttatataagagttttaatattctgcttaaaatgtaaaatgcaagaagactttgatggtttcgttttttgttagaaagaataacatctaaaataccatatcaaacttcactgttagtacttgagaaaaaaatggtttcagtgagagaaatatttacattaaacaggttttatatagacagcacccttgtaatgcttggtaaacaatctagaattccaaccaatattttagaaaaatttctaggtattttattatggtgttgtataagtcaccacattcaattttccgtggatgaggtatcaatatacagataagtaaatctcttaattgttttctaaataaactttatatttaccacacacatgaaatcatcaaagagaattacagtacatctgaagaactggaattgaaataacaaaaataggatcctcagtgggtattctctggtgatagagcttcaatttttaatttcaattaaaataaataggcttgatataattttcaaactgttttatatcaagcttgcgtattttaattgaaattctgaaattgaaatagttgaacatttagaaaatgagcatttttgagtggcttggcttcagtacacaatattccaacaccattgtcaatacttagcgttataaaaaggtttcagttactaacatgaactgagagatacagcaaatattaaagatgattgaacatatgaaactgaaaaactataaaaaggtagaagctattgtaaaaatgaagaaaactgaaaaactgaaa

SEQ ID NO: 89572 - DNA, 1693 bp, Homo sapiens
ataagcttcctaaatggatcagtttttgatcaaagatttctgaactctgacctgtgttatttattcacttttctgagactaacatagttgccaactcaacaatgtatgtactctcaagatgactgttttccacatttgtattgatatccatatttaagtggtttgacatttaaattgaggttatgaaatagttttccagagtacaaagaatgtcatgcaatttgtcatcatttctcattactgatatttaataatcagcaataacaggaaagggaaaggatgcccagaggttatcccagtctagctttgtgaccatggttcccaccatcaaccataagaccagtaacagtgctcagtttcctacatacattcaaggatgtctttcttgtgaagttgtagttgtttaccctgggctaagagaaaatgcaggttaaataggaagaatgcaaaaaaaatctctgtttaagcttgaactttttcaaaagtatgtttaattatactgcttcttgaaattataaagtaattctatagtgtatatacagttttatataataccaattgtgaagtatttattacatatgtttaatttgtatttttggtagcatgaacagctaattttaaaatcataaactctcttaggatttcacctacctggtaggtgctatcatggtagccagcatttttatttctggatattatattttaaatcctgaacactcatcctcgtttctgattgtggcctattgccatcaagttggtcggctttaagattgggtaattttgctcagatgattcccaggaaagattgcaaataattaatacaattcgagttagacttgaagaaatttggattgtgctacagtgagtagcttcacttctcaaggttccctgatttaaatcaaaccttagggatcttctatgttagttttaaatttctttatagataaaattactgatacccatatacatattacatacatattaataaaagtgatgtctatttctatttgtggatggaagtgttatatctcactccagcactgtacattgtgtttgaatgtcaacttgctcttatgtcgcagctgctgttgagagccaagatatgttcatgttaaaatgaagactattatgggagaggagagtagagtggagtgctgtgtagtgagtagctgccatatagttgtgctgaaactggtgaacgaacgactgagaatgcccagtggtgcagctcttctctcctgtgaactaacagccagattgtttgtaatttcccgtgctatttaaaacagggttctcatgtatcagccatcttctgtaagggtgcccagtgtgacttcggttgatcctgctgctattccgccttcattaacagactactcagtaccattccaccatacgccaatatcaagcatgtcatcagatttgccaggtatgtggagtgtttttgtttcttttgttttttaatgaaagtttattttttttaatcttaatctgtgaagccagtatagttttgaaattttcagtagaggtgctaaggaaatttgaaagcttcgggtaaaggtcttatctgtttttatacatcacatccagttgttattttaactacagagcaatctatagattcctggtgataagaaatatagtagaataggaaatgttagagattttattcttccttttgaagaatttgtac

SEQ ID NO: 89573 - DNA, 6811 bp, Homo sapiens
tatatagtaacctttatctgctgatgtttgttttttgtgctgtgttagaggttgttcttactgccagcctcagctaggaggctccaggtatctacttctctctagccatttatactcattgagttacacaggtgatgctcagtaagttacttaactattatgttgcctgttacagatttaaaacataggacaaagggagtgtaataattgttgtaaagtataaagtattgcaataccaaaagaaaagggggtcagctaacattacttatgttttcaaggtaatgtgtattactttcttatttcacctttaggcaaagctgttgatcacatgtatgtacttcttaattgttttttaggctttttatggaaattctcaatgactgttctgatgtagatgagatcaaattccaagaagatggttcttggtgtccaatgagaccgaagaaagaagctatgaaagtatccagccaaccgtgtacaaaaatagaaagtatgtgtagaatagcagcagagagtaaagcagtgagactcgtgcaacattatcattaatcttggcccctagaactatacgtttggaattcagcttgttgactcagtcttttgatgatatatagttttcccccaaatgatttttattctttcctgaaggaatgtgctaaagtttataccatcttatcagctatttcatagtatatttttcctgtgtagaataaaggaaacattcatctaaaatcattttaaaatatgatgtttgttacaaaacaaaaagtcacaaatgaatttatatggacagtttttcagaattgttcttagagtatctgtaggtggaaccctaggtggaggtgaggttagagaggctgcatcattggttaatggccttggtggtttggggatggtcacaggttagttgctcagaaagtaaacaaattgttaccttccatttctttgtggagaagaattttaacattgccttgattacctagaatgtatactcatccatcaactgcctgcatccatccacactaagtagggaaactgagggcatttggagtaattgaaacgcacaggtgaacttagagtttctttttatctaacagtctcattgaaacccacacgtgaacttagagtttctttttatctaacagtctactcactgcatttcagttttgttctgattacatttgaagttctaacaaacaatgtaatgaatggagtaagaagaaaggggaaaaaataaaggatttatgccattattaattattcctctgcgattgacactaaacctgagtgcagtgaccaaggtttctctcatctttcagaaaaatggggagtgatttagttgataagtttctgttgcttttccattatcaactgtcattcatttttaactaaatacattacagataataacatacttttctgtgaaaatgtgagttaacaaatatggtatgtgagactgtctttgtgggtagaaagaacctacgtgattagcagataattcataagaaaagtttaaatgtcttagtaacttaattgagaggtttgggtttttttcaacttatcaagatgaaagtttttatcaagttctggcttatggtgaaaagtctgtactttctttgatataagcataattgctagaatggaaatatctggttctgagctaactgtgccacatgtgtgcgagaatacatagctgttgaactcacccattcttgtcccatgacctgagaccagttccctaactctgcgtgtctttctgtaaaacgactgctgacctgcagagacaggatgagcagtaggagctgcacaaatccttcagtggtattggaggcataactaagaacattctgtctgaatgagacttctaaccatctgtcaaggaatagtgctcacctgtctccctaggtgaacaaccattttacagacagaggtctggagttagggagttggtatttgtccatgggttggagtatgtggcttcactggctatatgttgtcaggaacatactatactgaatatactagactctaccactagagtttatttgtgttatacctttaatttttttttccttttgtttctttacatgcaggttcaagcgtcctcagtaagccttgttcagtgactgtagccagtgaggcaagcaagaagaaagtagatgttattgatcttacaatagaaagctcttctgacgaagaggaagaccctcctgccaaaaggaaatgcatctttatgtcagaaacacaaagcagcccaaccaaagggtttgttaatttatagttcactattgttcattacccttgcaactaattgctcttggatagatttataaatgtctctttgggaaatggcataactgtagaaggctattttaatttgcctttgttgagttgaaatattttcgagtaagcacattgtttataggaagcaaattttgatggagaaaatatttacatctttggaaagtgagcgtgtgaggtatttatttcctacctgagactttttgttattttcttgaacctgtttgtaaggaaatttggcatctcagaccagatgagaaagtctggtgtaatggagtgtggaactgggaatctgacaagtatggattccaattttggcacaccatcgcttacttgttctgtgatcttagatgaaatacttaatttgattgagcctcttttttgtgttctgttaaatggagctaaataacgcctatattacaggatcattttcaggttttaatgagatgaaagaaagcctcggtgtcaggcatgtggtaatttcccaataaaaattgattcctttcccttttcaccctctccagggcaaaatataggtgggtaggatggcattctacctgaattttagcgtggattctctgtaagttatctggcagaaggcattactgacctgcattaaaaatcaggtttgggtatttaacaatagttgctttttcagagaggttttgaaccataaaaggagataacaggagagttctcctggctgtctacgaacacattctttcaaacttgggtttgctagtgtcatctttttggcctcttggtccacttggttttctaatggctttactgagttataatttacatagcataaaatgtacccatcttaagtatataatggcacaattcagtgattttagtaaatacatagagctgtgcaatcatcaccatgattcagtagtagaatattttcaacacccaaaaaactttcttcatgttcttttgtagtttattcctatttacaccccaaatctaggcaatcgtttttttgtgtctataatgcctgtttagacattttatataaaatgtcttgttttgcaacattgtttatttttataattttaagaattaaaccttttcagctgccttctttgctgttaaaatacttacatttccaaatataatttacacatatattaaaggcatatatttacttctacccatttaattagaatgaggtggggtttttgtgtgtgtggaacaaaatgaggaagtatttcaagtggattttttcctggtgtgccaatcatttattgctcctttgagacaaattggttggtacatctgtaatttaaatgataaacagaaaatgaagttataattttgaaatggttacgttcaaaatgtattttgaaggggaatgaatgcttagatgtgatgtttctggattttactctgtaatgatacgctttagaatatagtggaaaaacatgagttgcaagtactgcagttggctgaattcatgccaggttgagaggtcatgcctagtgatgctgactcatgagttgttgtgatcttggagcatgtctctggtggcatgccacaagggtctaccctctgtcctttactacatttttatctgtgtttgataagtccatgaaacaggagggatggcacatacacagtgggcgacaaaatctgaaatgacctcagtatgcagaggaataaggatagtttacatctgtgatcagctactatagagataaatgttaaggttcctcatttaggctgaaaagaaaacaaaaactaacattggtaagtataagatagaaatttgtgactaaaccagcaacacatgaaagtttattttaaaagtctgtataaagcgcagctacctagttcgttccatgaagctgatgtagcccttaacacccaacctagacatacatacacattaatacacggaagaactcttaagaaacagactcacatagaaagataaatgaaaattctgaattcagtcttaggaaatcatttaattatatattaaaatgacatctgtgaccaactagagtttatcccaggagtgctttaatattaggaaatacattgataagatggatctcgtcataaggacaactttgtagtcatcttcatggatgttggaaaggccttcagtaaattaattgccatttctgatagaaactctttcaaatgtcaggtttcagttaatggtttgaagagttcaccactgaaatcagtttgttcttagcattaataaaataagcatagtgtccaggatccataccatgccagttttgttccattttaggctatatgactctcagagcatttcagtcagtgctgatcatcaagaatggtattaacaaatgagtatggccagagcaggggaacgggaaggtgaatagtggaatctggagcaagatggatgagtggatcttaaggactgaagctgttaaaccaggagaagagattatttgatacccaccttgtagttcttaaaagggagacaatgactagctggattaagtttgttctttattaccagatttaggtccagtggactaaagatacatggataaactttctattggagctttctgaatactaggaaatttaatcttttgtcccaaaatcatattttctgtgttagagtggctgccacctgtcacagtgtcatagtggaggctcatgctatagttatatcatctctgtgatcccctcctactcttagacttttgtgactttgttcttggttgtccttttcatatcctttcttgtagttcagcatctagagtttttatggttttcctgtgctgtgtaagtttatcataggatttcttggccatcaaagatagtaagcaaatgagaaagaacagagaatgagaaatcaggaaaacttactctaatttacagccccgaaattatgtgagcaactatttttttttttttttaattttttgagacagggtctcagtttgtgacccaggctagaatgccgtggtgtgatcgcggctcactgcagtcttgacctcctgggttgaagcgatcctcctgcctcagccctccaagtagctggaactaccacccccagctaatttttttgtgttttttttttttttgtaaacatggggttttaccatgttgcacaggctggtctcgaactcctgagctcaagccatccacctgtcttggcctgccaaagtgctaggattacaaaatgcataagccaccacgcctggcctgtgagcaactatcttttaagaggtattattattttagtaaaaattattcttataaacaattttacaaagcaccaagaagaaagcaaaaaatatctcacctagagagaatcattgccattttgatggcagtcctattccctttctttgcttacgaaccggagtctttaaatgcagtcttataatacctgtcagaagaaacttgtatgttaatcttaagacatttagaaaacctctgatgtttttccatattaaaagataattttacatattgtgccccttctgaaaaatgagtggttgctttgccttaataagaaggtattctaaagacaggaaacataataaggataaatctatatgtctccagattgataatcattaagaattggtagcaaaattgcatcttttttatacttttatgatcataaagtgggagcatacagtgaacttcagggttataaatagaaatggtcaacctattttcagacatccaagtctgagcaaatgtgagtttcatgcaattctctgatccagcatataatccggaatactaatatttgctatatagcagcattctagcaattcacttttgtgctgtgatattatggataaagttacaaacgtttaaaatataaatggtcacttgcataatgtatacacgtatctgtgtgtgtttaccaatcctatgaagaggcagtaacaagttttaaaagctttaaatctttttattaacatatagcatcacatttttacatccatcatttcaccatccatagccatttacattttttcatggaatctgttactcatatctattttttgcataggctttagaatcattttgtttctgaatgtggtctttgtgaagattttgataacaaaagcctgctcccagtatgtaatttgataatcctaactaatgactactttaagccattctatgtaaagttgaatttgtattaatggttgcaacattcaggtaatgggaattaaccaacactaagtagtttagcttttcatatgtttgctgaggttttagatgttgatttactaatttgtaccgccattggattttcacatttcacatgttttgacagtcaaccttttggtgttgcctaagtaaggagtagctatttactcatttaaagtttcatgttactaagtgacaggacacgtacagttattaggtgttactgtagtgacagacaggtgtgtaggtacattcacttgactccttttatagatgtaagtcaaagggtcagggaaggaaagggagctctgttattgttgttacgtgtaagtctatt

SEQ ID NO: 89574 - DNA, 1240 bp, Homo sapiens
ataaaaatcttagaaatattcattacagcattgtttgtagtgataaaagattgggaacaatttaaatgtcagtcattagtgtactgattaaataaattatgataccttcatataatggtagctttttatataccgatttgtgtgcagtagtcaccaagttatatgacagaagtgagttggaaaacagtgtgtattgtatactatcattcctgggaaaatatttctttaaatacacacttggtttatgcttagaacatctgtgaaaggacatgcaagagatggataacagtggttctctaaatagggaaactggggaccaggtaagaaggagtcatactttcaatgtatatgaatctggatttacatgttaacccgttttgaaaaagtgaaatggtttttcaaaaatcatagggcagtcaatgaataaaaatatattgtaatcttcttgggaatacattctgatttggatttctatttcatttttatcatcttcttgtatgacatcttccgacttttacaactgaccatgttccctctgagctcattctcctttctgaaatagttttccttgtgtttcctgtcctgtagttaggaaaaatgaggctgacaatcccatgccgtgcagtgacttgtacacatctgcagtgttttgatgctgccctctatctacaaatgaatgagaaaaagcccacctggatttgtcctgtgtgtgacaaaaaagctgcctatgaaagtctaatattagatgggtaagtatatcccttttaacagctgatatggactaatacaacagctgttggcaatgcctttgttcactacaacttactgaactaaattctaaataaattctactctagcataaatccagatgtttgtatgttttccgtcttatacctaattatactcaatcttattttttaaactgtggttagtggcatttttatctctataatatgatttgcgttgagggcaatgtttttgctttccaagattatattttataaagcccacaggaaagagggaaaagtttgctttgtgatgtcattttgcttacctagaatttcttgaagtagcaattagggtctatgcaaaaaccagaggaagtgatagggtagatacagacatagctcttaagttcaaaactggaattcatgcccaggtatttctgactctggagtccaaactttaagcatcatctctcatattatattgcatgtcagaatttggaaaatgacatgaa

SEQ ID NO: 89575 - DNA, 3240 bp, Homo sapiens
cttagaattataatattttctctataccttcaagttgatgaacttgactttctgttgatttttggtcttataataaattatgtcaattttgagataccagttaatacaacaaggaatttacattttagaattacttgtttatataactgaaataatgaatggaaaggagatttcagttaatttctgaccatcagcttcagtgttaatattacatgaagcatcagtttcagtgttcttattacatgttcctaaacagaataatattcctgttttatggatggagaaattgaggcattatttatagcaggaattttttgttttaccaccaaggtaattgcagagctgggagtaactttacagacattggaataaatgattgtagacattgaaaacttttgccatgtaatggggataatactcttccttataattaaaatgattaattgacctagaatttacaccataagttgggtatttagatatctaaaagaacattaaaaaatatttaaaatacttggtttggcagctattaaaagtatgatgtttattgtagaatcaattgaatgaatatatttaataaaatgggaagataggttttttttttttaacatttatgtgaaattatattttgtctgttcatagctctataaatagctaatgaaggttcctttgtgccagatctaacaggtatgggattggacgctgttgttttctggcttgactttttaatttttatcattcttcatgtgtcttacatactatagtagctgctgcttgtcaataaaatacccatttggggtacaggagttaatttatcaaagctttcctcagaagaaagctgatacctggttcatttgcgtgatttactcaaaggccatgtagtagcaggtggtttcttctgccagaattagaactttggaactctggatttgcagtgttaattcagaccactggcctttggaatttgtttctgcagtggaattcctcttttaagtgaaaatatgagaacctcattacataaagtcgataaaagcagaatgattttggttagcaagattctggttagtcataggagggtacattttcagggtggcccctaaggtaccagttttgctaaataagaaccatagtttggaaaccattgatctaacctatattcccataccagcgaatgttttaaagtgataaatgatcaagaaatacctttaaaatgattgagcttttattttcagtgaagtagcttggtgaattttgtccccttcgcagtgattgaccattccatggaagttattttgaatgttatttttagaaaccagagtttcttaaataagtatttcatgtaaacaaagagaatattatctctcatctttaatgcaggttttttttgtttgtttgtagaattactctatgtctgtatatcttgtacggcagcttacatcagccatgttattacagagattaaaaatgaaaggtattagaaaccctgatcattccagagcactaagtaagtaatgtttaataagaccaagcatttaaaaaaaaaaaaaaagattgagcatatgagatactttaatgctttaaatattgctcacatcaatatattagtatatatttgttagcttgtgtatatactaatttatatacattactggtgagtaaaattgtagacacattaccacatagtagtttttaattatcaaaggaagtataaatatttttatcttttctgtttacaaatttaataattgttggaaacaaacaatagtgcataataaaaactgtgatgaatgtgtgttggaaaagctttgacgctcagggtactgctgcattccagcttcctctcctaattgttgttttgttcttaagtcttacatagctttctattttgaaagtcttgcttgccagcagttttacttttaaaaagaaattttaagaatttaaacaaagaaatttgcatgttcataattctttaacttatattgggagtgtgatcgtgttgtcaatacattaatatgtaacattttgttttaagatgctatatatttctataattccatttctttgtcacccttaatttttttaaatttttttttttctcttctttttaaagttaaagaaaaacttactgcagatcctgatagtgaaattgctacaactagccttcgggtatccttgatgtgccctgtaagtaaagcaacaaaacattttggggaatttgactttttataaatgattaactttcctataaaagtaagtgtgggaatgaatgatatattatgaagaatgctgaacttttgtcttttcccattaaggaatcttcatgattaagtcacaattctttgtattatttgggcatgcaaagaatacaaagaagagggaagatagctttaggctcagaataatctgttgtaattaatgttgtagataatatacagctagtaataaaaatatattaagagctgactccttttatcagaatataaatgatactgaaaaatagcaataaagtgactagggcctgataaatgctaattgatggtcttagtttagtgagttaggatgtgtaggatgtctttgtaatgttcttttaaattgcacaataatttttcttttatatctccttacatagaaagtatgagggagaaatcagtcagcaactctcacatcctcctgtgtacttgccactgagctaattgtgggagaaaatattgaggcttgcttagaatgttaataattgagtttgaaaaataaaaccaactcccataaaaatggtgcagacttcacttacagttaggctgttttactaccaagaggagatgggagggtcaggagcagtgaatgaattggaggggaaccctttccggttaagaagaacttaatgagaaaaagtcatggaatcaggaatttataatgtagttttgtgggtatttgatgactacccaccattttgagaaatgtgcagttttttaaatggggagaaattgtgtcagaaaagagaatgatttgttgagtctctactgtatgttcttttatttaactgtcttagcaaacctgtgtggaggagttgtcttcattttgtagatgaagaaactgagactgaatgaggttggctaacccaaattacacagttattggtagaacaaggataaagattgtagtgttctgatattcctgttctttttccaatataccatgctgccagattgggctgaaatatacatgtcctgattacaagtacat

SEQ ID NO: 89576 - DNA, 1139 bp, Homo sapiens
tccttatttgttaacttaacctggtttaaaagattaccatttctgttccacccagagaaaaggcagtggaaaatatttttatcactcaccagattttaaaaatgaaattcattagtttgttctttctttcccctcacttcccagtttggtttttttctttcccacctccaatatgtgcatgtattttgaatggggactgctaaggatgaatcgttataaaaagttgtgactttatctgtaaagcttggtgtcctatgaaaaaggaaaaccattcatagccaatgtggcaagatgtcagcatctttaattttaatgttggaacatggatttttttcctacctttctggacttgtgaaatattttgtaaccttttttcaaaggttattttcctattttgggttgataatgatcataagggctatatgatttttaggctaaaataaaaatagtgtaactgaaattgggcaggatcctgtatctatcttggagaaaatgtttaatcttcctgcagatgatttgaaataatttttctttcttacggttatagggctatgcaccaccgcctaaaaatgggattgaacagaagcgccctggacgccccttgaatattacatctttagttaggttatcttcagctgtgccaaaccaaatttccatttcttgggcatcagaaattgggaaggtaaaagctctccgttttgggtagcaggacagtgaccccactgagggttgactttctgtgttttttcttaagctgttggcttcagctctttctgtttttggattgtaatctctaaaaagcagtaattttcagtttagaggtggcagtgtggagattcttaaagttaaaaactttaactctgagctttcctgaatatcatctctttattttcctggaaaggaaatatgcatatttatatttcttaaggtaatggtttaaccacaattgtatgtatgtttgtgtttagtattttaataaactagaagctttggatgataaatatttatgaagaggaacaaagaaagttttatccgtttgggggagaaatggttaaatgtacacatgttgtgattagaaataatctgttctagcctttctataaacaactgatatttcagataacctgtaagcatttgta

SEQ ID NO: 89577 - DNA, 1622 bp, Homo sapiens
agaattaccagtaaagtcacactactcaaatgggatacagaatagattgaaaacactttatgctgagtgagactaaaatgattctgagtttgctgacacttcattcttacatgagtgttactctccctgcttctgttgcccttttctactgtgtcagacagtgttatgtcttaaattctaatttccagagtgcacattttagttcatgagttatttctatccttctgacagaccctgtaacattatttttatttggttaacctaccagtggacataccagcagacagaattatcttccaggcccaaaacaggcaaaacaaaagttttgttcaaaattacctagatactggtgttgatactccttgtgcttgatgctcattgaatcagctccttgagtctttatgagaggacttttcttaggagttgtttttttttttctgagcaactttttttttttttcacttgagcaacttaagatgggcataaccttcctactctctctctctcacacacacacacacacacacactgtctctctctttcatttccatattataatgcaagttattgaagttcttctctttgtcttttattcccctgctcaaacgtttttaatgattttcagaattttgttgcaagttatagattacacattatcatgtggactaccatttaataattactgtcttgcctcttatgagacagtgaagggtgttcccaagttgtggtagacagggtgtgttcctctttgcttgtgatactaccagtactagttttcattggtcctaaggtgcatattttagcattgccgaaatccagaagtgtcttaaaattgctggtgaccaggtgtcagctgtgacgtattatcattgcctgcacctgtgcaactttgatgttattggcatggcgtgactggttagctgtactccctggcttttcagttaataaataatttaaggacattttgagaaagaagcatgaatcctggctgttgtctgaaaacttttcattgatggattctcataagatccagattgtatccccattaacacatccagttaatggtgtcagtgacttgcagagaaatctgagacattagtggaatgaaatacagttttaaaagatacttttctctctaaaattcctgcttgcacataggagagtgtcatgtggaaaaatgtatgcattaatgactgagtgaaaagtgattcagaagtttcttctgtacaaaagggaatatgttaattcattttgcttccatttctttgccatatatacatagtattttctctttctcaatagtacataattaaattacatcactgacatcctagcatcagtgaaatatggtatctacttttcaatatgtagattttttgcagctaagacattttaattttctaaaaaatatattattttggctctgaaaaatcagagtgaagtcttgcggtaattgggaattggatatactgcgaatcagaaatgagtatacttgctatttaaaacgaacagttggccgggcactgtggctcacgcctgtaatcccagcactttggaaggccgaggcaggctgatcacgaggtcaggagatcaagaccatcctggctaacatggtgaaaccc

SEQ ID NO: 89578 - DNA, 4413 bp, Homo sapiens
attgatcacctttcagggaataagaaaaatacaaataatgcttttcctttttttcctcctggggagactgttctgagaattctcattgtacttttttaacccattttctttctctttccaacagggattttttgccaggtggtaggagagattatacagtccaagttcagttgaggtgagtttgaaattttctgttaccttagttttatacttgcttactatgtgcatgtagttctgaattttaaaacatataagaatgtttgagcacactatttaagaatacttttttcttttattaatgcagactttgcctggcagagacaagttgccctcaagaagataactatccaaatagtctatgtataaaagtaaatgggaagctatttcctttgcctgtaagttgctttttattcaccagatttgcatataagtttaatataaacactgacaaggcctagaaacagtgcaacagtgacagctgaataccagtgaacagttttagcatccagattaaatactattttccactagggtaacccatggcttcttggataaataataaatggcttatttcaggtctgaaggagatggaaaacataagcctggaattttttttttttttttttttttttttttaaagagacaaggtcctactgtgttccccaggcttgatttgaatttataggctcaagcaatcctcctacctcagcctcctgagtagtggggaatacagttgtgcaccactgtacctggctagagcctggagcatcttacttaagaaatcaaggatgctgtgaaacactcttgggatcatatcaaacagcatagttgaaggggaggacttgggcactttcatgtataggacagcatgtgtgggatgtctgcattagctgggcctggcctgtggatggcatggggaaaagcagaggctgctgagagtggctaactacagagatcaaaaattcccagcttgggccttgatgatgcattcacttgtggtgggtgggtgcaataatagttggttgacaacacatttaagcagtgagagagtatatgggcttcagcacctaggatgtatacaatgtaaatgcatgcagcctgtctctggcctaatagatggcttttgactcttcaaatcctgatagtcaagtcttaataaaataaaataataaatgtagaactggactatgtattggtttccattttggatacattactaaattggtaccattctgtaagaaggccagcaaagccataatcaaaaaaatagtacaacatggcacgtttgtcaagcactacaaagttggaggtgtatttactgtaactgaatcactaagagagcagtgactccctgactaggcccagttgtcatttcaccagagctgacactcttcgcaactattgaggaaatggggaagctgtgtaatatccctgctgaacacgagactgggctctggactaatatatgagcagtactcacgagtagccaagcaagtcagacaatatgatctaggactctgggctctccagagccaagtgctaagaattgggccccaaagtgaagaaattccatgactgagactgaccctggtcttgtggacagagggatctgacttctcttggttgtcaggagtctcatttgtcgcatacacagcctgtggacttagagacctgagaaatacttgttttgtgaacctttaaagggcttgagcaacactgcatcactgacgtgactctttttgaaagatgcatctgagactgaaatccattgagacagtcctgggagtgaaggggaattgcagaggctgagtaggtatggtcaggggggattgcttacatggcccatacatgtttccccgggtgggacatttagtttgtcaggtttccggctactagcaacaagattctcaggagctatcctttttttcccactcccctcccatccccacccaagatagagtcttgctgtgtcacccaggctggagtgcagtggtgtgatctcggctcactgcaacctctgcctcctgggttcaggcagttctccagcctcagccttctgagtagctgggattacaggtgcctgccaccacacctggctggtttttgtaattttagtagggacagggtttcaccatgtgggcaggctggtctcgaactcctgacctcgtgatccacctgccttggcctcccaaagtgctgggattacaggcgtgagccaccacgcctggcctatcttttatttggctagtttgcacaaagatctgaaccaagggaagaagcagccctacttggagctgaaagataccaatgggtaactgcatgtgtgacaaagaaagcctggcaaaacagattaatacacaaccctgtgcacctgtcccatggccttttcataaccatttttctttgccctagatgtgctaagatttcattttttcctttttttttttatttaaaaaaaaaaaaaggctctcaggtctgttgcccaggctggagtgcattagtgtagtctcggctcactctgcagtcttagcctcctagaggctcaagcgattctcccatctcactctccttagtagctgggactacaggcatgcaccgctatggctggctcatttttgtattttttgtagagacagggcttcgccgtgttgcccaggctggtcttgaactcctgggctcaagtgatccacctatgttggcctcccaaggtgttgggattacaggtgtgagccactgcgtctggctgctaagatttctttgacctttgactctcattgctatttgcccctcccattatctgtgatgaaagataagactatggagggcttcttggtgtctgtggactcaccttgaaggcttatcctgtatcatcgtgtgactgtgccagtgatgggagctgcatctgaaatgtgtgaggttgtgcctaaactctgtggcattgctatggaaaatatggtggctacagatgtgtaaacatagacgttaccagaatttccaaatggaccagtcagtgtcacattttgggatgataccttcctgtaggaggtctacagtaccactgaggatggcttggagtttgttactcttccagttcttttgagggagaagaatttaggcagttgagtacttcctctggggcattgttacttagttactgctgatttctgtcccaaagcacccactaacccctgattacttgtattagactatttgtgaacatattgactactacataaagcagcctttgtctgatgagtctggcatccctggagccaggggcctgcagcagctccatgggcagttgtgaaggaggagaagaaatagagcattgagagaaaggcaaagacatattttcaaaaatagaaggcaatggggaggatttgcctgacccttatagggccatcccaaagaaaatcaaatgcctgcctttcccaaagagtctttttaccctagctccgtaaagtcctatagaacagctgacagaaattcacatgcgcatctgatggaaaacatcttaaaccaccacttgatccacagttgctattgattgggataatgaaatgtggagtctttttaaatataaaacaagattctgcagtttttaagaattacgtgagtatgctgcagcctcagaagaagaaagctgctgtggccctataggagttatagtgagctcttgccaccatggagagcctcagggactttgttccagttttaagaagcatcaacaagccacaaaagaaatttgataggtggtccttgcccgtgatcctggtgtattgaaccatgaatcctggagggaaaagcttgacacagtcatgaattgcccattagagctctgaatatggtggcatttgtctgtgtcctggaagaagtccttatgtgtatgatcttactgtaatacccagtctttatggacccatggcagttgaccactatacttcatgtacaaagtaaacataggaatgggaaatggtattactttgaaaatggcaacgtgtccctagactgttaaggatcaaatagtgatgcaagcagcatatgtgctttttaacctacatcaagatgctgagttttacaaaacaccttcatgcattcattttccaggttcccttggtgcaaggaagacagcagctcatagtagggcttgtgggatggtgacatgcagtgtggacagacaagaacctgctgcagagaccatctcccatctttgactccaagggctgccagtgtacagactgacagccagatgagaacattccatgtttttaatgggcagaagaaagaaaaaggccctctttgtttagggagttattttaagaagctggattatttttcttctaaacaatttgtgagaaatatctataaatcttgtgtagctctaaggttgaagaaaggaagaagggttgacaa

SEQ ID NO: 89579 - DNA, 1871 bp, Homo sapiens
gcacctttgccgccttttttctctgtactctgcctggcaaacttcttgagtcatgtttcaagggccagttcaattcatacgtcccctgtgatgcctttccagatttgctttaatgtgtcatttgtctctcactgtgccatgtacttattttctgttaaggcatcattgcatttatttcactgcttgcatttgcaaccttcttaatgaaagcagcattcttctactcatttttatcacctcacaacccattacagtacctagcatatggtaaatgcttcttttgtatctgatggaccagtatgtaaaacttcctagaacagtgattggcagaaatgaatgtcagaagatgccttggtcattactcataatgtttgtgaagatatttagcacattgtatttcccagtttttgttaatttcccttgccagaataaagtgtaactccttagtgagctgttcaaaaccctttatgcccccatccatctttctaggctcatgtcttgtcttttctctttcttcacatcgtgtttcccatctaacaagtttctgatctgtatctctgtcctttctttttttctgggaattactgcactagatacccacagttactcatgttcctagtggagccactaagcagaagtaggcagaaccactgctgtaaaaaccctgttttctagttagattggactaattgtgataatgaccttgaactttcaagacaaaaattttccctttttctgtagcacttactttttataatgtactgtaccacttaccatattttattttaggtgttgtatttctgttacctacttagcatataaatcctttgaagcaaatactgtgttgtatttgtctttgaagctccagcacccagaatatgaaatgtgtcttgatatgaatgagtggagtgatatgggttgctcagaagaggtcagtattgtcaaggatatggggatgttttgaatagccatttgagaaggctgctcttggtaaggagaacagtgggagcagtggaaacagtcacagcagccagctgctcccatgtgttgagcacatcttatatttaggcacttgacatgtgttgttaacatgtttaattgtcacagcaacttgatgaggttggtgcagtaattttccatctttaacagatgtagaaactgaggcacagaatggttaagtgatttgcacaatgttgtgcagcttgggactgtagaacttaaggtggttgtcactgctgtgctttactgccttccagtggagctcgaggattgggaacggtgagtagactggcccagttagagcaccatgggggctcagtgtactccagtcttctcaagaaaggactacactctagtgatcttctctctgacagagtccaagatttatgacaatggctaagggcaatactttttaaaactgtaatgtgtatacatgtcacctgaggatcttgttaacatgcagattctaattctataggtctaggatggggcctgagagtctgcatttccaacaagctcctaaggaataagtgctgcttccccgtagactccatgttgcgtggcaagagtttggagggttcagtatgaaatatattttacatgggaccattagattctcatctagaaattataagaggttctgtatctttaattggatacataattatgaagttgcatggtatggagatgctgagactctaggcactaattctttatcctgggtctatattagaatccccctagtagctataaaaactaatgcttaggctgtacttgagatcaataagaatatccagtgaataggtctttatagtaaaagaaaagtctttggccaggtgcagtgtctcatgcctgtaatgagacactttggg

SEQ ID NO: 89580 - DNA, 1047 bp, Homo sapiens
cagactggcctcaaggagatttttgcttagtatatttccttctgcattactcgtttccttaatggcattggaatctgccttgacagaggcctctttgtgataggccactcttcatttaccacatcctgtctgtttgctgcacttcattgattctttttttttttttttttttttttttgagacggagtctcgctctgtcacccaggctggagtgcagtggcgtgatcttggctcactgcaagctctgactcccgagttcacgccattctcctgccgcagcctcctgagtagctgggactacaggcacccaccaccacgcctggctaattttttgtatttttagtagatacagggtttcaccatgttagccaggatggtctcgatctcctgacctcatgatccacccgcttcggcctcccaaagtgctgggattatgggcgtgagctaccgcgtctggcccttcattgattcttttatgtcattctgaatatttaaaactcagcaaggcaactctacctttgagggagctagtatggtctttagagtaatactaagtataaagtgaattctgaaccaaccacttaggtccgtatgcccctagacaggtgactaaacctcactttctcagcatgcaaaattggaataatgatcaccacctcactgggtggtttgggagattgatgctataacttgctctgcctcttcttgtcctggtgagtagcatggccatctcttcagttgcagcattccaaaacctggataccctcctagaaactccccttcccttatcctgccttctcacatctagtcattcatcaagtcttaccattttttatgtgtgaatatcactcagtggtatttatgtttaatagctttcaggccctcatttgaaattactattattttttgagccagggtcttgctctgtcacccaggctgaaagtacagtgccgcaatcaaggctcactgcagcctttaatgtccgggctcaattgatcctcccaccttagccttctgactagctgggactataggcatgtgccacca

SEQ ID NO: 89581 - DNA, 1046 bp, Homo sapiens
ttttatatttttagtagagatggggtttctccatgttggtcaggctggtctcgaacttgcgacctcaggtgatccacccaccttggcttcccaaagtgttgggattacaggtgtgagccactgcacccagcctgcattagtattttagaataaagaatggttacgtacttaacgttaaagaaacccctttgtagtgactttactcatgattccaagatgaatgcagtttagtacttcctgattttggagtattttaaccataacgtttcagaatttggcaggtactttataaaaaatgcctggttattgcaggtggttgtagtgttggatttgttattgaaatattatctttctttttttttttcttcccagttcaaagcagtattcagcgatttcaagagaagttttttatttttgctttgacacctcaacaagttagagagatatgcatatccaggtaagaggaatatttggaatatatttctcatgaatattggtttattcacctgtagggctgccataacaaaatttcacagactggacagtgtaaacaacagacttttgtttttcaaaatgctggaggcttctgtccaagatcaaggttttggcaggtttgatttctcctgaagcctttctccttggcttgcacgtctcagatggccttttctctgtgctagtgcatccgtggtgtctttcttttctggtaaagacactgtcatattggattggggacctaccctgtggctttatttaaccttaatttcctccttaaaggccttgtctccaaatacagtcacattgggggttaggacttcaacgtataaattttggggatacacaattcagtccataacagttgacctgtttctctcatgaaagggtagtatactttgactaaagtcagccaaatatttagtaaatactgtgtgttagaataaaatttttaacctttgaataaaacctcaatgtcttttagattactttttgttatatttggcaataattttttaaatgaaaaatttattcccaggttgggcatggtggct

SEQ ID NO: 89582 - DNA, 1439 bp, Homo sapiens
ttttttaatgtctcattttgcactctcttcttttagttctccatttgtacttactttagaccttttgaggtttctggctgaagagactggatgctcatgtcattaattaattaagattaaaatgcagcatgtttacttgtaatctcaaaatacacgttattacatttggcagttaagaggtcattggtgaccttagccacagatagtgaaaagtggagtccgaacaagaaaaaaagggttgaggagtgaataggaactggagaaatggagaggcttacttatgtttctgtgtttgatgctccataattatgtttataatccaaagttttattttactttttggccttcatcttaaacggcatctccctcttccctcctttttaaagcgttctgaaaaaatatgaaccattttgtgacatttctaggagaataattgctataataaactgtgcttatagaaaagaatattttagctagggaattaatatttttctgacttgatgtgacttgtggttgaaccgctctgacattggatatccaactggcatcttttttatcttcatgtagcaggaaaactggacagtgttatatacaaggaccatttgccttttttttttttttttttgaagactatcgctgtagtgcactggtgtgatctcagcgcactgcaacctccacctcccaggttcaagcgattcttctgcctcagcctctggagtagctgggattacaggcacgtgccaccatgactggctaatttttgtgtttttagtagagatggggtttcaccatgttggccaggctggtcttgaacacttgacctcaagtaatccacctgcctcggcctcccagagtgctgggattacacgtgtgagccactgtgcccggcctcattttgcctttacttgggtgatgttgcaattgttaggaagcaaaagacttgaggcctctatatatattaacttttttgtttgttttaatggacactagaacattattgaataattcattattaacctattgcaggtttttgtgaagtcataaatacatttcaggtaataatatacataagggtgacttcattaagcaatattttttaactgggaagactttcatatgcaaattaggtatcttcaaaacttaaaagttttgacattcaaaattttcttatatgagtgttttgtgtaattaaatacagagcaccaaaagcaaaatacaacaaagaaaaataaacaaaaaacatttaattcttgaatacagttctcctggggagcattttgacttcctttcattagataatattatagttaagaatgaaatgtaatattgaagcgttttgttatatttttactgtgcattagtatttttttttttttttgagatggagttcactcttgttgcccaggctggagtgcaatggtgcaatcttggctcactgc

SEQ ID NO: 89583 - DNA, 1033 bp, Homo sapiens
taggaagcattcttgtttttgtttttgttttttatagacggagtcttgctctggttgcccaggctggagtgcagtggtgtgatctccgctcactgcaaactctgcctcccgggttctagtgattctgctaccgcagtctcctgagtagctgggcttacaggcatgggccaccatatctggctaattttgtatttttattagagacggggtttcgccatgttggccaggctggtctcgaactcctgacctcaggtgatccgcccaccttggcctcccaaagtgctgggattacaggagtgacccactgcacctagcctaggaagcatttttactgaaatataaaccagtttattaaaaggtgtcaatatagtgcttgcagggggtgatggtgggggatgacttggcaggttttatattaagtatatttaacatttaggcacattaaaatattaatttttgacctaaatgtcttatcaagataaagtcaatgttacaaagtaggtgacaaaatatatctgttgaactgcttgttttttcctgaaattttggtatcttaaaaagcatagacttttgatgaggacttccacaagtgaaaatatattacatgtatagtatcttactgttttcagaatgctttcacatgttcctgcatttagtccacaaaaccatcttaaaaaggcaggtgagaaaagtgttacttccatttgaaatgaggtgtagagagacttgtaaatttcctaaataacttggatagtaaccagtagggctaaggctaggatataggactgttatattctggtctagttaagtttaaaaatttataaagaggaaaaagggatccatagatttagagctgtcataactattataccagtagcctactcatttagtaattataaatgaatctgaatacttggaattgataagattatgccaaaattcatgaaattgtggcattatttcatttactgttgctgtataatatagtcttccaaaacatagtggtgtaaagcaggtattttattatgcttgt

SEQ ID NO: 89584 - DNA, 1191 bp, Homo sapiens
ggcctcaagtgaacctcctgcctcagcctcctgagtagctgggactataggtatgtgtcactgtaagtgtgtgtcactgtaccttgccctgcccagttgttttgttttgttttgttttttttgagacagggtctctctgtctctcacccaggcagggtatagttgtgagatcacagctcactgcagcctaaccttctgtgcttaagtgatcctcctaagtagctgggaccacaggtgtgcaccaccatgcccagctaatttttacattttttttgtagagaccaggtcttgccatcttccctaggctggtcaggaactcctgggctcaagggatcctcccgtctcggccttccaaagtgctgggattataggcatgaaccactgtccccatccccaattttttttttttttttttttactgtggtaaaatacatactgtctgaccattttaaaatccagtggcatgaagtatattaatattgttggaaccatcgctgccatctatctccagagaacccttttcatcttgcaaaactgaaactctatatgcatttaacagtaattcactattccctcttcccccagctcctggcaaccaccatcttgctttctaagattctgactactctagatttctcatataagtagaatcatacttatatgtcttattatttgacttacgtgtcatattatctgtcttcttgtgattggcttatttcactaaacgtaatgtcctcaaggtttgtccatgttataacatgtcagattttttttcctttttaaggcatagtaatattctattgtatgtatacatggtgttttattcatttattctccaatggacacttggattgcttccacattttagctattgtgaatgatgctgctatgactgtgagtatacaaacatctcttcaagattctgttttttaattcttatgagtatacacccagaagtgaaattgcgggatcgtatggtaattctatttttaattatttgaggaaccactaaactgttttccacagcagctgcaccattttacattccccaccagcagtgcacaggggttccagtttctccctgtcctcatctgcacttactattattactatttttttttatagtgaccatcctgatgggtgtgaggtggcattgcattatagttttgatttgcatttctttaatgatta

SEQ ID NO: 89585 - DNA, 1765 bp, Homo sapiens
cagtatttcctggaaatttattacagcagatttattgcagtagttctattatcttatagatgtaccgtaacttacccagtacttttttgatgtacatcttcaatgggctttcactgtttattcattcagaagtatttttgtgtatagcatgtatcaggcactattcttgcagttttacagacattgcagctatgaacaacttttgcatatatttctgaatacttgtacacatatatatgaaggataaatgcccggatgtgaagttgttgggtcaaaatatgaatattttatattttgatattcacctttagagggaaattcgacagtagcttccacagcattgcaccaatttgtagtccatttgtgtgtgtggaggtactgttttccctatacactcatcagcattgtattgttggtcttttaatttttgctaatctgaaaggtgaaaaattaataagaatcaatctctttttatccttaaattcttgaacattaggacacactcattaagcttttggatatgattaaacagtattcaaatgatatgcacattaatgttaaagccattaaaatataatattctaatttactgtatatattatttttattaactcagttaataagtatataataaggacttaatttggatatggctatgtagtcttcccccaccgccaccgagacaaagtcttgttctgtcacccaggctggaatgcagtggcgggatcttggctcactgcaacctctgcctcctgggttcaagtgattctcctgcctcagcctcccgagtagctgggattacaggcatgtgtcaccatgcccagctaatttttgtattcttagtagagacagggtttcaccatgtcggccaggctggtctggaactcttgacctcgtgatctgcctgccttggcctcccaaagtgctgggattacaggcgtgagccaccgtgcccggtgtctgtgtattcttaattgtggagaagccagaagtatgagatgggctttaaggtgtttgttacacagttagggaggtaatgttcacattcgaaataagtagcaagtagataggtgtttgcatgatgaagcactgtcagttgtacatctaaaggtcagttactgcattggcctaatgaatggagaattcagtcaaggcttcttgtagtgagacttgagggagctttgaaggatgaatgcgcctactttggattggcagagtttgtaggagaagaaatgccaagaaaggggagaactgtgagtggtcacagaaatagaaaataaaatggtttattttagaaataaatagaataaaatacaattgcatctatatagcaatattcagttttttacaaatacagttttcacttatcactgctttaaattataatcccattacatacaccaaagtttttctaatttaatcagatttatttaatcagaataaaatagaaaataaaatggtacacacccacaggtagagtaagccctttgaactgagtaagccctggagggggcttgaagaaatgtaggtttgctaggaaagagcctggggtcgttcagagataggacgttggtgagcattttgagcagaggaagggggttgaaagtaataaggtggactaactccacactggtgggagactggcaggagttggggctgctgtttcatttgaagaaggttataataggctttcagtagggtggtggtagtgaaaatggagaggaagcatcactggtgattattaataaaatgataatttctgtat

SEQ ID NO: 89586 - DNA, 2013 bp, Homo sapiens
gccccacatttccactatactgatgagacaagcaggttgaaaaggaatcccaagtgactgtggagtgtgtagcacgggctgggttgggggagtgatgaggatgggatgggacaccaaaccacaggtagttctcctgggtaggtttctgacagggctttggtcagctccaggtgttcttcctctttcttgctagatgatgcatgtgtggtatctgacccaagtgtgatttgcctctgagttcagaattgactggaaatcactaagtaggtggattcctgaggctgcaaggggttaaaaatattcattaagttttgctgaaaaaatagaaggtgtgatgtgaagctgcaactgcttataacctttgttttacgcccaagcacaagccagtagagtagtgtggaggaaatgttgccctttaagattgatgactgctcatttccttgctcttcaaaggtctttttctcatttggatacccagctgggaatttcagttgttttagaagtttgactgctaaataagatgtatgtgattttttagctttaatattttaaaatatctttattatgttgtttgtttgttaatgtttgaattggggtaaaaaattcattgcattttggatcacagttctgacttgatttttatggatttactactcagcatcaaaagttacacatctaacattgtgaaaatctgattttttgtttggttaattggcgataattctgtaacaaacattacattgtatattgggaggggttggttttgaaaaggagtatattcattggtgatagattttatagtcataaagcaaataactgtttgcattagagcataatcagataatgaagtggttagtagaaaccaatagactatagattaccaaaattaagatcttgtacaacaaaatataattaacaccgtaacttgaatgtaatttttacgggattgtcttatgaatggtaatgattctaagtggtatgtgaaatgctgttactagcacatgccaattgatagaatgctggaaaaatcacattttacattatattttagataggatttttgtatgcttgagggtgacttggcttatgtttttttttctttccttttagaatatggtttctagttttagggtttctgaactacaagtattactaggctttgctggacggaataaaagtggacgcaagcatgacctcctgatgagggcgctgcatttattgaagagcggctgcagccctgcggttcagattaaaatccgagaattgtatagacgccgatatccacgaactcttgaaggactttctgatttatccacaatcaaatcatcggttttcagtttggatggtggctcatcacctgtagaacctgacttggccgtggctggaatccactcgttgccttccacttcagttacacctcactcaccatcctctcctgttggttctgtgctgcttcaagatactaagcccacatttgagatgcagcagccatctcccccaattcctcctgtccatcctgatgtgcagttaaaaaatctgcccttttatgatgtccttgatgttctcatcaagcccacgagtttaggtaagtgtttgagaattcagtttcttctgaacaagatagtaaatgaaatgagagaccttcaactattgattaatgatgtgctgttaatatagtgaaattgaggcatcaatgccgaatgtttgaatatacggataaaaattcggcaaccatgactgaaatctaatagaagctttatttcatatcatttgatctttcttcttctccaattcttttattgtaaaatacacataatataaaatgtatcatcttgatcattttaaagtgtacagttgagtggtgttaagtatgttggtaatgttgtgcagccatcactgccatccatctccagaactcttttcatcttctgaagctgaaactctgtacccattaaacaatagccttcctctcctcctctcccactagcccctggcagttaccattctacttcc

SEQ ID NO: 89587 - DNA, 3666 bp, Homo sapiens
actaaaatacaaaatttagccaggtgtggtggtgtgtgccagtaatcccaagtatttgggaggctgaggcaaagaatcccagaggcagaggttgcagtgagccaagatggtgccactgcactccagcctgggtgacagagtgagattctctctctcaaaaaaaaaaaattatattgccttggtgtagtagctcacacctgtaattccagcactttgggaggtcaaggtggaaggatcacttggacccagaagtttaagaccaacccggacaacacagggagactctgtctgtatgaaaagtaaaaattaactgggctggcctcccagctactctggaggccgaggtgggaggatcacttgagcctgggaggttgaggctgcagagagccaagatcgtgttgccacactccagcttgggcaataaaacgagatcctgtctcaaaaaaaaaaaacccaaaaattatattgccttgtattatctagaatttttagaatactgtcaaatgacagaacatagtatacattttagaagtcttagctttgtgatttagtgtttcatttttagtatattagctattgctttctgacagataccagttatcatgttaacagaatttctttcttttcttgtttattgagagatttcatcaggaatgaatagaattttatcaaatgcccttctagcatttagccattaatcatatggcttttctactcaaaccaaaaatctgtttgcattttctctatcagttgtcagaataatgatgaatttttcccttaacatcctttaaaggagatcagtgatttttaaagtattattatgaataaaatgaaacattactatatttaatcggtttgaatccaatgcagttattattctttttgatgctcaaattttctcatcttaggctactaggagcccattctggatgttttctttgcccttctgacaaggccccgtgatctttgatagcttctctgttttctggtgcgataaaatgttataggcttatcttgtgcatttcctgccccagacctgcagtcagccatttatttccccaaggagtctgggttccttttatgggaaatagtatttatgccataaccgcttttttacctcaccttcaaacagactaacagtttttgtttaatgaaatctagaatacctttagatttacagaaaacttgggaaggtggtagagtccccacatgcccacacccagtttcccctgttcaagcaaacttttgagttattgaaacactcttaaatttacaatgatagaaaattcttcgtgtccccagtacacagcttcagaagttaatcaactccagtcttttgtcatatatgtccccacctacttcccccaaattatttgaaaggaaactccatatattgtataattttatacataaatactcaatcttatgactgtaaggatagaaataatcttaaccaagcaatttacttaatttatgttaaaccattcttatattggtagattacactgtattgggtgcattgaggacttttatgtctacactcacaggaaacattgatgtgttaatattggtttgtaaattgtgttacacaaagacttcttatggtccatgttgataaatgagaaagaatgtatggtatactaggcccgccatttcataggcttttgcctaaaagtttggttggatagggtggacttctccctgctgaagtttgaaaaccaataatttgcatgttttttgaatttcatgttttgtgttcagcatttttctatatttgtcttctaacacgtatgtattttactccctggcttttattctcttgaacagtttaaggaacagaattccatcctttccttgaaagcttggtggaatttattcatgaagctgtcttgtttgggtagatgtttttggatgtggagggagggcaagacaatatacctcttcttgaatcagatggagtaatttgtatttttctaggaaaccacttttatctgtatttaagttattagaatatatagttgcatgcactattttctttgtttaaagaaatttgtttagttttttttttttcatttataagaccatacgtttgtttactttcccttttgtggatctgacttcactgcattttgctttctaattaattttttttttttttttttttgcttttttctttttatcctgtaatgcttccccagcccttttggtttattttattattacttttttgcttccttaattgactactttattttaaatctctgttgtataataatagaagcatttagggagatgttttccctgaatttggaatgtagcattttttttattgtttctcttaatagttgattttcaatttgatttctttaacctaggagttattgtaatcattatcttgtaagggagaaacccattagtctctcaaataaaagtggatttaattatagggattacatgatttcaccaggaatacaggaccaggaactggggcctccaatgacctttgaaaagagtaagcagtatctttctggcttgccacatagttcctcttatgtatggcattagcttggtcactcttttttgagggattatgttaatctggcagtttttctttattcctacttataaatgaagatgtagatgattattattcttttttgagatggagtctcactctgtcacccaggctggagtgcagtagtgtgatctccgctcaccgcaaccaccacttcccgggttcaagcatttctcctgcctcagcctccctagtagctggaattacaggtgcgagacaccacacccggctaatttttgtatttttagtagagacagggttttgcctttttggcctggctgttcttcaactcctgacctcagatgatccgcccgctttggcctcccgaagtgctggggttacaggtgtgagccaccgtgtccgtcctgaggtagattattttaatattgtagctggagtaggcaatattaataatgcagtttgtcagttgccctcagcagcttctcgtcttctcctgtattatatacatcatagcagatggggaatctacagagttcttattgacctttaccatgatttctaaccttattagcacttccccaaattctaggccgttattgcagcttctgtctcatgttttagaattgaagagcaatctcagggaaatatttttattcactggtgattacatgtaactgtcatgtatacctgtttgatgaggtattttttttttttttttccgagatggagtttccctctcgttgcctaggctggagtgcaatggtatggtctcgactcactgcatcctccgcctcccggtttcaagcgattctcctgcctcatcctcctgagtagctgggattacaggcacctgccaccatgcctggctaatttttttgtatttttagtagagacggggtttcaccgtgttggtcaggctggtctcaaactcctgacctcaagtgatccacccacctcagcctcccaaagtgctgggattacaggtatgagccaccgcgcccagcctaatgaggtattttctacctaatgaggtagcaccttcagcttgccttcatctttgtatgtagtgtttcaattatataatatcccagctttaaaatttttaataattttgtgtttattttcatttg

SEQ ID NO: 89588 - DNA, 1613 bp, Homo sapiens
cctgcctcagcctcccaaatagctgggattaaaaggttggagccactgttccttgcctatattatctttttttttttttaaagatggagtctcactctgtcacctaggctggagtgcagtggcgtgatctctgcttactgcaacctctgcctcctgggtttaagcgattctcctgtctcagcctcccgagtagctgggataacaggctcccacaccacacccagctaattttttattttctgtagagactgtgttttaccatgttggccaggctggtcatgaactcctaacctcaagtgatttgcccgcctcggcctcccaaagtgctgggatttcaggcgtgagccaccatgcccagccaatttttgtatttttagtagagacgatgttggaccatgttgaccagactgatctcaaacttctggcttcaagtgatctgcccacttggcctcccaaaatgcacccttgcaccctactaccaatttatatgccttcattgctcagcattttcattctgtcttatttttatatttttcctgatgctgtcaggatgagatctgtgttttcttaacctcacaaatttgatagttacttcatatagtaaaggtttgtttagttgactacctccctccccacatttgttttctgtgaaaaacgaacatcattctgtgattttaatactcattctgggcccagcatggtggcttatgcacttttagaggccaaggcaggagcatcacttgagcccaggagtttgagaccagcctgcaaaacataatgaaatctcatctttactaaaattaaaaagattagcaggcatggtggtgtgtgcttgtagtcccagttatgctggaggctgaggcaggaagatcacttgagctcaggaggttgaggctgcagtgagcagtgtttgcaccactgcactctgggcagctgagccaagaccctgtctcaaatagcaacaaataactcattcctctagattactctggttcggcagtggtgagctttttgcctttcactttcattgagtgtgttaggcctgcctttgtcttcaggacttttgcatttgctatggaatgccttggaatgcttttcctcaggtatccatagagtgctttcctcctgcttcagttacttattcagttactatttcagtgaggcctttcccctttaaaatggcaaatcctctacttcttcactttttgtgtcccttcctcctttgtttttgttcattttattcatcatgacctgccatattatatgttttatttaattctttattaaggttttggtctgttaagctctccaactcattaaccagtcgttggaatttttttatatttataacttggaaacaattgataccttttcagtgttgagtatttttatctagtaacatgcatgatacagtctgtttaatttattcaaagcttttttttttttttgagatggagtctcactctgtcacccaggctggagagcagtggtgcaatctcggctaactgcaacctccgcctcccagattcaagcaattttcctgcctcagcctcccaagtagctgggattacaggcaccctcccatcacgcccggctaatatttgtatttttag

SEQ ID NO: 89589 - DNA, 1029 bp, Homo sapiens
ttttttcctttcaactcttactgcttttatttccatttcttgtcttattctgctagctagaacttttagtactgtgttgaatgaggggtgatagtaggcatctttgcctcagtcccaatattagagggaaagcaatctttccgccctgagtataatattggcttaattttatttttttggtagacctgtttatcaaattgaggaagctctcctctattcttgtttttgagggtttttaaatcatgaacaggtgttgaatttgtgaaatgcgtttttcgcattgattgatttgatcatatgatttggttttttgtaactgttaatatgatgtattctatagatctcaaaacaaatacagagataagacacagtgaaaatgctgagcagcagtggcatataatgaaccagtcttgcatactggaataaactccacttggtcatggtgcataatgaccatggtgtttaattctttttatatattgctgaattttattgactaatattttgttaagggttttaacgtctatattcatgacgaatattggtttgtagtttaatttttttttggagacagttttgctcttgttgcccaggctggagtgcaatggcatgatcctggctcaccacaacgtccgcctcccaggttcaagcgattctcctgcctcagcctcctgagtagctgggagtacaggcatgtgccatggctaattttgtatttttcttagagatggggttctccatgttggtcaggctggcctcgaactcctgaccgcaggtgatccgcccgccttggcctcccaaagtgctgagattacaggtgtgagccaccgcacccagcctgtagtttaattttttgtgttgtctttgttttgttttggtatcatggtaatattagtttcataaaatgaatttggaaatattctctcatcttctgttttctggaagaaattatattgaattgttgttagttcttccttatttttattttttaatattatttgagacagagtttcgttcttatcacccagg

SEQ ID NO: 89590 - DNA, 4224 bp, Homo sapiens
ccgagggcgcgggggaggggagcgggccggcggagggcacgcgggcggcgcgggggcggcgggcctgggccgcggcgagccggctcctgagtgctgccagtggtccgcacacctggcgcggggggtcggggcgccctccaggaggggcacatggggacccgacatcccggttcgcagtgagggccgatgtgggaagcaacgtttgatcttgcaccttcaccggggtgtacgtgtctgtggctattcacaagtctgcatgctactcacttggtggaggactgttttctgaaagctgaagttgcgtttaggaatctctcctcttcttatggctgatgctaccgtttagtcaggtctgtcacgagaaaaggccccttctcccacccttgcctcctaacatcttcgaggaacctaatgtttggggatccctgccttcaataatcggccttaaacctcgatattttcttagtgttttagtaagaaatctgcaaagtctatgttgtgaggtttgtgcaccccttttactcttgaggaaaaatatttttttcttctcagtcttaaaacaagatcataactttattgttgatacccttgtatagcagaggtctggaatagggctgtgatgggggtagaacagaagagactttttccccccagactgataacctttaaagtcctaactaagtgtgacgaatgagatggatttgtgtgtatcgctgaattactggcgacataaatgagatgtttacggacagaaaccctgattttttttttttttaaatgtatcaaggtagagatgagtgtaaacttgaaattacatttactgcaactcgtttgtgtaacacttatgatattaggatttctttttcaaataaggaagaggaatccggtaaaaggttcagttttgtatatttattgttttccgcaagagatgggatgggggaaggatgttggctggttacctgcttagtggacgtgagcaaaagaacgtatcctctgctctaaacggagattgttggagtttgcacagtgcctgccatattccctcctgctgtttcaaaaataattattaagttcccagtaaacacatattaatacatgttatgccccatactagtttatgcagagaaccataagtgtaggtaaagggtgttcatacttgataagtttaagggttttagtggctcagagccccagctgtagagcttttaacacctgtggagcttttcaaacaacgaaccctgaacctcacctctgtaaattcatgcgttagatttaggatgggttgagaagactgaactctgaagttatatttatttttacctgccatttttaatttttgtgtagtaacagatgtatacaagttttctaagttcttttttttttttttgttaatgaaaactttccaggatttttattagactcttgtgaatgttgttggccaaagcttaatgtaaagcgaagaatttactcgctcttatagagcagagtaaaagcagtcagtgctcagattggagtgcaaccagcaactggaaagtgatagaaaccaaagaagcttttttttctcttcctttctgccttcctctctgttttggtttgtggatcagcttcatcctcttttcctgtaaatcagctgtctttacttcttgcatttttagaagatggcccctctcccacaattcatatgacgtgcccaacagagactaactggggagaattttcagaggagtgaggggtgcaggctgggcacatgcagtaagcatcatctgcttttctttgccttaactgctctgtgcagacccatgttaccctacacttgaagatgaactgtaccccgcccttacatcccattacagacagtaatgatgatgatggtatatacccattttaatatagtggttattccatgcctggttctggtctaagcattttttctatacttatttaattctcacaattttttcaagaaattgaagcacagagaggttaacctgacctaaatcacacagcttgagatttgaaaagctaagatttttaatcttagacatgtagcttttagagtctgggcttttcagagcccgggctacactactttgttctggtaccttggggtctaggtggagcttctagccatcatcctgcgattgctcctaaattaaatgattggtaacatccttcttgtgtgacattataataaaggaagaaaaacagactaaaaaacggaatagaaagaaagaaaaggggaagaaataatcttggattctcaaaatgatggtccttggatcagaatatattgtggtggtcagagtgatgctcaagtaaattataggaccaggaaaaattttgggcattagtttgttggctaacttcttggcagtagagaaattggtcagccgatctggatgccacatatttggctgctgatatgccacagagaggatttccattacccttcaaggctactcattttggacaagtataaccagagcagttcatatcctggctagtgctgcatctatactggagatagggaattttgggaaaggtaatcctcagtgtggtttggtgaccctggtgcctttgcttttcagacttgtgtgtcgggggtggagttgggggggggagggttggttattcgattaggcaactgttaagggggtcgcctgactatttcagttttggagactgctgcgtgagccagtaccagagatcttggctggtcatagcagaatatggcagctctataccttgttgcctttcagtccgggtgaccagaataccagcccacctctcttccagttcttctgggagagagaatctgattggctgagtttaggtctctacttctgttctaatcatccatagccgggggcttagagtcaaagcacacaaacctgatcagcagattatcctgatggattgaaggaaaggaagtggggaagttctctgaaaagggaaaatgtggcctgtgtgctcaaagatggttacaataatgtgttatatattagaagctttcaaggtgccagagaagaaattactcaatttaccagttgcttatttatggcatctgtgttgttaggagctgaaggagtgattagtttgtgaatgaacagattttgaattaactagttgtgaattaatgtgggacaagatcataagatttgatggcctgaacttctgtcactgctgccttgcttcctcctccaaaaatggtctggagggcagggcttggtagctcacacctgtaattccagcgctttgagaggcaagaggatcgcttgaagccaggatttctgggttacagctagctctgatcttgacactgcactccagcctgagcgacagagggagaccctgtctcaaactagtctgtagaagagctaagcacagggatggaggagagcaggagttgagtttctggaatcacttacctcttctttaaccagagcagctttttctttacccttccagttgcatatttccaatattgtggtctgctggtggcagtcattcacaaaaaggtccctgctacactttaacctggttaatctactttccctacttctcatcactcaatggggaggagggggatctattgtagtgactttttttttttttttaaggatctcccttctgtattcttcatccccttcttttcatgcattgagaatttattctgtgtgtgtctcagaatgagagagaatgtgcctgtgagaatctggttgtgcatttggcctgagagagccagcgatgataactttatcaatagatactgggtaaaccagaacatttaccaaactgggtaaatttgttgtgtcataattcgaagatcagatttgggtctttcatgctaagaagcctaagtaattctgtaacagaaggtcttctgtctagaaggcttaagtgtttggtttccttacacctaccaggagtcaccatcctgataacttcaagtgctgttaggatgcagcaggagaatgggaagttaatgggggatttgaggttagaggtcctcatcacgctcctctccccatttattgggcagggatacagactaatagctatgatagatataacagaatcttccatatgattcaaagctattatgggatgcaactaaaatttccaaggcttcacctgagctcatgtctatgaaagcacgttcgaaacaaaatatatttaacttaaagtgaaataggctgggcgcagtggctcaaggctgtaatc

SEQ ID NO: 89591 - DNA, 1167 bp, Homo sapiens
cacgcctgtaatctcagtactttgggaggccgaggcgggcggatcacctgaggtccggagttggagaccagcctgaccaacttggagaaacctcgtttctaccaaaaatacaatcgcagctactcgggaggcggaggtaggagaatcgcttgaacccgggaggcagacattgcggtgagccgagatcgtgccattgcactccagcctgggcaacaagagcaaaactccgtctcaaaaaaacaaaacttgcggggtgcgggggcaggggagtggaaggaagacctggaagtgcagtgcggatgaaacgaggggtagtgggaagaggcggtaggtaggaggctgattaaacagggccttaaaagttacattgttttaaagacctctcgtgtgtgggttccacccaattcttcaaggaaattgaaccctggacaccgtccagcgatttttctggccatcttgactcagcatcttccttcatcctatatcagcacattacgggggggccatcaagcttccttctatctacttactctgccttggcgtttgactccttcctagctatcagatttccccgactttttagcatggcccttctgagcgctcttatttcacttctccccgcccccaaccccaccgcctaactctcccaactctgcagtccgtgaccttcaggtgcccttcaaggtcagaaaaactcggcaaggttggtacttgcaggacattagcaattcaaagaggtgtcacacaacctcaccattagatgggaacaatagcttacccaacacccatatttagattattccgccacaactactctgggggatggttttatttgcggcggctttctccgtccataggcaccgcgtgaagggcaccgtaagaatcttcccgaatgctcctgtcacgcgtcccggccgcctcttcttcctccccgccacttcccgaggccaggcccgcggataacgcctcagttgcgacccagctctaggcagtccgcaggggcctccgccggggagggaaggcacgacctggggccgagcggggccaagccgcggggcagcacgccggggcaggcgcgggcgggcgctgtcgccgcgcggactgaaggcgcgggcggaaggcggtcgcgcgggtgggcagggggcaccgctaggggcggggcttcgg

SEQ ID NO: 89592 - DNA, 2989 bp, Homo sapiens
aactcctaattttaggaaaggtattggacctgttcaaactttgtttcttcatatgcaaaatgggaacagtaataatctctcataatgtggtagggattaaatgagacaaggagtggaaaggactgccttactcaagtttccttgatttagagattgtttgctttttttgtctgtaagagactgaataatcaacaaaacaaagagacttagctctgttagttttaaaaatgaagggggtgtattttactggaaggatagcagggtaacctatgtcattaagccaaggaaacattgagcaacaaggttcagaaagggcagagaccagtgtagcttcaggggcctcaacagctgttcccttcactccaaagtgtcctgccattagtatgactcatcttcaaacttctttagcctacacatcaatcagctcaaacttgcaaggaaaagaatgctgtctctgactaatggatggacttttctctcaatcagtgttgctttcaaatcaaatcaactgtggctagcatgcaagatctcagatatgaataggtctgcagggcctataagaaggaaaacaaagttgacatgcaccccaaaaagtatgtgattccagtgcttggaaatgcctggcacacgatgaatactttatgggttttggctattagtgttgtgactgttgatagaataccctgtaagtttcagcctccatacatttgattctgccatattttaccactgagatgacatcccttctctttttgaatgaaaataaatcattcttttcttttcttttttttttttttaattgtgagatgcagtctcattctgccgctcaggctggagtgcagtggcacaatctcggttcactgcaacctccgcctcccgggttcaacaattctcctgcctcagactcccaaggcactgcaggtgcgtgccaccacactcagctaatttttgtctttttagtagagacggggtttcaccatgttggccaggatggttttgatctcctgaccttgtgatctgcccgcctcggcctcccaaagtgctgggattataggcatgaaccaccatgcctagcctcatttcgtcatttattctgaaaatacttatttcatacttgacgtgagtcaatcaatggggatagaatagagaataaagtccctgccttcactgaacttatatgctagcaaaggactgggggtgcaggaattgatcatacccataatacatgtattaatataatttgaggtagtgatatattccataaagaaaatcaagcagtttgagaggatagataatgatactggaggaaggatagtgacactaagtgaaccagggataaagggagttgaaacaagggactgcggaatgtgataaggcatttgattcttatttttagagtaatgtaaacccattgaaagattttgaataggagggtggtgagatctaatttatatttataaaatattatcatggatgttatatggaatgagagagaaagcaaggagataagatagatggctactgaaagttatccaggtcaaatggtggcagtagcagtggaagtattgaagaacgatcagagttaggatatattttgtgtttattttgttataaaatatcttaagcatacaagtgtagagaataatacattgatatattcaccttccagatctatcaaatcctaacattttgccatatttgcttcagatcctttcttttttaaagaaagaaaactgtgttaagtatagtggaatacccaaaatagcctttacagatcctattcccatcccccagaggtaccagctgtcctggttttgatagtcaccattcacatgtaaggttttgaatttttatcacatatgtatatatccatgaatatatagcatttatgttttttgaaaaacatatataaagagtagataactttttccaacttgaccttttcatttaacattgtttttgagatttgcccatgtttttatatgtagctctagtttattcatttttttcttattctacacaaagcatttttttttaattttttgagacagagtcttgctttgtcacccaggagtgcagtggcacaaacatggctcactgcagcctcaactttccaggctcaagtgatcctcccacctcagcctcccaattagctgggactacaggtgtgcaccaccatgcacagctaatttttgtatgaagggagatctccctatgttgccccagctggtttctaactcctgggctcaagtgatcctcctgcctcggcttctcagagtgctaggattacaggtgcaagtcaccgagcctggcccacatagtattcttttgcaggaatatatcacagtatctactatcatgttgatggacaggttcagttttcattttttcacgattacaaacagtgatgcaataaatatccttgtacatgtctcctagtgcacatgtacatgtatgagagtttctctaggtcagtgcttcctaaactttttcaggtcatagaactcagaaatgataaaatttgtgtgttacattggtaagctggagggaatttagaagcatgtatatatgcagcttggtgaaaaagatcacacaaacattgatacattattattaactaaagcccatactttattcagatttctttagtttgtacctagtgttcttttctgtttcaggatcccagccaggataccatataacatttagctattaaaaaataaaaataaatagaaaataataataataaaaattttaaaaaacaaaaaacatttagctattatgtctccttagtctcctctaggctgtgacagtttctctgactttgtttttgatgacctttatatttttaggagtactggacaggtattttgtagaatgcctctcaattgaaatttgtctatgtttttctcatgaaaaactggggttatgcgatttaggaagatcacagaggtaaagtacattctcatcagaccatatcaagagttca

SEQ ID NO: 89593 - DNA, 1961 bp, Homo sapiens
ggaattaaatgcctaagatctctcgccttagtgatggcaaatcaggatcagaagccaatattctaactaactcccaggtcaatgttttcctgtctttcaacaatctaattttgaccactccccaaatccattcacccaatcaagatccagagtctaataacacctccccgtcaatacctcatttcctcaatcaggaaccgaccctgccgtccctttcatccgacccgttgtcacccccaaacccgcctgtgtctcatttatttttccctccatcacggctgcaagcccagcccgggatttaaccacctcggccgagcgcctctcactgcgtttgcgcttctctagtagcggactctgtcgccatagcaaccggagactcggaatcgtcccgcagcaacagtaggagaggggttcttggtataatcatgttttatatatgcgttccttaccgcttcccgcgcctgatgcgtgaatttcagggtctggtaggaaagctccatcagacactgtgctaggaccctagagaagggagaaaagtagtcagttactgggctgaccggtcgatccaaggaacctgacgcttaaccagcccgcccctttccggattggctagagcccagacacgcccgccaatcgctggccacagaaggattctttaacatgccaatcaatgttagaccatgcatgtttaatccagagtgtttgcatgacactggccaatgaagagatcgaagagggaagattgttagagcacagggcgggctttgcaattgttttggttttcttaattcgtttctaaaatacaagctgacccagggccatgtaccataatatttgtccttgatttcagccgttgttcaggtctttgcgacccaatgcttctatacccaagactatattttgacgtcccgtcttctcctccctggattagggtaaaggtttggaaatctattctgcttttctttgaaattctctgtgcatggtctatctagactggacgaatctgctgtggacactttggttgtcaagagccttctgggatgcaaactgtgcatcaccaaacttccccttctcctccaattcctttcacatcagacctgttctcattagacgtggaaaaacatggacgtgttttcctctgctctatttttttcatgtgttaactagtctgtttcttcaatgtctttcccttctgtctctcttgctgtgaatcctattccaaattatcccttcatcattatcttcggtcttcttcatccatttcttcttcatccatttctcccttcaggatacaaaaatattcaagtttcctcaatctacaaaaaaaaaaaagttctcgtaagtgttgaactgaatcacctttctcccattcagggcaagctttctgaaaggactagctatcctcttcctcatttcctcaccttccacccatttctcaacacattctggtcctgctcctttgaagcagttctttccagagtcgtcaataacttcctaattgggaaatccgattacagattatttaatattctttatcttattccaacttggcaccatgtgaaattgttgaccactttctaattaataatcataactgtaatttattaaacatctacagcaccaacgtactatgcgatttacttggctatctaatataatcctaacacaacatggagaagttattaatgccccaatttgcagttatgcaaacaggcccaaaaagccaaattattaataagtagttctagatagagttaggatgcaaacctgtttcctgactgaagccagtgctcttttcactatgccttgcttccacccttcctgtccagtctcacctctaattcccacctggatacaggcaaccccactctaacacaagcgaactgcttacaatgcttgtgaatgactaatgagtagtttatttggcttggagaaccactctcacccctgctgcataagaa

SEQ ID NO: 89594 - DNA, 1961 bp, Homo sapiens; identical to SEQ ID NO: 89593

SEQ ID NO: 89595 - DNA, 1961 bp, Homo sapiens; identical to SEQ ID NO: 89593

SEQ ID NO: 89596 - DNA, 1961 bp, Homo sapiens; identical to SEQ ID NO: 89593

SEQ ID NO: 89597 - DNA, 1719 bp, Homo sapiens
cggccaacatggagaaactccgtctctactaaaaatacaaaattagccgggtgtggtggtgggcgcctgtagccccagctactcaggaggctgaggcaggagagtcgcttgaacccaggaggtggaggttgtggtgagccgagatcacaccattgcactctagcctgggcatcaagagtgaaactctgtctcaaaaaaagaaaaagagtataaacatgttattttgaagaagctgctacaagtcgaagcagttgcttctggggagcagtaattaagtaagggccagttgaggtgaagcaggagattcgttttttttcaaattttgttgaactattataattttaagtgatgtgctgccattactttgttaaaaattaaaaactgaaaatatatttgtaaataaataatttgaaacaacaaaaataaaccaaatacaaagaaaatattctgaaaatcccaatacagtagatgatgtaggtaatcagaatgtcttgtggacgtgcagtcctctttatatctaacacactggatcacatcccctcctccagcttctccagacccctactcagcacaattccttgcacatagaccccaagagatcaaaccatcagtgagcatacctaaatattgctcttagcgccatctagggactaaaacaaaaaataaggcttgagttcctgccttgctttcaagttccaagaaatttatattatctgttacatgcaagcaacagataacaatataattaatccaattaaatactaaatttatggcataaatgctatggagttgtcagacgttagattagggagaatgtggctggagcactgagaggcaacacagaaaatggagaggaaaagcatggaggcagaggttgggctttattgcagtgctttgtaggtcttgtcaagatttggagggtttatcccaagtgtaatggaaaggcattaaaaggatcccattaaaagagtggcactattttaagaaaatcaccctgatcattggatgaaggttggactgaagagaggcaaaaaccaaggggtaatagctaagatgctattaatgtggttccagtgacagggcatggaggtttagatcaggaggtggatgtgaatatatggattattaaagatacaatatagaagtagaatcaataagatttgctgatgtcttcctcttgtagaggacagaggagagggactaggagaaagaaggagctaaggataacccccagaattacgatttgagcaatcggatgaatggtggtttcactggggtggcttcccctatggggaaagactgggaaaggtacaggttttagagaggacattcaaaagttaagcattaagccagacacgaaggctcacgcttgtaatccgaggactttgggaggccaaggcaggctgatcacttgagcccaggagtttgagaccagcccaggcaacatggtgaaactctacaaaaaatacaaaatttaaccacgtgtgatggtacatgcctgtggttccagctacttgggaggttgaggtgggggaatcacctgagcctgggagacggaggttgcagtgagctgagatcacaccactgcattccagcctgggtgacagaataagaccctgttgaagaaaagaagaaggagaaggagaaaaggaaaaggagaaggaggagaagtagttaggcattaaacaagttaagatgcaaggcacagtggctcatgcc

SEQ ID NO: 89598 - DNA, 1719 bp, Homo sapiens; identical to SEQ ID NO: 89597

SEQ ID NO: 89599 - DNA, 1719 bp, Homo sapiens; identical to SEQ ID NO: 89597

SEQ ID NO: 89600 - DNA, 1719 bp, Homo sapiens; identical to SEQ ID NO: 89597

SEQ ID NO: 89601 - DNA, 1026 bp, Homo sapiens
ttttaggagcccatgcgattaataaaaactaaggcattttaacaacactcattttaaaaactagtcaatgaccttattaattagctaacacagtcgatattttgtaatataaaaggttcaccaaggcagagtagtaacttttgaaaagtacgtataatgacacatgagaataaacaaacatgactttgttttaggattcttttgtgcatacacatgaatgtgtggatcaattccagttttccaaaaaccattatcgtgcattgactctaattatttttttgtttgtttttaattgtgcagccaaattaaaaacaatgacataattctttggccttagagcattatagaggattcttacattcaggttaagaaaaagaaagtggcagaggtatacagattacgtatagtcttatttgtattaaacactaaatttaaaacggagttggagaaaaatctctatttcatatctttgctaccagaagatcaccagcagcatcagaaataaaacatagaagcttgtgatacaaatctgtgttagtcacagctctccagacaggcagaacaaattatacaaacatgcatacacacgcacacgcatgcacatgtgtatgtataaatatatgtgtgtatttttttactagatttattatttactagattattttgtactagattatttattatttactagatttattatagggaatttataattataaggatttattattataacgctcatgtgattatagaagctgacaggtcccaagatctgcagtcaacaagctggagaaccagaagagccaatgatatagtttcagtccaagtctgaaggcccccgaaccaggagagtagatggtgtggttctaatctaaaagcagccagactcaagactcaggaaaagccaatatttcagtttgagtccaaatgcagaaaaaaaaaacaaaacgctgtcccagtttaaagacagtcagaaagtaggaattccctcttacatgtgggagggtcagtcttttattctactca

SEQ ID NO: 89602 - DNA, 1026 bp, Homo sapiens; identical to SEQ ID NO: 89601

SEQ ID NO: 89603 - DNA, 1026 bp, Homo sapiens; identical to SEQ ID NO: 89601

SEQ ID NO: 89604 - DNA, 1026 bp, Homo sapiens; identical to SEQ ID NO: 89601

SEQ ID NO: 89605 - DNA, 1318 bp, Homo sapiens
tagtttttaagacgtgaggaaagggagaaagcgaaaagttaaaaggaaacaaaagtaagataaatagccagatggcctggagccaccacctggtccttgtagttaaagaaaaaaattaaaaaatctacccctgacctaaactacttgtgttatctgtaaattccagacattgtatgaggaagcattgcaaaactttctgttgtattagctaatgcatgtagcccttagttatgtcccccatgtttgcttgatctatcatgaccctttaacgtggtccccttagtgttgtaagcccttaaaagggccaataatttcttttttagggagctcagttcttaagacgcaagtctgctgacactcccagccaaataaagccacttccttctttaacccggtgtctgaggggttttgtccgcgtctcgtccctctacagtttagttacttgcaaatcagtttcttcatatcagagcttgttgttaagctttgttaggtaagggatatctaaagtagcctttattctaggctgtgcctggctttgcttactcttatgcatagccttacttggagctctactaaatgctcttctgtcccacaagatttctccacttaagtcagtcataatgcaaatgtctctaaatgttatgagagcagcttcatatgtttttcctctatgtatgtgcagctcagtattcagccaaaaatcaataattgtggagctctttttttgcatagctcctcctctctgaaactcttccctcccagttctaagcaactcagtcttcccaaactccaatctctatcgcttcatcttagcaaaactgctgttcattttttttttttttgaagtttcgctcttgggttgcccaggctggagtgcaatggagcaatctcggttcactataacctccacccaccccagttcaagcaattagcctcccgagtagctggcattacaggcgcccaccaccatgcccagctaattttttatatttttagtagagatgaggtttcaccatgttggtgagattagtctcaaatgcctgaccttcaggtgatccacctacctgggcctcccaaagtgctgggattataggcatgagccacagtgcccagccgcttttttggggttctccttccagaaccagaatctagttattgcttccaaatagaaggccttctctcataattacgttgtccaaaaatcacataatccaatgcttgaaaagagtttactcatatgtttagtccagttttccagtttcttacaggagacctggtctggtgccaattatgccatctcagttgaaagtagaaggtc

SEQ ID NO: 89606 - DNA, 1318 bp, Homo sapiens; identical to SEQ ID NO: 89605

SEQ ID NO: 89607 - DNA, 1318 bp, Homo sapiens; identical to SEQ ID NO: 89605

SEQ ID NO: 89608 - DNA, 1318 bp, Homo sapiens; identical to SEQ ID NO: 89605

SEQ ID NO: 89609 - DNA, 1137 bp, Homo sapiens
gagacttgttaatgtgaattacttcaatgatggcaaatttgggttgaatttgggttttatcattttgccaaatgttacctaaaatgaatacctgtgaataaagaggtaaccaagtttgggcagatacccattttaggctgcaaatgagtaaagacaaatcacaagatgtttcttggttgatttacttatttgacttttaagcacttccaaaaacatccttaacaacggtgacatcaccagaataagtatgtaactttcaaaggcaactgctttgaaagataatagttaaatatacttaacaaatatggggctctttataggcaaacctcctatgcacatactagttttcatctaatgtgctatatataggcttactttttgtattgcatccctttagacttgtaatgcctgttagccattattcttttcacctcagttaatttcttctttttattctgtgaaactgccaggtatatcgatacagcaaatgctttggagcaagaaactaaactggggttacgacggtttgaagtttgtgacaacattgatcttgaaactattttgatggaatatgagagttattattttgtaaaatttcagaaataccccaaaattgtcaaaaagtcatcagacacaggtacatgcctattttctagagataaggctttgtctcatctgtaagattagtgtttctttctcatcttattcccagatagatggagaccctcaccctgcaccaaaggagtaggccaggaggattgtgtagccattctcatatccagcacagacaactgaaatatgattacctggacactgatatccctttaggcactttggcatttgtttgagaaaatgtgttttcaggcaatgaaagcaaaaccccagtgtatcataggtacttttcagatgattagcattactttaatttccttagagatgaaaagaactgttggaagaggataaatgacagaagactttttttgtttttaggagacctattatctgtcttgaaaataactacaaaaatgagtattggggaagctaatagctcatgtatagataatgaaaagcttttgaaagccatcaatccagataatgatcaatataatataaaaacccagtataggttagcagtca

SEQ ID NO: 89610 - DNA, 1052 bp, Homo sapiens
ctatatggcactgggatctgctcagcttctggtgaggcctcaggaagcttttactcatggcggaaggcaaggggacctggcatgtcacatggcaagagagggaacaagaagggagggagatgacctgctcttataaacaaccaggtccctcgtgaactaatagagtgagaactcactcattacagtggtgagagcaccaagcctttcatgagagttcctccccaatgacccaaacacctcccaccaggcccacctccaacactggggatcacatttcaatatgagatttggagggggcacacatccttactacatcagaatccaagctttaggacaccctccctgcaaatttagtaggtatgttgttcttgagggcataggcttcagagtcagcctgtctagattcaaaacctggctcagatgctcccccactatgtaactttgggcaagttggttaagttgttttataatttctccaagcctcatttctctcatctgtaaagtggaaataatcatagcgtcccctttaagtctcatgatgaaaggagagccttggtgcagtgctagcacatagtaaacactccataaatgttaactattattattatttttttttttggtgcatccttgctttttccttcctacctctaggggggacagggtgatattggaaggatcatgggttgggagagagattaagtgggtttaaatcctggccttaagccatttattagctgtgtggccctgggcaaattacttaacctctctggacttactcccacatctatgaagccaggatgtcactcctgactaacagaagtgttataagaattagaagtaggctgggtatgctggttcgcacctgtaatcccagccctttgggaggctaaggtgggagtataactcgagctcaggagttgggagaccagcctgggcaacataaagagaccccacttctgcaaaaaaaatttttttaattagccaaaagtagtggcgcacatatgtagtcccagctctttgggaggctgaagtgggaggatcccttgagccca

SEQ ID NO: 89611 - DNA, 1050 bp, Homo sapiens
tgccaacagggttgtactcgcttacagtcccatcaatggttcatgagtgtgtttgcttctccacaccctggccaacacaccaatatattttttaaaataaacatttgtcaatctaataccaaaaagtaatagtgtatttcagtgattaaacatgcatttcaatatttcagtgctcgaatatgtatttctttgattctgaatgaacttgagcaacttttgaaaggtttagaaaatatttatatccttttgtgatgtgcatttttattttggatattttaaaaaataattcaagaagaaacagataacctctgctaacctcgaaggaactcgtctcatttcctttcagaaattacatcattttctctttattttctgagcttttgggaagatcctcaactggacaatcttggtcatgctgtcaggctccttactgtgaagctttcaaagaaagcaaacccttcaggaccttcccctaaagcagagaagctttttctaccatttgtttctctttctattccaattaaagagttatttatagggaaccattgggttgtgttcctccctcccctactaatgtctgtgcctcttaggagctgatcgctactgaatagttgagtggtctctttagcaaatgcatacatctgttgatgcttacatctttcaatgcaccgccccccagttgtatgatttaacttcctccaggttcctctgaaaattttagactaatgcttccagaaacacttacccatgattctgtatattccctatgagtggaaagagcaatgcagaggacagtatgaatgcctagactccaggcgtggttctccttccaactgggtgtttggtctagcagaggctcttggtctctctttgcctttagtgagcaccttaaaaacatgtacgggttttatattctaatatttcattcctcattgggtagattgccactgtcgtaatcacccttaatatcaggtatatttgggcttctttgtgtatgtgtgtgacaaggacggaaagttatttgccctgaattaggtggtctccattgta

SEQ ID NO: 89612 - DNA, 1035 bp, Homo sapiens
gctgtagttctaatattgagttcaactgtgaaatccatcagatgtgccaaatggagaagacagaaagcaacaaagtgaattgttctttagcccaagtggtacagtgaatttgctttaacagatgttgaaaactaaattttctactgtattcccagcacgggtgacttctttttctcttcattagccagagatgactaatttaaatttagaaccagattttaatttaaattaatatttccattaataacctattcattgcagatacctattatactgtgtaacagttgttttggaaattttatgtaaaattaaaactatcagtattttacagatgttttaattagacattgttattaacaggaacagtgcagaaactagaatcaagccttataatatcttatagaccatgcatttttgaagttagtgtccactagggtcctattaactgtacatttgcaagatttcattatttttgcctctgacactatgggaaaaattttttagaagctattgggacagattcaagcttttatgcacttggttactacagctgtaaaatgaaatctcgtcttgtagcatggattattcttctcatgttaaacccaccaaaataaaggggactaaataggtaatgattttcctagtgcatttgcatactgtgataatcctgggccttgcaatagttctacagggctcttgggcattgaattattaggatgtaattgtacatcattgtagtgttcaccttattgaagctcactctgatgttaatgagcttcgggttttgatgcttgtttagagatcagcagtcttggatgggagggaacaaagctaaataaatgttagtttggtgagcactgtgtttttgtttttgcaaatgcctcatcttagtacttctatatcccagagtgcaaaagacagatgtgatatgactaccaccccaaatcagaaggatgagcggagtggctaagagtatactctggatcctggtaacacaaaattagctctctggccttgggcaagtcacctcacctc

SEQ ID NO: 89613 - DNA, 1174 bp, Homo sapiens
ttaaaagtttccccaagtaatgtagacagtgattctcagctacagcatttttatattaatgattgtgatggattttataaattctgaattgagctaattataataattatatagcttgacagtatgctttggtttttagttgtgacttgagaagtattttgtatgatattttaaaaaaaggagaaaaaaacagttacaaagatcatcttcactaaattaaatgccatggaataatttagattgtagtttgttttataaaatcagtgtaaatgtagtgaaatgagggtgttgctgctatcaaaagttaaaaagaaaacaaatatttaactcattattgttttaacttttcttaaaagtcatatgactttctactttgtctttaacaaggtctcaaactaatcttttagaagatgacagggaggaaggcaagtgtgtaataacttttaacacagctaatctttacattatacagttggctggggaacagaccagggaattggtggatttggagaagagccgggaattaaatcacagctaatgaaccttattcgatctgtaagaaccgtgatgagaggtaagaagaaaagctaatagagcattcttaagttttaatgttgtggtttaagtagcaaggcttctgagtgtgaataccatatatgccatttgtagtgggaattttttttctctttaacatggctttgctgcttgaaagttactgggttttttttttttttttcttagtttgcttcttacttctatctaagccagttggtacaaatagaatgcttagtataatacatataatctgtttgtgtgttacctgtcagagctaaaagacaaaattatattcttgccttttggaaactgttgtttccaagttgtaaaatcacatacagtattgggaggtttccaagagaaagctgggcgtgttggtttactcctgtaatcccaacactttgagaggccaaggcaggcagatcacctgaggtcaggagtttgagaccagcctggccaacatgggtgaaaccccgtctctactaaaaatacaaaattagccagtggtgcatacctgtaatcctagctatttgggaggctgaggcaggaggatggcttgaacccgggaggtggagggtgcagtgagctgggattgtgccacgccactgcactccagcat

SEQ ID NO: 89614 - DNA, 1049 bp, Homo sapiens
agacttttagcctccaaaattatgaaaaaatttctgttaagccacccagtttgtgctgctttgttatggcagccctaggaattttatgtggatcaaaagatattttaaaagtagaggctgggcatggtggctcatgcctagcactttaggaggccaaggtgggcagatcacttgaggtcatgagtttgagaccactctggacaacatggtgaaacctgtctctactaaaaatacagaaattagcagggtgtggtggtgggcgcctgtaatcccagctactctggaggcttaggcaggagagtcacttgcctgggaagcagaggttgcattgagctgagatcacgccactgcactccaacctgggtgacagagcaagactatgtctcgaaggaagaaaaaaaaggtataaaaggcagaatttactcttggactttgggaataagagtggatgaagtcaaagatctcttggccctctgggttaagccactgagtgaagggtaatacctttactgagttaaacagtattggaggaaaatttggggtgatggtgctaggtaagaaggtgaagatataatgaaataaattttagtcatgctcagtttgagatttctatgagatacgcaagtggagatgtaaaatagccagttgcatttaaatccatagaacagcagcacgaattagggcggagattgaaatttgagtttgtcaagcatagataataaatgaagtcatgtgagaagatgaaattatgaaagaaaacagtagagtacaaaaagaattggtgccccagacagccctagaatctcctctagtatttattgtttaggtagagatggaagaactgacaggagaacttgacaagtgagcaaaacagagagatggaaaaacctagacagtgggatttcaccagagtcaggaagtgtttgaagagatactacaacagtgggatgttactgagtagcttagtacagtagtcccccctcatctgtggtttgtctttccacacttttcagttgtagcctgccatctgaaagtactaattggaaaat

SEQ ID NO: 89615 - DNA, 1415 bp, Homo sapiens
ggaatcacgaggtcaggagattgagaccatcctggctaacacggtgaaaccccgtctctactaaaaatacaaaaaattagccgggcgtggtggcgggcacctgtagtcccagctacttgggaggctgaggcaggagaatggcgtgaacccgggagtcggagcttgcagtgagccgagatcgtgccactgcactccagtttgggcgacagggccagactccatctcaaaaaaaaaaaaattattgggatattcttcatccttgttccagttccaagtgtgtgaaatccggtgtgtattttgcacctgcagcactggccacatcagagcattgattgcacatcaccggtctagacaagcggcaggacttgcagtcttcagcgaggggcggttcttagccagatggaggcggggcttcccggagagttcgttttgggccccatcggcttccgtaggaaggcgccggccgtggaggcgccacgtcccttgcggcggcgggagagaaatcgcttggacttcggggcggcctcggacggccatggcctttaccctgtactcactgctgcaggcagccctgctctgcgtcaacgccatcgcagtgctgcacgaggagcgattcctcaagaacagtgagtgggaccgcggggcgcgggctggggcggcggcggagtccccgggggcgcgtaacctaatggggccgcgtgaggggacaccaagggccgggacagaagaacagcggaaggctcggcttggagtggaagccgagcctttcctctcatcaggtttgggctcaacagccgggagaatattcaacagacacccgctgtgcagggcccagggggttggggtggagggatatagaagtcagtcagggacgcctctgcttgcgattacttcaggtcagtaatttaattcagttttctgtgactacttttttttttgagggggagtctcgctcttttgcccaggctgaagtgcagtgtcgcggtcctgtgactacttttaatagtcgaaaacccggggtctgagtttcgggctaagagttgggggtgtggggccgggcgcggtggctcccgcctgtaatcccagcactttggcaggccgaggccggcggatcatgatgtcaggagtttgggaccagcctggccaacatggtaaaaccccgtctctactaaaaatacaaagattagccggacgtggtggtggaaatacaaaaattagccgggcgggaggctgaggcaggagaatcacttaaacctgggaggcagaggttgcagtgagccgagattgcgccattgcactccagcctgggcaatagagtgagactccgtctaacaaaacaaaacaaacaaaacaaaacgagttgggtgtggaggggaaggaggcgtgacccattttggagcatcagtagttcacta

SEQ ID NO: 89616 - DNA, 1032 bp, Homo sapiens
tgagcctctccagttcccatttcctcagcacatcttcgatgacttcaaatgaatgatttctctatttcatctggccctgctagtgtttcttggcagggagactggtgtgccttaagctactgtatcccaccaggaagcagaaaactcttttccatctttgtttttgaaggatatagtcattgtaggaattttgtgttggcagttgttttctttgaggactttgaatctatcattctctatcttctggcttccattatttctgtcgagaagttggctataagtcttactgctgctctttgaaggtaatatttcttcttttctcttgctgctttaaagattttctgcgctctggtattccagttacagtgaagttaattttgtcaccatgtcccaaggggctcctgcatgcttctctgtattttccatccttctgtctttctatgctatcttctgacctataaccaggctcttgggccttcgcctgctcaggtcctcatgaccctcagttggatcactgctcagcccttcctcctgtctccctgcttcaaagcctgcttccctctaatcctttcccccatcctctaggcctaaagagctttctaacaccaaatctgaccatgccattcctctgcttaaagtatggagcaattccccatttcccatgagtaagtaaattcccagcttcttaatatgtgacttaggacactacttagctttggactgatctgtcattattttctgcctttaacgttaggctctaaaaattcttgatgggattataattctctcatgtccatgcacacacaaacatgcactccccaagttgttcccctcccacaagcctctgttcatgctgctccttctgtctggggagctcttctatccccttttgtctgactaagccacatatatttccaccacatctcagtcatcttcacctccagggagacttcccatcttgtctctgctccccacctccctcctgtttgctcccataatgacttttgcatatgtctattatcacacagactc

SEQ ID NO: 89617 - DNA, 1037 bp, Homo sapiens
cattaagagaaggggactgagtggcttgtgggggaaatgggggatggaggaaggtcctggtgtgtttctctgtggatgctctgctctggccccagattttcagaccccactcaggtgcagagtcccagcagtaaccagccccaccagcctacagtcagctttgagatctgctgttgcttctctaggttggcctcctgtggctcccagccctctctaagcatgcctctcctaaaaaacttgttctcatctctttcatgtcagtgatattttagtgacctgtgacctagtggtttgtctcctgcagatgcctggctgttgaccccaccctggaatccttggtctctgttatctcacatgctctaggcttttcctaaacttttgggactgccattgccatgttccttggtgagtctctctccttctatccggtccttaactgttggggaattctccgtatttgaccacctgctcttctcatgctatgactctccagggatctcagccactcccatgtgtcaactcacacagtgtactgatgataccccatatgactatctccagcccagacctctgctcagactcagttgtccaactttctgcctgcaatcttcaccagatgtcttggattcttcaaactctatgcatacaaccgtattccccaacctgctcttcctcttgatgtctctccagctagccagagggtgggggctcctccctcagctccactgctcccatcaagctttcatcaagtttttcttactccatagctaagtaatggtgatagctgacatatattgggcacttggtgtacatcaagtacttctctaagctccctgaagacttcgactcccataatctggacaacacccttacaaagtagggaacgttagtagcatccccatttcgcagacaagaaagctgaggcctggagccacataggtaggaaatagcagaaccaggacatgaaccaggtgctctggtttcagagtgtatgtggttatttgccaccctctcacctgtccaataatctctccaac

SEQ ID NO: 89618 - DNA, 1069 bp, Homo sapiens
catctggccgggtggggagtgccagctggcaacagggtccaccgaggcactgactccctgccctggggctctcagcaagtccagccagccagcctctgttttcccaagtgtaaaatgggtgtcaggccatttgcttctgtgggagggcctggagggctgtaattatgggagggtgtgtgaagtcctgggagccctcgatggggttttgcaaggaagctgcagacagccatgggtcatgactggttgggagagttatgaaattcctttagtaaaaagaactatgtggggagtgggcgggaggggttgatggcgactcaggaagaaagtgtctggcgcccttgggaagacatcttagcacaccccaaagccctctctcacaattcaatcaagttgttccttctgttcataccaaaagggcctttttaaaatacaattaggctctgttttattatgtgtgacagacgaggccattaaccattccgactattaaatcagacttcattaaaaaaaatggaagtaactgtaaattgccttgggtcacgatcgtttagagccgagacatttcaaagaaaaacattagggagctcacgaccatgatgaagttaatcaatttgacatcccacggagggccgggtgtgcctgcaccagaagagcggcttcacagcctctccccagagcctgctcctggggagcaggggtgtctctgcctctcctctctccaaaggagagctgggaaggctgtgaaaataacttggaaatttgggggaaagggaatttcttgtctctcagtgaggtgttattggtttgcttttctgaaaaactatctaaatttatcaaatgtgataccaagtcatacataatacattttcatgtttttgcaccaaaaagtgactttagagctgtaaggagcagtgctatataagtataatgtatcttccctagccctctaagtggggtggggtggggtggggtggcttccacggacttcctcatttctggacaggttgtgcccttaccaggcatctacttcttggcaggagtcctgagggagagaaccctgcgctggggt

SEQ ID NO: 89619 - DNA, 1068 bp, Homo sapiens
tttacatagtgattggctggagagaggtattgagcataaatttttttttaagattcaactgggaaatggatgatttacatgattttagtctctttagttgtctgggtatttcttgactgggaatagcaatatcttaaaggccatttttaacaagaatgctaaggatggaacacttgaaggaagcagtcctgtacagtcaaatacttcagttaccttggataatagaatgaaaactcaattgcctactttgaacaaattttttttttggattttaatggctggacagaataacattctgctaattttaatccttggtcatttccgatgtaatggaaaatgcagtttgactcagaatcggaggcctggggtttggaccctgattgtgccaatttatgtgactttagataaatcttttcatcagtctaccttaaagttcttcatttcctccagttccctaaaatgaggaagttagtttttagggtggttatgagaactaaatgagagcacttgagagatcattcagcctgaagtgggtactcagtattagatggctaaatctgcacagtctagaataccaggcaaaggttactctgaaggtctttgctaataacaaatctttctctaagaaagtttgtaaatgtgatgttaaactcagaaatgtcacatagaacatattggagcaattattgccgcaaaagtaactcgtagcaaccacaaaaacccagtggtgtgcagcaataaacagtttatgaattagataagtgatttcggctagatgtctctggagcagttgtagtctttcctcgttcatgagggagttggcctcacctggaaggacttggcatttttccacatgcctcctatcctccattaaacaagcatgtttttgtggaggttgtagaaggcaacaacagccaagcccaatcccataactccctttcatgtctgcatgcttcatgctaactagcattcaccagaaacaagccacatggctaaacccagtgtggaaaggcactacagagttattagaccaagggagagaacataggaggggtgaagaattggagc

SEQ ID NO: 89620 - DNA, 1099 bp, Homo sapiens
tttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgttactatgggactaatttttaattgttttaatttttatttaaactgatctttttttatatgggattacattttggtgttcactccctaaattatatggaaaccaaaaaaagtgattgtatttcacatatggacatatgattttaagagtacatgtttttgtttttttaatttggtgttacataaaagattatcctatccccccgggagataaatttatactacttaatataaccccacaacaggcgcacaccacacactgcacagtgctatttatacatttttatttatttcagagtttgcctatgctacattagcgctctaatacataagatctatgctgtaaacaaaaacatcttcaaagttgaaatttgctgaaatatacttttaacaaaataacatttttaaggctccattgaaaaatactagataagatataatctcatataatca

SEQ ID NO: 89621 - DNA, 2363 bp, Homo sapiens
aatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgatt

SEQ ID NO: 89622 - DNA, 1857 bp, Homo sapiens
gtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgat

SEQ ID NO: 89623 - DNA, 1050 bp, Homo sapiens
caccacgcccagctaatttttatatttttagtagagacggggtttcaccatgttggccaggatggtctcaatctcttgaccttgtgatccgcctgcctcggcctcccaaagtgctgggcttacaggtgtgagccaccacgcctggccctggcctgatattaatagtatctacattctctctcaggtgttccattttggatgatggtgaataataagatcaccttattaattttagtgcgatgagaaaaagatgttcttgtaaatcacttctaaaacaaggtcatcagaagtactttgactttgaggatcaaccattttgcggaataatcgtgtccaaaattatatacacaaccttttaatttctgtaaatttttaatgcagtgtacctaaacatagccattttccctgcctgtggacttgaatttcataatcattttcctgtattcttttaaacagaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgt

SEQ ID NO: 89624 - DNA, 1161 bp, Homo sapiens
aagaaaatgcttccaaagtcacactgaaatagtaaatgttacaaaactaatctcatttgtattttgtttcaggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggtatggattcaataatgtacataaacctatcatgtcaacttgcttagtttttcttgttgctaattttaggaatcagtagatgattgcatgctcatattctaaaacttgtaacccttttaaaattactttttaataatgatactcttttgacaatttcttttaccttttttaatcataggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccggtatgaaatacatatttggttcttaaatttccacagtgtaattatgtttcattgcattcttgcatattctggagttcatttgtatctattttcaatgaggttatagagtcagctgatctttatgtaaaataaagttggaggcctccaaattcaaaactgttgcaaattactgagctgccattatggaagatattaaaacatgcacaggcgtgcattttaacgtaattcagagtgttaaatatcataaaaggggtgtatatgaagggttatgtcagtttatggaaggagagatgtttgcacacggtgctcaaggaaaacttgatggcacatgatctagttgtaaaaggtgcattggatttcaatagtcataaatggggtgggcagagttgggaagtgataatcttgacaatagcatagcaattcagtttggagaatagaaaaataaggctggacaattaaattgagacaaactagatgtaggttaagaggaggaacttcattcagaagtagaaggaatacttgctaatgtgccaggcactgtgctgttttaagtgtagtatctaaaaattattatttctgttgtcaattcattctttgtaaggttgaaatatatgaaattgccatcgtt

SEQ ID NO: 89625 - DNA, 1036 bp, Homo sapiens
gttgactgactttgcctatgattgttttgtatttgaacaggagctagactaaaactactggtaaaacaaagaatccaacataaagtgatttaatgacatgggagaaatttgaaaaaatctggtatgatctatgaaactggagttttgtgtgaaaaatactgaaaatctggtatcatctgtggaaaccgatacagatactatgtctacttcctgagcttttgccagtgcaggctggcatagagcatgtaaagatgattatattaaatctatttttggcttgaattgttcacgcatttcttccttttattatttttttatttttttctttttcagatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggtatgttttattttccttgttgtgaaaaataaatgctgtatactcataatgtaggcattgcatggtgtgccacatcaagagcttgtgtgcagtaaaaccagctttctctctggtggtttaagtgccgacacatttaagtgcacaggcttcactgcttctaatagatcctggtgatgcttcagctgcaaactcttcaacttttatttggcacccttggtactggaaagttcttcaataaatatgtgttaagataagtttaatttgctgagtctctaccagtcataaaattgccatgttcagatttgggggttaatacttttttataaatcatgtttttttgttttgttttgtttttgttttttttcagtttctttatatagctcccaggttttttccccctttggtgagtttatatattaaatgaaatctgcttgctgttcatctgaaatgagatatctaaaacaagaactgcatttaatatagttcaaaa

SEQ ID NO: 89626 - DNA, 1681 bp, Homo sapiens
aatcacttcattttcttttttgcgtatatggtatttgttcatttcatctcatcatattcatcaccatccacatttatttgtgaactacataaatatacctcagttctcaaaacagtcacaactgggtaaagagttgcagtagtctgaggaagttactatcacatcattgttggtatttatcattcttcacactagttccttttctgactcttcagtcacctccagaattaatatccttagaagcatctctaaaatgagtttgatttactaaacatagaagttgacaaagtttttcaagtataactgcataaactctcttttttaaaaaatcagtttttcccaagttgttagcctttcattggcatttgagtcatttatgtgacatatttataagaaacatctgctagtgctgctgcatacttttatcagatccattaaatagtacatttttgttcttgattctcactaaaactaactaaatggctgtcattcttttctttatgcttttattgtactaatttagcccatttgactgcacttttttttttttttttttaaagttccctcctttcttttccccttgcttcccaacaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccaggtaggaatattgcaagtttttttcttggttttgaattaaatgcctgaacttcagtatatttaagtactcttgtgacccaggaaaattttagtgtaaattctaataaattaccttaaattgtgcatattatttggtggtaattaaaatttttttatttttaaaaatttttaatgagaaaacatatctgtttcttggaatagcatatgatttggcatgaaagtgcatatccaggaaatcctgtagattggcagtctgctcagcgctatgctgatgtgcttctacatgtccctgctgcagtaacattttcaagcattttgcacttggagtgcttttagaagtactttaatgacatcatttgtatgtacaccgtttagtaaagcttgtaacaagacttttcatttagttagctgtctacctgaaactattaaaaaatatagcagtagctgcgtttttggaaaatttcctatatctgattttacagataaagacaatgttaagttttccaatggggatttatgaacttttatggtaatataatattaccaggatcacattgttcccaaaagtttgagataaattagaacttggaaatttggataatagactacctaagttagagccataatcagatttgtcattttctcagtaactagtatatatcgagtaggtggaccctagctttaaaaattaagctacaacttctcttcttgttgaaaactttaaaaaaggttcccccactcccctttgctctttgccattaacttggatttcttgaactttttcagttttgcctccagtattagtgccccgacacaccgagatcctaacagaacttccgcctctggatgactatactcactccattccagaaaacactaacttcccagcaggaa

SEQ ID NO: 89627 - DNA, 1072 bp, Homo sapiens
ttttgaaatactcctttatccgcattgaagttttgatgattttgtaatatgtaagaaatggacttttcagaaaagtacaacttagtacttgagacattggctgtcaaagttccattccaaaacttccttttaagctctctttcccttctctcactgaccagaagttactatgaaatgaaataaaggtagggaaaaagggagaattatctctgagctgcccatattctggagagaaatgtgggagaaaatttttaaggtggtatactaaattagaatgacttcaaagtctatttctttatttattctagagatgagaacaaaataattttcagtaaaacttaaaaatatcatgaccagataacctgaaaatcttaactgtggatgcatgtctatttttattgggatttttttctatattaaaaatcagttgacatctgtttttagataattttttaaaaaactggattataaaatgaagcacttagtaaagctgatggcagaggttttagatcttttgaatacaggaaagtggtaagggcattataggtatgattcattgagctagagggcgttggtgttcacattttaaaaacataatcatgacttatctggagtcacatgttccattttattggcttccttcatatagaaaatatagtaaccagcactacatgcctgtgaaaaagtgaagcaattgtatattttctgggtgaaggaagtattctgtacattctccatgttttacatcatggtattttgaataaccatgcttccatgttcacatcaattttttgtttttcaatttatgcacagcacttgctctgaaatttggggactgagtacaccaaatacgatagatcagtgggatacaacaggcctttacagcttctctgaacaaaccaggtgaatattctgccctctgtcgaatcttagagatcttgtgggaggggggtatattttgaaagacctatatggggttgcttagtataattttgcctaggatgtttccttaatgtaaaataaggcatagcatttaaaatatctgcttgccagtataaaaaatatattaaat

SEQ ID NO: 89628 - DNA, 1049 bp, Homo sapiens
ttggacttccaacctccacaggactccatcacacattactgtcacatcagattacagtccagccagccacttaagatcgtgccccttttctctcagactccctcttcctgctatttcagaaccgggaggggccttaaaaataatagctggagagtactggaagaggtagcgtgaaaagaattaatgagatagtaagattttggctttgctgtggctggattttaatttctgaagacatttattgttaatacaaatatctggatatgactaggaagtgttgaaatctttttgggattttgtgcagacaggataaaagcagcttgggaagagcttgttggagagcaatgactagagtggtggtggaagggagctcactaagtctagtttgtttcatgagctgtctgtatcctctttttgaaaattgagaattccaaatttagtggttgctggggacaggaagaatatgtggggagaaaagagggatgttacgtgtgtctacgtgaaatacatgccattttaacaaaagccttttctttttttttttttttgcatataatcatgatactggttaaattagccagtgatgctttattttcaaagaaatgttacaactacagttttcttctattatcatcatcgttttccttgaagcggtaggttagtctttactctcaaaatccaacttttaactctgactttgggttatgatgggaagcgctatgaaatggtcttggtgctcttatgaaactgtgatcactaataatacttaaattagaactgaaatatataaggagacttctcactaactccttcaccccagccttttgtcttttagaactttgcttatctttatggttagatagatagatagatagatagatagatagatagatagatagatggatagatatagatatagtttctctgaaatttgctaggacaacggggtttgggggcaatgaaagaaggttttatatttatgtttaggatgatagggacattgagagatactgaacacaaatttataatgaagttaagtaatttaaaag

SEQ ID NO: 89629 - DNA, 1602 bp, Homo sapiens
ggatctcggctcactgcaacttccgcctcccaggttcaagcgattcacctgcctcagcctcccaagtagctgggattataggcatgcgccaccatgcctgtctaattttgtattttttagtagagacagggtttctccatgttggtcaggctggtttcgaactcctgacctcaggtgacccgcccgcctcggcctcccaaagtgctgggattacaggcatgagccaccatgcccggccacctcttacagacttttaaacatcagagtaattagtaactttatgcagactgtcttggaatagagcagttgtcattaaaaaaactgtcatcttttatttctaacctcatgttcatacccttttgcttctctaggtaaccaggaatagctaaagagaagtctttttgaacccaaactgtagtattcttccattcttaagcaactgctttttcataataggataattctttcttctcattcatacataggcatgtgcgtgtgtctgtctgtatcgtaatatgtatgaaacactatggtggagggaactctgaatttcaagtttgataacctgtttttgtgtcagcttctttagtattgatgaatgtagatcctagggaatatgactgtactttttttactgttcacagctgtgaaaggcagtagtgctatctgagtactttcacagtatgacttttgggtccattgaaataatgtaaatgagcttcataagctataaaacattatagctaggaatatgatttattggaaatattcagatattctaggtcttcgttctctatttttgtttttcaggagaactcacattaaattgtagacattaaaatgtattgtctctgcttagaaaaagtttttgccaggcaacattgcatgatgtataatttagtttattaaatgtataaaatttgttgataaagtcagagcaataaaactttataaatatgaattagaactttgaggttatggggaatagggaccttttatcagccttatcatccagtttgtcatatacagtttataaatgtgaaagcacttgtgatgaggtcaagtatcacgtgaaacacactttggaaggcactttgctaagccctggaccttatctggtgcctacatttacagttaggtattttgagggggctcctgctccaggacctggtattcaaagtcccttgtgtatatggtatattcttgcatggggcatttttatcacttaccttatcagggaaaatacctacctgccctaggacctttgtccctttataaaaattactgaaattatacctaaattaatcaatttctgtaattttatcatgtaacacctgatgcaatgaacaatataccctcttttcttgtcctgtttaacatattagcttcaggaaagagtcaacctagctaaaataggcatttaaaaaattacagtaatcttttgttttcccaacatccttggtctgtttccagtccttttttttttttttgagatggagtctcgctctgtcacccaggctggagtgcagtggcgtgatgtcggctcactgcaagctctgcctcccggattcacgccattctcctgcctcagcctcctgagta

SEQ ID NO: 89630 - DNA, 1053 bp, Homo sapiens
tagcttaaacagaattattcaaaatgtgatacacaatggatttgtaagcacgtttactcagaatttcaagtaaaatgttagtaaagtgcctttatggttttataagccaaaaaatacaactaagttcagctgatgaagaacgggaaacaaattgcttaattttaagaaatggcaaatgttttctgttgaaatgtttactgaacagttcctcctctctactttcagccccttaatattagagtggggttaaagttagggcagaaacatagtcctggctttgtgtccctcccactcccctcatctcattactcttgttgcctctggcagtttaaaagctgtagttatagatacgtcactgtcgctcccttcccaccattttctgtggtgacacagagtaatttataggtagagcttaacctcaataaaagctgcagtgagctaaataataaaaaatttcaggaagctttttcatctcaaacatttttgagtccgagggatgggagacaacttggtcgtgaaatcagaatggcaattgatatttagataaagaatcagacataaggaaaaagctttcaatatattattatccacagtaaagcaaaattgaaattgcagtggggatggaggtctgtaaagttaaaagtaaggactatggggtctaaaatggctattttataatattgattatacataaatgtataggaatgcaaaatttattttcataagcataaattaaaaggactttcctaaggtggtactctgaccatgtaatcacatttttgatctttcatcccaaggaaataatcagaatattgtcaaagattcctgatgtttgtttcagtatcattttttccaccagtccattggaatctgtattgtttttaatatgaattagaaaaaacccagtcctaacctttagtttctttaataaagaacacttaagcttattttataccacaattaaacaagaatagcgaaagaaaagtttatgccactctttataaacatagatgcaaaagtcataaataaaatatcagaaactagaattcagtg

SEQ ID NO: 89631 - DNA, 1427 bp, Homo sapiens
tcctgccttcctaagggatagaaatacacgataaacaagtaaacaaattaattataatttgatatggtaatgagtgcaaagaagacaaccaaatgcagtgatatgatagaatgaagaattaaaaagctgctttgggtcggattgtgatgcttgcgtggagcttggagaagcagcagccaactgagggaagagtcttctaggcagagggaagagccagagtgaagacactgaggtgagcttcttgtattagaatatttaaaaggagcccagtgtagatggaggacaagacttgcccaaagcttatacagggcatcctagagtgtggtgagagtttgaatgttagtctgaatataacaggatgcaagtaagtttattctgatggattttaaagaggatcttacatatttttacaaagatttttctggctgcgggagagtggtatgtgtgtagtagggtagatggaagcaggaaaattaggaggctgtgaggaatctaaatgcaagacgatagaggctggactggcgtggtggctgtgctagcacacgaagtaaacagatttggcatgggttttagaagtggaactgaggacttcctggtgaatgggctgagaagtcaagctatatttcattcttcattgtgtagtgcttgggatttcaattaggtaaccatttatcatatgcccactatgtgcctggtgtgctcttcctcactggagttaagatacagtgtttgcttttaaactacttacttcctagtaagggagataaacttagaaaaagatggtttcatgaggcttggtagatgttataaaagaagtatgcttggggctatatccagaggaggcttgtggaaagtttccttctggaggaatactggtgattttgagttgagcggggtaaaggaggaattaggagaagcctgtttcatcacatgtagtgcggtggtgtggagattgggaggtgggggaggattggtgaagcgttccaaacaagttgggtatccttagagtataaagtaaggggtggcaaatggccatagtgtgtataggtagtaaggagtcacttcatgctgtgccagtgttcacacttaacctgagggtgacgggtgaggttggggccgtttaagtgccgtagggtctgaaggctcagaagtcagattaatttcaagtgcaacgtgggttgcagcgagaaaactccttgaggctgtcaagaatggaggccgggagactggtatcacttgattgaagggagctgtgtgatacagcagagatagagccatgtttttgcacaacttcaacaaggctcaagttgccattgcagtgaggttatccagagcagagcctgagagagtctaatcttttagggaggtacagcagtactaaaattggccattgctggtatttaacctgtggaggaggtcaccttagt

SEQ ID NO: 89632 - DNA, 1033 bp, Homo sapiens
atagtattggtggtgaaaaatcgttaaaagtatctgattttacttgcaaaattactgtattttcccacaagaggagtccttacaacattcttgtttttagaagggtttgtttccatcattcatttaaattcataaagataacgttttcatgggtggagaagtctattgggaaagtcataattcgaatttctatcttgctttgcagtttgctttctatgataagttgaaattattacttgatgttcaaggtagtctctacatcatcctttcaatatttctgctaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtaagttttgttagatcccaggtttgatcaaattatgtcaaggaatctgaaggaaagttactgaatttgtgttcctttcaagttgcctgtaaaaagtgatgattgaaatatgactgtttttaaccttgtataaattgtttttgctagctgacttgttttataaattattttcttgaatagtgaggtttaatcaagctaaataagatacttagatttattatcttcattgcctacatttgtatgttatcctcatttccgtgattgaatgatacttgaataaagaattgaagctttttctatcactaacatagtagcaacctacagttttctcctcctttagtcaaaactttcatcaggggtgaaaagaggctgctcactttttaatgaattttatatggtttttctttgcgttgcagcattgcttccaagaaagaatagtgtgttaggtggcttcttaatt

SEQ ID NO: 89633 - DNA, 1016 bp, Homo sapiens
gagagattactcatgctaactcaaaaagaggttttgttctgaggatataattgtggagctggaacaggcctggacagtcctcagaaaccaagcctagagattggctgctctgcttttcttcaagacaccagttgtctctgcctagctctggcacacactcttacttgtacactgactgctagctcccctgagtctactatattttatgctgcctcctggccatgtgatgaacatagttacttacataaaggcatgtataaaactgaccctttagccttcagggttgcttctctttcctcattcctaatagtgatgaatgtaccattacatgccactcagttacattaggtagtcggtcacattagttgtgtttcaatccttttccctaaactgcacgtccagtaggtcattcaaaatgcaaattgtcactggaataaatgaagtaatactcctatcattagcagtaatttctgtcttcagctctttaatctgcactggccttattttcccctcatcttctgccacagtgcttcctgtgcaccgtattttagtgataacctaaatttttcgtctctcctaaaacgtttcctgtctttagaaaacatgctgaactttctgcctgctgtactatctctctcaatacttgtgctctggtgtcaactttagtgtcacctttcccttccaaaggttgaatcctgttctctgtgctaggataagactgtgtcacatgatactacggtgtctgtagttggctcctctagagcatactttgtggcacagagtaggaatccaacaggggccaaaggtagccaagtacactttttgctgcctgatagtcccaggttattagttggtagatgattacatgcgtttgatggagttttgtgtatttgctttattttatcaagttacatactacagtgcttatttatgtgtcgtattataggtctaccactatagacagtttaaccgggctgttaagttcactgttgctcttttatttgcattacagttcc

SEQ ID NO: 89634 - DNA, 1033 bp, Homo sapiens
caacataaaatgaaaagtcattctaaggatttggagatttttttgtaatacatactcagtgatagggtttatgtcagaataaaaacagtaagaaaaggaccacatagttgaggactctggaaagagtatgcactgttgtttaattaaatgtgcagagaatgctatttgtcaaactataatatagagttaataacttgaaggctttactacaagttcaggataattagacctcttaccttattgaaactttccggtgagtaatcgtagaatcctaattttactaaggtatcatttggtaagctgacttattcagctgtaaagatagtctttgtgttcttttgaaatctgcattatgtaagtatcacttattgctggaattagaaatagtgtctgaacttagatttcaattcttgcagatgttgaaaatttatttcagtagagaacttgctgccacaccattgaaggaaatctgtatattctgtaaatgactcattcacgttttgatagcaacttgattataaatctagttttcttttttgtatttcatttgtttttaacctggaacacattgttatctgttccttgtcagcctacattcagtctatttacacttcaaaaatattggctaaaaatgcttcagtttttaaaataaaagcttaactaattgaagatgtattatcagcattacttacaacaaatgttattttattacataatttaaaaattctccggagatattagacagatgtcagccaaccatggttactgagacatgcaaaggtaaggctggcaactttaagtgttcacttagttccaaaatggttttaactcctcttgtaagacatgggacactgaaatcatgtggcaataccaggtcatgtggccattcagatgacccagaataggcctaaacttaagttagtttcatttcagtgaagaaacaatattgtaaaggttttatagaaaacttttagatccccaggaatacagcttaactcataagaaacatttctcctaacgaaagtgtaacagg

SEQ ID NO: 89635 - DNA, 1010 bp, Homo sapiens
ctcaggtgattcgcccaccttggcctcccaaagtgttgggattacatgcgtgagccactgcgcccggcctaaaattcttaatagacaggtagttaggttgtagttcatgttagctgatcaattaaacttttttttaaaaaatgttttagttatcaggagggtccagctttggcctgaggttgtgcattggccatttctgctcgaaaccagtagtagtcagacttaaaacatgtgcacacctgcacacacagcagcaactagaaagcctttagagagaaatatgcagaatttcgaaatgtaaaacagataaaaggagtaaagctgttttgtggaaggaagaataggcagttgttgaagtcctgcctgatcagttttcctctcatcctcaccaccaggaagcctttgaagcacagctgaagaacagtaggtcttggagaaatttttgctgtagacctgctctatcttaacaggtagctgccagccacatgtggctatttagcacttgaaatgtggctgctgtgactgagaaactgaatgttaaattttacttaatctaaatttagatagccatatgcagctgatggctactgtattagacagcacagatacccaaggacatttacatcattgtataaagttgtgttgggtggcactactctagactttgctttaattgagcttttatggcctgaggaccccactcacgtgaattgacgtggtattagttgctgcttcagaagagggtcaggatagactttgggaatttgaagagcaattagagtacttgtactttatatttgtgctgatttgagtctgggcctgtgtagtgttgtcataggtgctttttttttttttttaataatctgggaatgataaaccaatatgtaagttacgtgtttacaagttgattatagagttgtggattccacaaaactcattataggtgataggaatataactcttagttaaaaaaaaaaaaataagtagtctctttacacagcagtccctat

SEQ ID NO: 89636 - DNA, 1058 bp, Homo sapiens
ctttctaatccaaatgatttgcctacactgttattatggacctattgtaaaatgtatttgagaagcagacaatgaacaacaaaggcctgggatagccaaattgtcccagtccatagcttaaagcttaggagagccttggagacccttaataagaatgtgttggcatttatttaaagtgtttctaacaagcaaagttatctggcttctaaacctgcactagattagaaacaagtagattatgggtactgtgggaggcttagagggggtgtggtgggggctggggagtaggatgttagcctagtgtctcttgtcagaaaaaacagataacagctcggtgaggataatagagataatctacaagacacaaaaatagtcaaagcctgactagcatgtctggggccattgagtgcaggaccagacctgaaagcatagtaatgaatgttcatcaattagcctaaatcatgtttgggaaaatctttttaagagtgcaataatctacgtaatatactttagattgtcactcaggatgattaagaaatgttcttaaaggggttgaagattgtgctatagcttatggcttatttcatgaaagatcacagtagctgttatgaccaagatgtttttcatttgttttgccattcagacagccattcagattccaagctgaaagggtagccagcagtaaagaaaggctgtttcagtgtggtagcaccctatgtcacccctttctttggtgtaagtaatttttttgtcagtctgcaggagtatcatataaattttcacttgtgctttgacagtagtgtatgcttttcactgtgttttgagatagagtatgctcgagatttctaggataaagcaagagtggatagttggccagtctctctgttgagggtttcttgactcttgtcatgtgacttctgcccagtattagcactgataatttttttgatcccctttcttgtaaccttacctcagggttacttcttaaaccatctacaccatcagataattattggtgaccttgtaatatgtagccttggctgtttttaagaatcagg

SEQ ID NO: 89637 - DNA, 1034 bp, Homo sapiens
ccatcggaagaggaaggaacaaaaggtcccggaccccccggatctgacggggcgggacctggcgccaccttgcaggtaaagcctgggcgcccgcgggcctccagctagggaagtgtttgcgtgcgtccgcggccggggcgatgggccgtgtcacatggccgctgcgggtgggggctggggtgtggtgagttcgggggctgtgggtgcgccggcccgggcgtgcgggttcggggccggagagccgggaagggacggggctcggttgcactgcgctgccgcccaggctgacgggggcgggggctgcctgcgtcccttcccctcgctgctctcacactccatagtttgtggttctgatttttaaagccgaagggccagagctcttgtttcaggagttgtggggaagccttgttagggacgcgtaatactttgcctccactttttttttttggtctcgtaacctttgttaacagtggtagtctcgggttttccatggcttgtgtgtactcacaaacacgcacacagctgataactctgtgatcatccttcactcacttgtgaaagttgttctgcgggtggagcctattagtttttatcacacgcctttggaaagccctcgaagtgatttctcgtatttcaaacttggtttttaaaattgcaacttactttgttctcttggagggggatattgtctttgggtcaggtacttttgtcttttacttatccttaaaatgtccttttgatcctaaacagaaaaagaatgcctgggttggttttgttattcctttctcttgaccctttaaaagcaaaataccaccagtgtgttgtcaaccatacctttaaaaaagaaatttccaggtaaaacgaatttgcaagcagcattttccatcaaagtcatgtcttgtttgttgcaatttggactatcttaaatttgggtttgtgaaacttttaaaacgacatgtgtaaaataattgttaataaataaataacttggaataattacatctttttagaaatggtctttgaaatgtgattta

SEQ ID NO: 89638 - DNA, 1071 bp, Homo sapiens
cttcatttggtaggcatttgctgaatttgcctgagcaggcgctggggaggaacaagttaagggagggtggagtgagggaacaaacatttctttggcacccggtactacatgccaagaggcgctctcttaggtgcacaaagatggattatatgttcagcccgagagcagagctgggaactcctaggagagcggatttgggaggatggggcatcttcaactggtgtttctgatttctggacgtgctgggagattagcggacagagcaggtggggcctctgaaggctcttctgtttaacctgaacatcctccctttcaactgcagggaggatgacgctgacctgtgtcgtgtcatttctacctttctacctggggaaaggtagaaaggagtcacctgcccctcctccacccagaaacaggcctgagagctcttgctctccctgcagctgcaggggaagcctccagatgccatcctgggagtggggaggcaggaggaggaatcaatcaacccaaaactgtgcaatcgctaagccgatgatctcagccaagcccacggtgagggaagaagggctgctctgtgtttcctggaactccaggcatcaaacagatcctgtggaggttctagcatgttcttcctctctgggctggctgttcccatttccatctggcttctccttattgggcactgggcttgaagccctttgtcgcatcaccagcctctttggataagaatgagcagatctgcagctaagactggagagcttgtgtcctttctctcccatagaacagtaagggcatttgggaggggagaaatgaccaagtggaggccagtatgccttgaggagctgtttggcagtgccatctacccagcacattgatgaagctcaaatgcgtcctcttcatgctaatgcctgtagcactgtgggtgggggaggcagagttgagaaaacacatggaagtctgtatcctggggaaattgccaaacgcctcttttctctccttgtaccttgtgccacctccctcttctctgcgcactttgatagatgacctattttgatgctggcaaagatgtga

SEQ ID NO: 89639 - DNA, 1051 bp, Homo sapiens
tttctattggacagttctgttcgagagagaagctgcacaaagagataaccagcactcaggccacctctgcttcaggagttaagagaggaaagagcactgtgggctggagtcatctgacaaggggttggaggcagtggaactggaaggtagatgggtctgattctggtaagacaggcaaggggtgggtctgtctggcctgggtccagcacagtggggagcaggatcccatcctgcagccaagtgcctggccggacaacttttctggaagtgaaggctttggtagggaccatgggaagttaaggctggacagataggcctgggtcatgctgagcattcaaggtctcagcctctgtccacttccccaggactcatccccagtcctctgcttctctctttgttggtgctgatgctcagcccagctagaggcccacagcagggagaagtagctgacggaggacttggtttgttcttcctgccttgcttgtctataaggcctgcagacagcaattgttcaggaaagtgcaggatcgcatctggaagtctgtaggtgtccttgcaaaggacttttaactccctgggcaagaattccctttgatagcgattggaaccccaggattaggcaggagagccaagcaccgaagccccctggtagagctctgccacacacacgccacccgtgtccctggcactcacacctcatttgtccttggtacacagcaacagtccctgtgactggcccagcacctgctacgctctcacctttcccttttatgatctgagaaaatccggggactcacaggaaaaaccacatgctgtctctggctgtgggtgttttcctggcacttcccgcgatgggtcccaccttatgggaaccttcctgagcactggcctctggccaagggtgggaagggcatggaactacccacctcactgccctgccacggaccacactcccacctccttcacccagttctgaatcccagaactatccttgctggtcttgggaagagaggaacgctatgaagggccagtgtcaaccctgcgtgatcgg

SEQ ID NO: 89640 - DNA, 1127 bp, Homo sapiens
ggttacaggagaacccttcaacaagaccgtcattcatccattctctcacccaataaccatttttattttattttattttattttatttattttttgagacagagactcactctgtcacccaggctggagtgcaatggtgcaatctcggctcattgcaatctctacctcccaggttcaagtgattctcctgcctcagcctctggagtagctaggatgacaagggtgtgccaccacccctggctaatttttgtatttttattagagatgaggtttcaccatgttgaccaggctggtctcgaacccctgacttcaggtgatcaacctgcctcggcctcccaaagtgctgggattagttacatgggtggcatgagccaccgtgctcggcccaataatcatttattgacatccctgctggccaaccctgctccagggctctcctctcaaataggcagcttgttctttcttgctctgaccaccagacttctggcttgaaggatagtttaggtctataaatggccttgaccttgcagacctctgttctcacctctatgtaaaatggccatcgtgcttgccatggaactgcctcaaagtggccatgagaatccaaggactccttatttttctccagacctaggaatgtgtctaagttctgatgcatgtcatttggggagtattaagatcacctgttatattgccaaagttcaaattcccacctggttactaccaggagggaattgggggagatttttgcagcaaattcagctgccccagagtgagaagaataacccagaaatgccttgccaggttgaaaagtgctgtgaaatgtggttgaaaacacaattactgtctctcaggcagggcagctaatatatgagcatggttggacactgccttttatcaccttgactgctgtttccccagagctgcatccaggtagaaccattcagctccatgctccctttttcgtttcaaagtgttccattttaatgaaacagatatgaggtcagggaacagaagtcacttaagaagtaaatgcatatgcaaaccactgtgtaactcactgcaattgaaaatgcagtaaaaccttgattaagtgtaccccaagtaaccagaactctcaattaact

SEQ ID NO: 89641 - DNA, 1148 bp, Homo sapiens
atagtctagctatgagcaacctgaaggggctctcaggtggaagagaaatcaggcttattcctttgctccagtggacagagttacaatcaatgagtaggtcatgtggaagttcgatctgggcttcatatgataactctctaacaaagagagccaggccaaggaccgcctggactgtctggggagcaaaccagcctccagctgctgggcgcattctggcagctgctgggtcaccaagcattgcggtgagagaagactcttcccaatttgtgccctgacccgaaactgatggtgggtttctgggtgtgtcacctccacctccccaccccatcctttctcatgctctcgtcctcagctcctcttatggaccctagaatgggggctcaagcaacgtttgttgatttgagtcggaataaaaaacaagcccaaattcaataagaaaaggaatgcttggattaggggaatgtcagcagggactttgttcttatgctttaattttttccaaggagtgcaacgaattcatgtaaggtttatgaagtgaacaatggatttcaaaattaaaaagtcagtgatgaaactttaagagactccttctatgtcattttccccccatttcctcaatatttggtaacccaaggtgagctactccccaggactgttctgaacctgtcacagttatccaggggagggaggcagaggagagaagaccagagccctggctgggggtcggcaggagggaggtgtgggaggcatgctctgttttcacctgggatgggagagatgtgatgaggggcccagaggcagctttgccaagtcagtggcctggtactggggttttcgtgtggacgggtgtctgcactcactcattattaaagaccaaccttctcaaaacagaaaccaaaacatctatatatcttatatgaaactaaggcatagccagccagtgagcaaaaaaagggagaaaacataaacacagtttttggcaggcaagttagcaatttcggaccctgaaattattacgtacattctcttccagccagcaattctacttctcattgtttatcctaataaatagttaagtatgtaaaatggtttgttaaataatattaatctcagtatgattatattgtggaaatgactttaaatgtcca

SEQ ID NO: 89642 - DNA, 1018 bp, Homo sapiens
gagatgctacagcccagggtgtcaggcccctccagacagagccccaaggacaagttcgaccagccccatagatccgcatcccctcctgcaaggagtcagagtccaagagggaatatttcaactttcttgtgtgtgttgggagtggggggcggttagagtgcatgcagtacataagcagctcccatctggtctgttcattcactcatctgctcattcattcgtttgctgagcagctacaatggtgctaatagagtggaggctcaggtgtgagcagttcttcttcctcctgggttggactgaatgtacagcaggacaagaatcccggaagcccaaagtagctagttcattcactgggaaggccactccccaccacctgaactccaacccttgcattttgctgcccatttcggatacttcaccagagcctgttgtaacatattaagtcagtaatcacagggattactgtgatcccagccctcaccagcctcagctgctctgggccttctcagaagaattggctgcaaccatctggcaccatgaatttaatggtgcctcttgcttggaggcctcttatacagggagcttgcacgtgggcaggacagcatgatagtctctgccctccacctccctcataccctactgcagcacctgtgtgcctataaaataaagatgaaacaactacattttcataacaaaagagaaaaaaatgaccaacaatcagccaaaggtaggaaaatggtaatatcaattgtcgaccatccattcagttgaatattatacgccattaaaataacagatccagacactgtacagcaccatggactgggttctgaggccctgaagaactgtgctgcccacacctctgtgcctacactgggctgtgctggcattgctgttggtccaagaagatctcagtttccatagcctctgagagttttggtcacagcaacatgaacagcccgatctagatggctccaagctcagctggctcggctgcaggagcctggcacctcctccc

SEQ ID NO: 89643 - DNA, 1171 bp, Homo sapiens
gagatgatgaaaaagccgaacaaagcccgcagtctgtctgcctgactgcaaccctcaggcaagcctgggatggcaggcggtgggaatgggtccctcatgtgaatgtattaggagacactgagtagcaggtacctttcctggaagtcaacagcacatgctggaatagaatctgcaccacagtccttagagccaagcaaaatgcaaccaaccacctttgagaaccatggtgttttgttactaattatcttttgcacatgcttttactactcagttattgtttatcgtatattaagttcattattactacagaggagccagctggaagggggtggggtgaatctgcattgccccctgctgttctgtgaggattactagggtctctgggcacctgcaggggtttggagatggtgggctgaacagttccagcaccatgggattaaggctgagcactcaccctcaggtagctgagacccaggaatcctgataggatgctggctggcatttttggtttggtgtctgtgaagtgctatctgagccagcccagggggctccagttcctcaaggagcaggggtgggtgagaaagcaggaaagcaaggacagcttttgggaatggacaggcagaattttaacactggttgggagaaagccccttgcagttttcccctctctccacctctctgctctgaggacagcagcggtggccagttgggacagccaggatggagtctagggccaggtcaaggcaggagcagcaactgctgagccacaccctcagctttcatcagccgtggcaggagaaacgccacggtcacaggcagaatgcaggggccactgggaagcaggggaggggcagaggtttgctgcatgggagctctgagtcaaaaactactttcaaaattacagctactgtgtgctagatatatcgcataatttatctttttgatcttctcatcagctcagaggacagctatgattatcccactgaacagataaacaacctgggactcagaagttccaagtagtccacagtgactcaattagaaagtgggtgaactgaggtgggaacccagatctaagtggattcttatccagtaagggcttcctgctgtggaagccgtgtaagggatctcactcctgaatggaattctggactagatagtgtccgtagga

SEQ ID NO: 89644 - DNA, 2042 bp, Homo sapiens
atgtgcctccctatgcctttaaaggcaaagggaagaggagagttttgatattcagagtccagcccttttgtggaagacaaagatggggttgattctgacatcccaacatcactgctctcaaagggcatatcttgcccaggcaccagaagccccagctgggaacccaccctgcctggcttcgggtacccattgttccactcaacagctgtgtgctttggggacagtgacttaacatccctgggcctgcatttcctcccttgtgaaatggaagttatagtgctgtccaaaccaccagatgagaagtaaacaagataatacttgcaaagcgcttagcacagtgcctgacacccactaagtgctcaataagggctcatcgtgattattttcaagtgtgtgtcccatcttatgcaagagacagctctggaaaagttgcgaaaccaaatcccgttttcccactaactgacttcatcactgcaccaagactttatctttgcctctgatcatctgtggagggcagtgactctgaacacctcagcaccaggcttcctgcctcctcccagctccatgatctccttctcatgcaatggaaaaataagaaatgtaggtggcatgaataatgattctttatgatacctatttgttaaatgtagatttgtttgttctattcatgtatcaatcatctgttctatctatcatctgtccatcaatcatctatctgagaaatgccacctatgattattttatctttccctaccataggtaaaacaatatataattcatacaacgaacaaattatagttctagtcaacaacctgcctttcacctggattttttttttaacattttagaggtcataaactttcttgaaaatttgatgaatactaatgggctgtctcccagaaaaaggatcatacttacatacttgtacagttttgcatatggtttagctggggatttaaggattctctgaagcccaccagagacactgttaaggaccctgtggaagccagagcccagctctcctatgtaaacaccctgtgtcccagtagtagcacatggctgattaggtgtgcactgaagccctccccaccatattcagactcctaagactggcaggccaactcacccccttgcccactgtcaactggtcccacccatcctcctacagtgtcctccctcctgtgacagggctggctggcctgtgtccctccccttggctgtcactcacctttgtcccactgcttccccacccgcatatctacatctgacctacagtgcgagtatggaatgacatctgactgatcagagcaggcccagggaggatgtggagctcgagcagagagaagagaggcccagttgtcaaggcagagaaaccacgaaaagcatggaaacgtgagctcctagttcagggggtgaagtcacagctggcagggagattggaacagagagagaatgtgtttcaagcttgatttttccctcctgtctgattggagattgaagaactcagcagtggcaaaacgccctggcccatgaacaagaactccctgggttctggtcttagttctggcattgactaggtgtgtagctctgggcaggtcacaggtcgcttcgacaatccagcctccgtttccttatctttagagtgaggagactgaaatgctggcagcgctgtggtgagacggactcttttgaacagtgcaggtgtcagcctaagtggaaaatgcaatttagtgctatatgttaggcaccatgaacatgttcataccccctttcatccttctaagaatctcatctaaggcagtcattcaaaatatgagggcagtatgtctaaggatgctcatcctaatgttagctataatacggaaaaggtcccggtgtcccagagtagaggagcggttaagtatgtcatgccgtgtccactggtgacattttatgcagctattaaaaggaatcactgtggtgaacatgcttcagatgcaatccagcagttgaaaacctcctcctgctcccatcctccagccacaacacacctgaaggagggc

SEQ ID NO: 89645 - DNA, 1750 bp, Homo sapiens
atgccagcgggtgttctaagcactttacagatattagctcaggtaatccactcagcttttacagatgaggaaactgaggcagagagagactaaagcatttgcctcacgtcacacagtgagtgatagcagagccaggatgcagagtctgccttcgagtccctgctgttaagtgctgtctttctgctgggactgccaggttcttgccattttgacaagtaatataaccaactgggtctctgtttcctcctcataaaatggagagaataatattaactgtcgagtggtcactttgagaagtgtgaagggctccgcagacagaaggaccacttcttatctgatcatgttcccagctggggttggtttgtctccgtttcctcatccgcccacagttagcaggctctggcagctcttattgccttgtaggaccagtgagttcccaaggagatttctggacccctttccccatggcaaccttctcatgttcaaccccaagccaaacctattgtctatattattctatgttatttctatgctatttatattgctatgttatttatatgattcttcttgctgttaatgcttttatttattgaaaagctctcctcagagagtacccccaggttataggcaaaagccacatagaggaagctgtctaaggtcacccagagaaccctgcttgaccagagttggtggctctaccctctcccaccctttgaaatggcagcttgcctaccctggaccactggttcactctcagctaaaattctggcctgtattcagaagatgccttattccaccaccaacactaaaggttggggaaagcctctgagtgacaggcaggggcactgcctttcaaactgcagccagagagacccctaatggggtccactctccatccccaatcctggtctctcctctctcttatccaacatcactcgctctcggggaaaaaaaaaaagtgttctaagggggacttaaactttacttaaatttgacattccctgctgttcctttctgagtacctttatttttcccagttgaagcaaggaaagagaaaaaggtataatgatggaaatggacagaatttgagtgcaggaagtgccatgaggcttcctattgtttgggcagtgtttgatgttcttaagaatgtatacagaattaactttgatcaacgatagtagcttcaatctggtggctccatcggccaatggaaagtgagtagtattttatacatggcaaggacacagccaagaaaatgaaatgatcagttttgtgtgtatcccactttacttttcgagtgctttccttcacagacaagctctaactgaatcctcacaaagatcctacaaggcaggatttgcccattagacagactggaaaactgatgcctcaaaagaaaaggggcgcattgtgggttagtgaagacacctaaagaacaaaaaagcggagctccatgggactgttgtatttcaccctcctcttggctgccagcatcttagtactaagtctatcgccatgccgtgtcacgtgggcaggtcttcttggcattcatcttgaacatgacccaaatcctggctccatcttccctcttacttttcctttgccccatttttcttccttattttttatgtatgtttaccttgccctgtaggcgcatttgtaagctggctcaaatccttttgggaacaaggtgggttataaatgcacacgttcctacacaggatgttgttagtcatttcataaggtctct

SEQ ID NO: 89646 - DNA, 1022 bp, Homo sapiens
cctccggccaaggaaggaccggacacaggactacctccggatggccattgtgcagagagcaggcacagacagcttgggtagaagggcagcacgaggttctgaagaccagagaagggcagggctgagcaggctctgctttgtgcttccagctgaggttgaggtcagaggaagaggcctcttcctggggctgggggctgtgagtggggaaacagcctcaagagcttcccccccgccagtaaggacaacacaactgagccaccttctagcttaggaggtgcccaataggtgccagaggcttgttccagtgtggacagcagcttccaggcacacttcagcaaaaccatcaccaaatgtgcccaatatggtccatctacggctcgcccctggctgcctgtggcagtgtagtgcccaggcccctggacgctttgggggtcactccttggcccgtctccctgctggaaactcctttttcttgccccctaacatgctgcttcattggtcctgtccgtatcgctgaggaccaggccaggtgcttctacctgctggggaccaggggactctgagcttccacaggactggccctccctgtgatgacatcactcatgttgggactcccaccccaacggcattcctgggagggaggcagggagaaaccgggggtctgagaagctgagaagtccagcttactggggaaaagagttaactctgcagacacaaagggcaacaagatattgtgtgattcttcttctatgaagcatccatgataggcaaattcttcctacccagtgttcttatttctcccaaaataaacaaataaataaataaatagaagaagcaaattcttagagatgaaaagtagattagtggtaccaaggttcagaggaggggaacgttgggaagttattgcttaacagttacagagttgtttgggttgatgaaaaagtcttggaaatagtggtgatggttgtacaacactgtgaatgtactcaatgccacggaatttcgccttaaaatggttaaaa

SEQ ID NO: 89647 - DNA, 1057 bp, Homo sapiens
ttgaatgctctgttcaatgccagtgtacattttccaaattgagcttattttataatcgtggaggcctggcagatatgtttttctcttgcaagcaagctcccttctttcagttctccttcatgtttacactctctctcaggttacaagaaaatcctctaacttgttcatgacctgttccagcccggagacagatgttggtggcacccccatgaggcaatgaaaaaaaatctcatttccgttcaagaagtagaatcattatcttgattgaaataatatctttcctcaacctgcaaccagataaagcatcaaattggtggagtttccttatcactgcacagagtttgcaggacacagaataatggcctgtcagctgcctctggtggggtgggtgctgtaatacagagcccacagctcctggcctggtttggattatacgatgtctggtgtgatgtaaaataattcaattaatgacaaatatcattatattaaaaagagaaggtagcgtaaaccctaaaacagaataagcaataaaggcagctacaactattatagtggttgtttttagtagacacatctaacatgcataggcaattgtgggggtgactgaaggctacagatgtttatgtcctttaaggatgtaagtactctggaacctgcaaccccactaggcctaagattccagggcttcagtgggagtaagggggtgactgggcttgagaaggtggacgaggtcctagttttgggtagaaaacaggacagccagagggcagcaagctgatatatttggaaagggagctgaaagagctgtgggtagggaggcagggggtctgggttccagtcctgattcaccgtcattgtcatgcagctttgggctcttggggcctcagttgcctctttgttcagaaaggataacatgggggtaccaggagaaggaggcgaggcaatgtttgtgcaaagcccaggatagtggctgtacctttgatccctcctgtcccttgtccactgagtggggaggctctgctacagcccaggcaggtctgccaggtggtaaaatgct

SEQ ID NO: 89648 - DNA, 1437 bp, Homo sapiens
ggaggccattccaggaaggaaggaacaggggtggatgcctatgtggaggatggtgtaggcatgggtctgagggtgggaggggagaagatgctggtgaggttggacagggccaggtgctggagggcttggcatggcttcaggaatggtccagatgcaaagaatcaggatggaataaaggattcttcacctatgtaaataaaatttagtttctgcctgtttgtcggccactccacgatatgaaaatggctgcatgaatttttcacaaacttgaggttgtatttgagatcagtctatacactgagtagattataggaaatctgcattggagatactccctttgtctcagagagagagagggaatgagaaagacagagagagagagagagagagagaaaattctccacacagctgcagccaagggccaccagagccctgtgaggccagtaatggggccacatcttgagctcctggcggacagtcaccaatacagcactcccaattgtccacttgcctttcccccagagccacttctcacgcagggagctctaggtactgtgctcaggatgaggggcagctgggatatatttatttaatgatgattaattaatatttgtcccaagcaagcaggagaaggtagctagttataaatctccataacaacagccagtattcacattggatgagcaatttgcagcactcttgaaggtactgcctcataggtgctttacaaaggctctatccagtattcccattttgcagatgaagaaactgaggctcagaatcattcaatatttgctctagtttgctctgctagtaagtggtagagctgcctaagacgtccacactgactttccgctgcacataactggacattgctcagattatgcaacaggtccttttggctcagcccttgcctcctgcttattcatcctggggaagaagagtcatcattgtgctgcgccacggggtccagttgtcagaactctgtctgttctggatgtccatgttttgctgttgctggctttcgtgggctgtattatgtcagactggtggtcttcggcaaggcaggaaggtggttatggtgctgccttcaaggaggaaggctcacgtgtgcttccaactcctgggacaaccctctgaaaagatgctggagggcttcattttgagccactggtgactgacttaggttgggcttcctagaagcagagcctgagtcagttttcagtgggatgtgatgtatccagggagagctcttaggaaacacttgtcaaggagagagggaagcagggtaaagaagcaagagctgagtgggaatgtggtctcagggcaggtctccctgggtctggtccacatcaactgcactgcagtgatgtctgacttggaggcagggggcagggcttgtgtgtccccttatttgtcagcagctgcccccagagt

SEQ ID NO: 89649 - DNA, 1046 bp, Homo sapiens
ctccgtccagtcggaactccctcaaaggtaaccactatcctgacttgtatcattgtacagcagttttgctgttttgagctttatataaatgcaatcatgccatattcactcattttatatttcacttaacaatatatctgtggcctggtgtggtggcccacacctgtaatcccaacgttttgggaggccgaggtgggaggattgcttgagctccggagttcaagaccagcctgggcaacatagggaaatccagtctctatagaatatattttagatggatagatagatagatagatagatagatagatagatagatagatagatgataggcagtggatagatagatgatagatgattgatagataatctgtgagatttattcatgttgtagactattcagaagtttattcttttttgtagctatatagtattcatgcagtaactatgccacactttttttacccattttattgttgatggatattttgattatttctaggttgagactatctttttaaatgctgctgtgaatattctcattgaggtttttgtgttgtacataaatatcttttctgggcacatacctaacagtgaacttgctggattgtatggtatatgcatgtttagctctaagagatattgcttaacactcttttgaagtaattgtattgatttacactcttgactgtcattgaagagagcccagttgttacacatcctcaccagcgcttgacatctcacttcagccattctggttgcttcagtgctacgtccctgtggtctttttatattgtgtttgcatgatcttatatgtttattcaccatttcgatatcctcttttgagaagtgcctattcaaatattttcctattttttaattggtaagtctatttttttcttatttgttgtctttctttgtatgttttggatgtgatttctctgtcacatatcttctctcattctacagcttgcgtttttactcttttaatggtgtttttgaagaagagaagttttaaattttgacaaatttccatttatcaatctttt

SEQ ID NO: 89650 - DNA, 1033 bp, Homo sapiens
taacacctttatagtctgatctcaccttaaatttccacagttagccctcactattcacacatcccatctactgttcttattagacttgtcttttacttcccacctcaatcttttgctttaggagggtctgccagttgaaatcctcctcctcccacagtaacattctgttcatatttcaagatgcaattaaagtgttatttcttctatgaagtcttcctccagctcaaacgaaatcctgaacttctcttccctaaggctagcgtgggttttaggtggtgcctttgttgagttcttgaactataagtttatccgtttccctagggttcatttgcctgttcaacagagacttatcaaacacttctcatgggctaaaaccctgttccaagtttctgagaataggtatccatttatgaacttaaaaggcttctagaagaggtgacattggccttacaccaaagtgtgggttaacttagattgattctctactaggatttagataaacttggacatagggaatcagagttagatgagaagtatgggaaaatgtagatttggttgtagagatatttagtgaactaacgagtagatatgaaaaaattattcagaatacagaatagagaaacaaaaaattaagaaaataccagagatgcgaagagacacagaaggctgaataggaaggtctaacacatgtctaattcttaaaggtaaaagagtagtgagattgagaaagaggtgatctttaaagagaaaatggctgaggatttttcagaattgattaaaaatttaaattctcaaattaggggagtaaagttgatctcataaagataaatgaaaagaaacacacgtttagaaatttgaaagtgaaatcgtatgatattaatgagaggtattaaatcagccagggaggaaagatggatgtcctacaaaggacaacaaaactggaaaaacagctgacttctcagcagcaactttggcagctagaagacatcttcaaagtgctgaggcggggggtaatgtatcaaatgaggatttt

SEQ ID NO: 89651 - DNA, 1014 bp, Homo sapiens
cctatctgccattttttcaggaaagtgcataacacttatatgcacagtttaacaaatattaatagttataatgcaaacacccaagtaacttaaagccacccactttaagaaaaggaacattatcagaatcgctggaaactcccccttcagagataaccattatccttattttatggtaataatccccttgcttttctcttaccagctgtgttttcattatttttaattttggactttcctagttttgaacctaataaaaatagaatcattttatatatattattttaggtcatatgttttacatacacagaacattgtgtttgtaagaatcatttatttggttgtatgcagttgtagttcatttttattactatattccattgtatgaataagtgaaaatatacactaatttaaaaaagtatttccattactgattggatatttggttatttccattttggggcaaatataaacaatgctgctgtaaatcctcttggtatatttgatggtaaccatgtgcacacatgttgatagagtatatagctgggatgcaattatctatcatagggtatgcctacctttctttttactggataacatgaaactgctttttttttttgcaaagtggtcatatcaaactatgctcccacaaggaagcaaagaatataccaattatattacccattgtctcatcttcttgtcaacacttagtattgtcagagctttcaatttttgccattctgatgtgtatatgtatggttttaattttcatttccctgatagccaaggttgagcatcttttcttatatttattggccttttggatttttgtaccctcccaactgttccttccctttggatgcttctatggttgggagtctcagctccccacatttgtactgtttcctaggttctcagctgttttctttgctcccagcctccattcttctcctcacaatggttcttccttgatggggcccttacttgtaatttgcttatttgctctttgcatca

SEQ ID NO: 89652 - DNA, 1029 bp, Homo sapiens
ctttttctccacttcaatagcagttagcaaaaactgtttttctaatttgacagataaaacagtatttcaacttgctttaatttacattcctttgtttactagtgaagattactatttctccatgtatttgtttatattgtatataattttctgtgaattatctgtttgttatggtcttggtgtttttataaatttaaatgcactctttgtaggtgataactattaatcatttttgttttgtttattcaaatactttgttgtcctttttaatttttatttttattacagaaaagctttatattatgtatggaaattgtcaatctcaatctgtgagtacttcttatttttctgaagaagagatagtaattcttttacctatctcttgtgtgttttatatgcctttcatttaatcatttattcaacatcgagttaccaggtgccttttgtgggccggatattcttctaggttctgagaatctaaaattttcatcttcttggagattacattttagcgagaagagagacaataagcaaaaacataactaataagcatggcagcaataaatcttataaagaaaaaaataaagcatagtcagaggacaaacaatgaccagggaaagatttagtgttcaggacaggccactgacaaagtgacatttgcaatagggaagacagggagggccagtatcaaaaggtatcattcaagcagacctggatgagatgacagagggaacagaaagtgcaaaggccctgagatgggaacatatgtggcatcctgagtgtattagtttgttctctcactgctataaagaactgtctgagactgggtaatttgtagagaagagaggtttaattgactcacagtttgcatggctggggaggcctcaggaaaattacaatcatggtggaaggcacctgtattagtctgtcctcacgctgcaaataaagacatacctgagactgggtaatttataaaggaaagaggtttagtggacacagttccacatggctggggaggtctcagaatca

SEQ ID NO: 89653 - DNA, 1028 bp, Homo sapiens
ttcgagaccagtctggccaacatggcgaaaccccgtctctattaaaaatacaaaaattagctgggcatggtggcaggcacctgtagttccagctacttgggaggctgagccaggagaatgacttgaacccaagaggcagaggttgcagtgagcgaagatcacaccactgcactctagcctggatgacagaacaagactctgtctcaaaaaaaaaaaaaaaaaaaaaaagagagagaaaaaaattacctaggaaagctggtgcttaaatcaaggaataatagctagtcgaggattttggaccagttggctactgagtgttagttgggacctgggtcctttccctagatttctcaagtcatgccttgctggggactctggctccgtaggtgtgtaaccatgagaatatatagacccttgtgtctaggatttatgtctagagatggagacattctcaaatatggtcagagttgggggtgtggctagtcacagggttgtgcagatgactgtgagcagggatttaggggttcctctgtgggcaccttttgttctgggtgtgttgatacgggttggggcagattgtgtagggcttgagaagccaggccaggatgttggggagtttattctgttagtggtggattgccattgaaggcttttgagcaggttagtgccttcagggaagcaatgtttttagaaacaccaatgggaatggagcccaaatccaatgaatgatggatgcagtggccctgacataagaacttgggagtccagggaggggtcgaggagtgccctcagttatgggtgaagtctcgggagtcggtgaaaccctcaggctgcagtgtgctcccactttctccagcctccatggtacctttcctgcccactcctccttctctgacaagctggctccactcagcaccctccaatacatgctccttggctgtgctcctgcctacagcactgaccacaccgtattctaattgtagggtgagttccttggggcaagaaccaaatgtgtcttatttaccatt

SEQ ID NO: 89654 - DNA, 1139 bp, Homo sapiens
actgttgaaatcctcaggccttggatatcaaatcaaaagtcactttcccaacctggggccttgtgctggcaatcctttacctccctgggtagctggagcactttcttcaatgtgaaatcaaagctttgatgaagctggcctgtatgtggtaataaaatgatgcccatgtgcacattcctattactcagtaagtacattcatttggctgcagatttgtgaaagcctttcattgctagtgcatgaaaaaggggtatttcacacatgtttcatattagccctgtgatttagcttctgagtgaataagaatcaatgcaatggccaactgccaccagagatcccatttatattgtattacaggctgctacggccccacctttgactgtgatcttgtcagatctgataaggtaatagtaataataacttagatttccattatgtgggctcttcccctccaaggcattcctgctgcatgtgtgccttctttgttttctatctgtgcttgtccagggtgtatctgagtcagccagggtcctcaaagtgagtttcatcttagaaagaggtctcaggatcacttatcaattaatcagttagtagaccaatcagtcattcaatcccatgttaccatgcacagcacctttcaaactcagtgtggccaaagggagctcccgacatagtccccacagccctgggaactgactctgtcctgtaaacagctccattgtcctcctgtctgctaaccctgcttctacgcaccctctcgcatcacatccacggtggctctgcccgctctgtgtgttaatgcctctggactctgccacttctctctgctcctgagtcgtcatgtggtccagctcaccacccccttccctggaccagcccagacaggtcccccggcgtttcctgccaccatccccagcccaacccagtcttcacgcagcacacaggaattgctctgctaagcatgcttatctgagcatgtcattctcttatttaaaccctctcatagcctcttcttgcttttaggataaaggtaagatattcttctcagggcctacaaggttctgctcacctcatcagcctcctctagcatcctcttcccttttggtttctctgcccttatgaactcatcacctcccata

SEQ ID NO: 89655 - DNA, 1817 bp, Homo sapiens
ggccactgccctatgcccagccccatctgaagaatgagttaaatagcgcctgccttctgggttttttcagagcctcaaatgagatagtgtatgtgaaggtcctttatagagttatcaaatgttattgagactcttagttccctacctgggggtgttttcgggtctgggagctgggtttgaggctgcagatttgatttaaaagatgccccttctcttggcatctcatggcagatggtgctgccataggactcaactaggtgttcccatgaggtgctccccctaggtgctctatcccccggggtgagtgcctctgaattaaccccttgcctcctgttctcctttgggagaggggaaggatctgggtgttggtggcagcagtaggtttccctgacatctttactttccctcagcctgttgtgtgtggggggtctctagccaatcctcctgagtttggaatccacctagattattgtgaaagctcataatccatccttcctgggacttgggagcatgccatggatctaagtaagtcctgtaggtcctccttgcctccctggcttgggtctggtgaggattctgtgatagggaatgggggctccaggcaaatcccatgtcctctgggcctggcgtggaggaagtaggatcaggaggtgcaggtgggtgacatgaaaagtaactgggcttaagctgcactggaatcagggcaaagtctgcaggataaatggaaattctctggtcctgggcattgagacagtgttttcaaggttgggtccacatttgactgtgtgtggttgggttaatgggcctttgatgctcgctgcagtggtatttgggtcactcgtgttgctgcctgcctctctagactggagagcccccgccccctttagcagctggctgctgcttcctgctggctctcctgggccccaagctctcaaggctgtcacgaatcctaaaagagtccttcaaaccagtgtcactgtgacttaacatctatttcaaaagatgatctatggcacatttggaggacaatgcagaggggggtgtcacaaactcaagcacatttggataaggttattgacctggctttttcttagtttgctatgtgacccagtgcagttcttttaagttccccagaccttaatgttctcctctattaaatgggcatgagagtctgtactgcaatgatttaatcctgtttccaggtgtacatgcgctctaaaagtaaaaggtgctgtggatcttacttgctaaagatttgagagaattatggcaacactctttcctcaccgagtctggcagtgtataaattctgtttctttaaaattagtatctttattgcttcctgggagcccagggggaacagcttctgctatatcaccttaagttttgcagcagggagaggaagaaagctacattgcccttgactgacaaccttcatatgagtatttaacaattttaatttttcatgattcttctgataaaaatagtacccgactaaaaacaaatacatttgtattttccatctccttaattagtttctaatttgggggttcttattagcttaaaatcatcttgctgaaatggtccttggatgaaaaaaaaagtgaaaaccacaatcaattctagagagatcttactatttaattatgctgattggagcactagagacccctggtaaaacaaacctctcagaataagcttgatttgtgtaatttggtttttaaaaatttgggatgcatatttatcatgttcgactatgtgttgttgctctccttgagattctgacttgtcttgtaagagatgaggggaggaagcca

SEQ ID NO: 89656 - DNA, 1114 bp, Homo sapiens
cactgtcatggtggcattgtacctgtcatgttgccattactataaaaactttgttatattttatattagagtgttgttatgtattataagattgctgtgttacatattataatagtgttccctgtcattttctttgaaagtcatgttttgatcatcttcatagtttcctctttctagacctgctctgaaagctttccttcaccctagggtgaaaaatgacacagagaaaaaatttctccttctcatgggggatggaggaaggccaggccccagttctgggtggctgtgcgtgtgagttcatgggggtgatggccaccagctagttctcttgtcatctggcccttggcaggattatccttcctgtgccctttgttgggggctggggtcacaggatgtactccgggcagtaagttgtgagtgaagtatgggtttcacttccaggtcagagcatcttgttgccagtacaaggccctccagagctcacaggacagcaggaagcattggagacaggggctactgcatcagcctaaaccttgagtgattccaacaggaaggcccctgtggacctgtgatcaacaccagccaggcataagggaggaggaaaccgggactagtttttaatagctttattgagataaaattcatgcctctcatttattgagataaagttcatccctctaagtgtacagtgcaatgttttttagtatattcacaggcttgtcaccactctctaattttaaaacatttgcatcactccagaaagaagccctatatttattagcataaaccctcagtgttctcagctactgcaatttgggagttgtttgttgttactgcagcatggcccagcctatcctgactggcacagaaatcaattccatgcctgcaagagttgtgctgctgtgttaggccgtttttgcgttgctataaagaaatacctgaggctgggtaattaataaagaaaagagggtttgattgactcacagttctgccaactgtacaagcctggctccagcatctgcttctggtgaggcctcaggaagcttccaatcatggtggaaagcaaagggagagcaggcagtgtcacagggtgagagtgggagcaagagagaca

SEQ ID NO: 89657 - DNA, 1118 bp, Homo sapiens
aataggcctgtttattatctctcttttggatgcttcaggggccctttttattttaatttttttatttcataggtttttggggaacaggtggtatttggttacatgagtaagttctttagtggtgcttactgagattttggtgcacccatcacctgagcagcgtacactgtacccaatgtgcagtcttttattggatataatcttgattctccttttgtttattgtctgtctttccccactagagtgtaagctccctgagaacaggcaccttgtctgttttgcaatctattgtctcctcctgggctatacctgggcatattcatttaccgactatgtactcagacactgctgtgtgctaggcactgttctgctgtgaataagccagttagtgctgttggggtatgtgaagttgagtcagcccaaggccctgccttcttgatctcttcagcctagaggcagaaatgaagcttgttcatacatactctcatgtaggcagggagggaaggtgacattcaagaggtatagcccaggagggccattgttgagagatgttagccctgatttgacaagggtggttggcttaggtagatggagtcttctttcagatgttctgttgggagtctgggagctctggcagctgactcacctccaggactggagttcctctagcttgactggctaccacctctgtctctgtttatttacttctttggtgggcaagagctccaagcatactgccatccttggagagtcaggaatgttgtgtttttccacccgcttcattcattggcagcctcctcagaacagctgtggacagctgtctgccagcatggatgcagggagggtttctctttggggccaggggcacactcagccctgcaggagcagggaattcattggtggttcacaccctactgatttccaaaccccactgaactggtgcctgtaaaaacagattcataaggaaattaaaaaactattagcattcagtttactgcttattttctgattattaaagcaataagactcataatagaaaattgggaaaatatggaaaagaataaaatcaaaaacatcctacaacacccacattttggtatatttccttccagtctttt

SEQ ID NO: 89658 - DNA, 1128 bp, Homo sapiens
ataaatttatttttctttccaagtggctttgtggtgaatgggcttaaataattccctgactatcctgtttaaatttgctccctctcccccagttctttgcctcctctgttttatttttctccatagcctgcattatcctgtgcataaaaacgagtgcataatattgcattaaaaaaggaaacaaaattaatgtcttaaaacgaccatccttttattatttgctcagagttctgcactttgggcaggagttttagggggtagagagtgggctgggaaaaggtcagggcatctctgttccttgtggttcagcccagggccgcttgggaccctccattcttctctgcgtggtgtctgtgtgtggttagcttgggcctcctttcagcatggtgttgttggctttattgaaaggtgactggcttccctcagaacagaaaagcaaaagctgctagacccggagtcacttgcgctacgtttctgagcatccagccacacactgggaagtgtggcgactatctcgtcccctaggagtgtggtgtgaaatgctgggacactcgatcaatgttagctctttcattagacacagccctggactgtcagagacccagctcttgaggtaggtgacttcctgtgtgacctggcccaagactcactccctctctgaatctttaaaatggggagaatagaaatatgggctagccacatgtctacctcaaggggctgcttggagggccaaatgagataaagagtaatagtgatgacaggtgttgggaactgggtatgaccaggttttcagaattttgctccttggagctcccagttccagacacagggagccccgcctctgccaggactcctgggggcagggtccagggtgcaggggaaaggtcccagcttccccttttgaggtggccaagcaggccgccgtcaggtcagcacgtaggccttgagtccagccacttttgttgagtgtttaaaatttaccagggactttacatcttttacatcttttctcatgtaccctcaaaacagttctgtaatgcaggtgatgctttgccccccgacagctgttctatggcaacacggccgagtaacagaaccagaactccatcttcaacccactgggatcca

SEQ ID NO: 89659 - DNA, 1049 bp, Homo sapiens
agaatggctgactgagcagggggccgtgacggggaagtttccactgagcggtgaaggcagaagcctgcctgtggccagctcaaggaacagaaggagatggcctggagactaggagaatagtacaactgttttgaggagtttagctgtaaaggggagagacatgtggtggtatttgggggaaataaggtcaaaataggagcattgacctgtgtgttcaatccaggggcaagtcaggggttgctggagccctggcctatccccagcccccagcggttcatccacaatgacaggagggagtggcaggtgtggggccgcgcatctaaaatggctcctgcagcacagctgtggtttctctccagcggcttgcggccacgaaggtgcagaggcagagttacaaagatgactttaaccagggtggaggtttctccagggaatacagtggaggagagaggggtgagggaggcacaggagtgatgatggtgagtcacctggatgctgagccaggccaggacgggagtgggtacctgaggtggttgtggaggctgacaggtggtagggtcagtggattggaggccacccaaagaattgtaatcctggtagcaaagagactgagctagaaagatggtgggggtgtggcgtgtgtccaggagtggggtgtttgaaatcagaggtggaggaatgcagtcatgggtcaggagagggctgggtgtgagcatgggagtgtgtgggggagagggagaggccaggaggagagcgggtcgtgaaactcagatccatcttcatggatcttgaaatcaccaagaaaggacaaaaggatgtgggaaagggtggctgtgatacaggagaaaagtccttgaggaatgtgggagcaaggtggtggctgggtggcctggcggtctacagctgaccgcatggagggtcttgtctggtggtgcattaacttatttgcataatcctttttttaatatacaaactatgcttattgcacagctaatagtaccatgatctgaagtggaaggaggaggaggattaggatagattggaaaatt

SEQ ID NO: 89660 - DNA, 1922 bp, Homo sapiens
ctgcaggggaacacccactggggtggggctgggggagttacaaagtgttggcttccgcccttggaaggatgggggctggctaagtggggagatggagccgcataatctgtaatccatagtctaagccgagttaatttactaagttctgaattaacttgactaagttccaagttaacttgaccaagttccatgtgaaggcaagggatgaaatccgaattgcatatccttcacctcatctctggtctgagaccaccccccggcaccccctcccccaggacccctttactctgaggtgtgacttggggagcaatttctccatgtgtgtgaagtcggcgcgaccagtgtgagaaagacggtctaacgggcatgttgtccctgtgccctagatggcccctaggtgagcattagatttcctcaggttcccgggcacagggccctcggcgccctgcggaaatgccacctccttatatcacacagtggcctggtgcttttgtgtcatatacaataccccattgaaagacgttgtttgttgaattatccagtgtcctgcccagggctttctatcaggacgtattttggtcattatccttgaattctcccagacaaacattatgtctgctgtctttggtctgacagtaggaactacataacccactgacttctcgttttgcctttctcttaggaaattttgaaaccaaattctgtgtctgttggccgttaatcattagatggctcagacctagcagggccggctcccctgcccccacattgctggccttgtccagagcgtgtgactcaggagccctttgctgtgaaaggggcttagtgcccacacaacagtggacgccacccggtcaagtgggatttctggccttagggatgtgcccaaagcattccccattgagggtccccagaaggctcaggggacggaaagtggctttctggcctcctgagcctgtgtccaagtccagccttcacacgggagatggctaaaggaagggacagttccttcctcgttcttctgcttggccctggatgataacagagagatcctccccactacctctctaaagaatccgagggacaaatgagctttcaaaatgaaaatcatggctccatgaaatgacactcaggtgtccctcactcctggaggagtgaaaatggtggccgataaggaatggcctggcagccccagcaggtggcgctgctgctatttagtaatgggggtcctgggcgggaggccggggccgcggctggggctgccccacactggggttgaagcctctgtagccgggttcccagacctccagatgagaaggagtaactttattgttccctagggctgtgttagctgttgccaagtcttctggaaacttctaggacatgctaactcacaggcgtgaggattagtaaagtgccccgagacacccaggagcagagtcctgaaaaccatgccccacctcgcctccccaggccctgtgcaccggcgactgttgctccatgtcacccgtggtcccacggaggtgaggtctgaccttattcacccaggccaacattacggatcaggcatctctctgtgtcccaggcattgtcttatagccattatggactgagtttaagtgcaggggctggtacctgtcccatagacggggacatggtattctcctaatgtccccttagtgagaattcaacaaggagcgtaatgcaccaacagtaacactagcgaacattcacagagtgctttccgtgttccaggaactgagaaggtccttgctttttctaatcttaccctcacgttgtcccatggagcacgtactgttattgacctcactttacagaccgatgtctttggtcggatgtaaccttctcagtaagggcttgtgaacactccatatgcctcctcatcactcaagaatcgtcac

SEQ ID NO: 89661 - DNA, 1018 bp, Homo sapiens
tttgcaaatggtttggtgattcaaggacaacatggtcccccagactccagcaactgctcctgtcactggtcatgcctcagaggacccctgggtcccgacagccctgggcgggccattggggattagggtttctggaaggctcattccctttgcaccaaagatagaaacctcagcagagtcctcagtgacgctgcgtatttccaggtggtcaaagccaacacctggggtggagatgtgggggcaacccacctggatggggcgaagccctgggctcagtgttccagatctttccttccagcgcactgctttgtgtgtgtggcagatgaaccatccacagcgtgctgggcagaggccgacagggagaggagtttgttccctgcgtgcagaacctctgcagcggcgggcgctgacaccgaagcacactgggtggcagggggaagcctccctgggaataaagcaacaaacacaaacttctgtctgcaaagagaataatccaaagttgatgttacatcgaccataagtaagaacaacaagggagtagcaggcctagctaaacacgccctggaaaggctacatactgtggttgtgtccagaaaacaattttggactccaggaaccccacagaaaatgacggcctgtcccttggacccctgcttgcagtgagaccactgtccctccgagcatcagtggtctcacttcgagcagggggcacaagggacaggccatcatttcctgcccccgagcctcaccctcctcctgtgaaataggagtgctggccttgccctccttctggatccaagccttcaccccccttgcccacttttggggtgctcctgaaggaaagagctctgattattaaagcattagatgtagtcttgtgttctccaaagaccctctttgttccttttggcaccccacccccaaagggttcaggaggaagctctgcctctagcggtctaggccctgctctctctccagagtgaaaacctcaaggagtgttttcattactcctggggac

SEQ ID NO: 89662 - DNA, 1030 bp, Homo sapiens
ggggtttacaagtttttgtattcatgagagagcaggagttgaattaaatgcatgtggtcaatcctgtcgagtcagaagtctaatttgtttggatttaaatagttagggaaacaggaagaaggtcggaagactgagctctgtgtgcttgtcaagaggagcaacgggagcagatggtgtcgtgtgggagtcggggataaagcgatctgtcttcagagttcaggcaggagaactggcttgtggctgagccctggacaggttgtatagagaggataaagggggtgcaggatgtacctgaatgccagtacatagatttttttctttgctgttgttcaaagaactctaggaggggacacacacacacacacacacacacacacacacacacacacacacaccaagcttaccaaccaggagatgggcagagtgagcagagtataagccccagtcgtctgaggggcctgggaaaatctctgcttggattcagaccttacaaagattcagaccctacacaagagccaccagggcaaaagtgctctgggactcaaggataaggctctattgtcctcccctgcttaggattccagccacaccctgcctagctttgtatttgccccttcctggtgggaaagactcttcctcagcaagcctccagagccctgggagcagggctcttgtccgacaccacctctgagacagcactggtacgctgttggagctccatcaatcacagaaccagagaatcgttgctgaaattgccagagcaaatgtgaagccgactgtgtgcaaaggtgagcctgaaagcagcctcttcaaattgcccttaagaacttgtaaggcaccaggtagttgctggcacctctgtctctgcagccgcctgagtcccgctgtcctttgccgttactaagaaatgtggcccccacccccagtggtagcccagtcccagaaggtctcatataaagtacaagctgtccttgccttttgccaattcacatttcaacaatccacgcattctgcagttcctgaaaaccgc

SEQ ID NO: 89663 - DNA, 1047 bp, Homo sapiens
ccaggttggtctcaaactcctgacctcagattttatccttttcaaaaacctgagcttgttaattgtctcactaaatgagacttaagtttttatctttgtaaaacaaaacaaaaaacccttgctcaactcaactgggaatccacttgacttctggaggtctggaaacaaagggattgtgcccaagggccactctgggtgttcatgggccacaaaaaaacaaaaacaaaaacaaaacaaaaaacaaaaaacaaaaaaaaaaaaccacccttactcctatttctggctcaccatacacgaagatcagtttccttcttgcctggatcttgtcctctccacctctctgcctctaattctcccatccatcaaaatctctctcacttccccctctttgtaagaagtgtttcctaaccattctgctgggacattctagaatctttgctttctcagaacatggtaccctgcctcattacttctcaaactttagcgtgcatatgaatagcatgcagatctggtgaacatgcagcttctgattcaggaggactagggtaggcctgaacttctgcatctccagccagctcccaggtgagaccaacgcggctggtcctcagaccacactttgagtagcggaaccctacaacaatggttcccacattttgctgcacaatgggctcctgtggaggggtgggttgaaagagactggtgctagtcttccatccctagacactctgatgtttttagcatggagcttgacccaggcattgggattttaaaatctcctcaggtcattatactgtgcagtgtgggaaccactgccttattgcataaagtgaatatggctaagcctattattatttcatctgtgcttaccttgtctcgaccttgatagactacagccctctctaaggcaggacttggtcaacattttgttttgagcattgatagatgaaccaactgattagatattaggcccttacgtgcttttctgatgatgaatcggtgttaatgagcatatatgtgttgccacagagaaatgtactagatatcaag

SEQ ID NO: 89664 - DNA, 1066 bp, Homo sapiens
aggtactcaacaaatgctgattgatggagtgaacaaatgaatgaatgaataatgaatgtggctttaaacaagctacagaaagggttagccccaattgtggtgggcactcgctctgtaaacaattccagcactgaatgcatacatttacaaggttgctgtaactgggttgtgccagagcacctcacttcttccctctcccttcttccaaattctgtgctgtgcttccaaaatagctgtgctgcttcatgtgaatctgatcagtaccagaagaagataatagatctccctgacaagtgtgtggtcaaaaatttaaaaagcatgaggaacttgcagaaatgacaaaggataaggtcttacagaggtttccaattaggaagaaagattagatggacaaagatgagttcctaaaaagctgcttgcatgcagaaaaatctctgtgtggaactgtattttaagcatactaggaaattgtaagtcctgttccaaatatctttagtaaattagacaatcgactccaacttgttaattttacaagagaatccagatgctttaaggagactggttgtaccattctctctgactatagtgaaatttatcatttcagaaattcaattacttgttccattcccagaaagcagtgctaagcttttgttgtgtggatgcacggcattaaagagtctgcaccacataaaaaggtctttatgggttgtcttaaattgggcagccattggttctggccagcaggctcactaagcaatagtggccctgctgacgtagttggtatctcattcccaccatggctctgtagcagacagtgatctgacctactttcaggggcacagcggtggctcaagaaggaatggcggagaatttgagaacctggactcaggatattgaagctcagtctttaggcgcttcctggccatcctccactgccagggttcctgtggctctgactgagggcagctctcatcccctccctgctctctgtctccagagcctctgcctcctgcagccctcctcacctgaatccattgtccttgggcaggaatagcgtccattccta

SEQ ID NO: 89665 - DNA, 1035 bp, Homo sapiens
aatatcctgagtccaggttctcaaattctccgccattccttcttgagccaccgctgtgcccctgaaagtaggtcagatcactgtctgctacagagccatggtgggaatgagataccaactacgtcagcagggccactattgcttagtgagcctgctggccagaaccaatggctgcccaatttaagacaacccataaagacctttttatgtggtgcagactctttaatgccgtgcatccacacaacaaaagcttagcactgctttctgggaatggaacaagtaattgaatttctgaaatgataaatttcactatagtcagagagaatggtacaaccagtctccttaaagcatctggattctcttgtaaaattaacaagttggagtcgattgtctaatttactaaagatatttggaacaggacttacaatttcctagtatgcttaaaatacagttccacacagagatttttctgcatgcaagcagctttttaggaactcatctttgtccatctaatctttcttcctaattggaaacctctgtaagaccttatcctttgtcatttctgcaagttcctcatgctttttaaatttttgaccacacacttgtcagggagatctattatcttcttctggtactgatcagattcacatgaagcagcacagctattttggaagcacagcacagaatttggaagaagggagagggaagaagtgaggtgctctggcacaacccagttacagcaaccttgtaaatgtatgcattcagtgctggaattgtttacagagcgagtgcccaccacaattggggctaaccctttctgtagcttgtttaaagccacattcattattcattcattcatttgttcactccatcaatcagcatttgttgagtacctgctatgtgacattgctgtgcagagtcattataatgggatctgggggtctattgccagagaaagggaacccacgcacacacttctggatgggcactcgctgccgtcagtgctgggtctcatgactgatgctcttatgagca

SEQ ID NO: 89666 - DNA, 1076 bp, Homo sapiens
agcaggacagtgatgaacctgttcattcatgtgaggccttggaggcttccccccggcacagcggggtacacctcagaatcttagcatggctgcgcaggtggtttaggcaggggctccctccctgctacccacagatgcccctgccctgtgcgaacgtgactactgctagtttgtataatgagctgcagcagagtgtgctcagaagaagcagagcagagcccctcaagcgtgggccgtgcctctctcactctaacctcagagcctctgttcacttcgaagggtgacctcaggcatcccttcctccacagctccttggaccttggatgttcttccattgtgactccactcaatttgcgtgtccctcttccccagggcccatgcccctcttggagacagaggtggagtcttgttttcctgtgtctgtgcacacagcatgctcacagggcaccgtgggcatcctctgagggtttgttgagcatcactcctcttctagagttggttgatgcttcagttctatgatggtctttgaacctcctcaagtacataaaactcttcacaatgttgcccacttctcaacagttgtcatttcccccttagaggccagaacgcaaacattgctttgccttctcttgagcttgctctctagagttcttgaggctctgggtcttatctgtgccatagacacaccacttcatgaggggccaggacacaggccatatgtgtctcatcatgcccaggtggttttttcaggggctgcagaatggaaactctcattcctcatggccctttgtacctctcacatttcttgggcgtctttctgcccctggtctgcagcagcttgaaggcattgccattttcagttcagaagtgtgtccaggacccttaatagatatccattatccagggaatggagcatgtcagtccactccagttccattctcttgtgcgtgtcccgtgtcaatgagcagcatgaacaccatgagcctaagtggcctgtgttcaagtctttcctgggttcatgacctggagaaggcccgtagccttttggtcccatttggtcttcgacacagagagtc

SEQ ID NO: 89667 - DNA, 1090 bp, Homo sapiens
gcaaacttggagtgggagaggtctgctttctttttgccacctcttaattctacgctgtctgccccatcagtagcctcatgtgtccctctgacttctcactctcaatacgaaaatatgcttctagaattgtctttaatatttttaagccccattccttgacactgctgtggcttctgtatcccaggctttgatggtcatctgtgactacaggaggccccacattccttttcacatgtgggctcatgggcaaggactctgggggataccaagtgcctctcgacatccctctctttaagtcacagctgctatctggaacttgctgctccttttagcacctcagaacactctaccagtcatagagtcccacatcctacaaaaatgaccaggtcccccagatcttgcccaccgggaactgatgaggaattaacctagtcggagtcctatatctatacatcagctcattcacatgagttgttaagatagctcttttggaagtgcagtccatccttattactcattgattcatatttgcacattcgcctacttgtaaaacttatttgtaacaccgcactcaatactcatggtgtttttgcagtcagtcattgacacacaaacagtgaaaaatttgagttgcctgacctgcaagatcccagtccaggccaaagtaacactctgcctccttgtttcagctctcatagtataagcaagcacccttctcatggttctgtttactgccatgtttttcacatttttgtgcttttccttggtgaatttgctattttaaatggctcctaaacatagtactgaagtgccgtctactgttcttaagcgcaaggaggctgtgatgtgccttccggagaaaatgtgtgtgttagataagcatcactcaggcatgagttatagtgctgttggccgtgagttcaatgttaataaatcaacaatatgtattaaataaggtttctttaaacagaaacacatacaaaacgaggttatgtattgatccagtggtgaaaatgttgtgaccagaggcttgcaggaaccaaaccccgcatttcccctaggagtaatagttcagtattcactaattcag

SEQ ID NO: 89668 - DNA, 1042 bp, Homo sapiens
ttcaatgccttgtgacttcccactgtggtccctggactagagcactagcatctaccaggagcatgtttgaaacgcagaatctcaagcccatcccaggcctcttgcatcagaatctgcatttaaacaaaatcccacgtgattcatatgcacattccggtttgagaacccctgacctaataaagacaacatgcttggcacattaagaaatgtctgttttgttgtggggtggggggaggggggagggatagcattaggagatatacctaatgttaaatgacgagttaatgggtgcagcacaccaacatggcacatgtatacatatgtaactaacctgcatgttgtgcacatgtaccctaaaacttaaagtatataaaaaaaagaaaaaatgattaaaaaataaaataaaataaaaagtaaaaaaaaaaagaaatgtctgtttaataaatagaattttacttacaaggacactactaataaaagggccacatttcaggtaaaaaggaattggcttggatgtaaaaactgaagaccattttggagctgtgggattggtgacggggtcctctgagaccccaaggtctccagcactgtcatggctcatgagaatggtgcttctgggttccttgagatagcagtgttgagtctggctgggaagggttaaaggaccttaaaccttctcccttctcccaccctgcacttcccactccatgggggctgcaccccagcttggcaagagccctcagacctctgctgcagaatgtttaccacatctgcggttgcccctctccctccatgctgccggctcccatcactgaagccctggcagcaagagaagtcagccagggagaaccaagtgtaaagaccactgctgggagctgtgctaaggaggcacttcacaccctggcccctttgtagcctgcattgctaagccggggcccagaacttgtgtgtggaagtggtagctgaacctgatcctatgggggcatctcggaggctgccaaacccaaccaggtgctggttggggaccgagagccagatgggc

SEQ ID NO: 89669 - DNA, 1042 bp, Homo sapiens
tccagtttcacagagaagtgaagaacgagtgtgcctctttttatgggacctttggaatgacaggaatggaagcctgagccctctccacccagcactgccctgtcactgccccgggacgtccacgtgggctctgggaatgctcctttgctgagacaggcttgggtagtacaagttcaagccctcctctgttgaaatgtgtgtgctctgtttagccaagaggtgtctgcatccgagctatgcagagcaaagtattattagagccggcatcagtgtgtctgtaactgaacccagctctccctagcaaccgttgccaacaacacatctaacagaaggatgcgatacctttttttgaaaaaaaaaagtttgtctcaaccaagtcataaacacagcaggcctgttgtgaaaagacaacacaaaatcagaatctggtgtgtgaccagatttcaaaataaattgctcttctctagcaccttctagaagacagcctgttaaaaagctgaccttgagctaaagagcggagaaactcttcagagtttctggctgggtcatcatcaagcattgtgttttgggcttttcatacatagacgctcagttgagtggtgactctgtgggatctctgggaatgactttagcacagaaggggcactcaagattttctggcttggctttccttatcagtgaatctctcaagtgtgagacaagcctgaagatgtatcttacccatacctcatcctggatgtgtgtgttgcccccacttctacccgtttctcccatcctcctgcccttctccttgtcccatgttttcaggcttgggaagaaaactgggccattcctctaactctcttcctaaggggaaaacctcgttctcttgtgattctctcaaggtctctggaaaatcaagtcattcccctttgtcagaagtttgaagttcctaactcttatcttttacataggaagggaggagggagactgatatcgattcctggagtctaagttttaaactcctagatggccagaatcctggctgagttatcggctgtcc

SEQ ID NO: 89670 - DNA, 1747 bp, Homo sapiens
gatccattcaggccaggagtcaaggctgcagagagctaggtccctgctgttgcgctccagtgtgagcgacagagtgagactctaaaaaacaaaaaagaatccatctcaggaagtcatcaattgggatttcaaaatccaccctgtggaataatcccactgtgtttccaggggtcgctgagtctctgagctttctgggcctctggaggtcaagggtacctgaagaaacccctgcactctccattcgccctagtccctgtgaaaccacacaggctgctggccccagttcccatctcctccttgcatcctctccctcttctcagaccccctccctcatttctgcacacccaccgctgagccgatgtgcactccaggcatgtaaactaattttaatgttggcccaagccaggcacacccagggatagaagcacattgttctgtgcattccaaagcttgagcaaaagccctggccatacccacatcgagctcccctccactagttgctagaaatcagaaaggctgaagcaaagggccagaggcagtgcaagccgctttccccgtgggcaggctgcacggaagcttgcaaaagcccagaaaagggctgtttttctaaaaatggctggcatctgagctcccgccctgccccctgtgggccatctgtccccatgctgaagcccgtgccctgcaagggacatgcagagttggcacacacatttccctgaaggtgggcaccaacaggcctcgtcaggctggcctggcatcacaggaggccagcagtcacaggagcttgacccctgcccaggattctgtggcagccctgggctcccccaacaggaagagccaatgcctgactcctatccatgttctttgcccctgcggccagagccacagtggataggagccgtgtgcctcgttgccaatcttgttgtctgcacttgctttgggatgagtaaatatgacctgcttttctccaatctttatttcttctcaacgcttattgagcacctgctatataccatgcactgtggcaggtcctgtatgtctctgttcatttgccctccactgtggtctttcaatctgtttgtgcaaatcttaagcattgcattcaaggacccaggtgggatacctcaatgtcagtgcttagaccagatcgccctgactgttcagtttgggtggggcgggggaacatgtggcttccaggagtgctaagcctgtggttctctctggagctttgaagtgctcagtgagacagagcagccgatgaccggatcataaacaagcattttgatttttgaatctgaaaataagcgaggaaagaaaatgaccactgatcctcagccagtcctggaaagtgcccagaacagcagcatgccaggtgtccagtcatcatatcatcaggggggcctgggtgctgctgctgtgccaactactgccccaggcccccagggaccagtgagcttcctgcaaaaccaagtgcccagcttcctgcctctttgccactgcgccactgtgccactgcgccactgcgccactactgtgttcttcaaaatcacagagagccccgctcctgagaaagcccaaagtgcctttctgtgcacggcatgggcttttacaagtctcatgggcagtctactgcaggccttgtcagagactctagatgtgcagaggctgagggagccttggacaaaagtcactcctttcccgtgaaaagtggccattgccctgtgttgttaggagcgtgggtggctca

SEQ ID NO: 89671 - DNA, 1005 bp, Homo sapiens
agacccattaagcagagagggcttgggagccagcacgtcaccatgtcatgcccctgcctcccagttttccgtagagcaaaggccatacgaaagaagggggtagcttaggaggtatttggggaaagccagactccagctaaagctggtgaatagctataatcggaataagtgcattcttgagcagctgcgtattggagcgccacatattggacccatacttagcatggaccccattaggcaaccgtcattgcattattctgagtattaaaaaaaaaaatgtggcaaggggagtaatatctctaaagtggggttcgaagcacagtcacctggaatcagccttccctgccatagacccttcctttaatgccttaccacctgtggcataagaaataactcaagcggccaagagccagccacctccccctggctctagttgtggcgccatgcaactggttgactctgggtggatctcaagcgtggcagccctacacttactcttctgttaaatggggtcataatacccatctcctcctcctgcctactgcactgacattatcattgttaaaatccactgaaatgcctgacttttacctgtgttcccttaagactcctcctccaggagaaacttgtgaatttcatagcagcatgtttttccttttccttttgatgattccattcattcaaggttcttaggggaggtcccaggcagggaaagcgccatgagatgcccacgcagagattcttccacaagtccaggggcccccggcacagtaggacttgaggtttgggtgcagcactgtagacagcccaggatccagccacaaggaaagctctccaaggggccctgggactggcctggaggccccacagggttccctgagctcagtactgtgaaaccccagtgaaacaggcactggcctctgcctgacacataaaggggggcagggccagctcagccagagggcagtttaggaacatcagaggaaggggcaagccctgtaagtg

SEQ ID NO: 89672 - DNA, 1120 bp, Homo sapiens
tcagcattcgctttcccctccttggcccagatcccaggccctcagtgcacccacagggccacaggtcaggtgcccgaggctctgggaagctgcaggcggacaggtcctggggctggcatgagatgtggttcagtccaacctcggcttgggttccctcctctgggcctccgggctgagttggcggggccacacagactccttggctcctgtgccttataaacagggctgagtgtgagtgtggagcttagaagaggaatgcccacgcctgtggcccggggcagctgccaccacccacccccactccactggctaccaagccaccagactcagagagcccatggggcaggagtgggaagtggggagcttcgcctgtagacccttctcccctgcccaggcctggcttcccagaacaccccagattacagatgtttttctccttcatctccaattaacatttacctgtcctgggtcctaacctttagtgaatgacagggtgtactgtccctcccttcctatctgggaaaggctgatgtcttagctgggaagagcaactgggatccaggcctgttagacacagggtcccatgtaggccaccacaggtctggaccacctgggaggcctagctggggggctcccaggggccagtccaccaaccacagctggtctacattgcaccagcacggcttatgtatggaatgacttgaaaagtcgtcgactgccctttctgggaaggactggctactactctgagattgcatccttcctaccatattggcattaagttgtcctttcttttatgatatgacggatgaagctttaaaaaaaaaaatgcttagcaaaataaaatgtgggcaaccctcaaattttaccagtccaataaatcttggagctcaggactctggttccagaacagcacggttcacctggatacccagctctcctggcactgaggagcccggggataagaggaactgttgagtgtgtggggtacagcctggggaggcctccgaccctggggctgcatgcctcaccctgacagtaacttgcagcttgaactgccagttcatctttacacctgggatttccaccccaccccacctcctctatcctctcggctgga

SEQ ID NO: 89673 - DNA, 2090 bp, Homo sapiens
gggttctagctctggctgtgtcatcccctggtactccagcagcaggctttctgggtcctggttttctcatcaggatgacaaggggctggaggagctggccttcaaggttccatccagttgaaagatctgtaactccaggacgttgctgaggctttttgaggccctaaaagcagactacccaagctattaagggtccctttgcatctgtgctctgcagagaagaggctttgttggccaggtgggcacagatgctggtgtactggactcctgatgggcaggggcctggagagaagcagcacccagcgcttcctatgcttaaagaaaggcagggtcctggtcaaagggctgtaagagcctgggcaagtccaggactagcctcaccgcctccttctttctgtctcgtcctgagagatgagctggtgactgggtgcagtgggggggcgggtgtcttcattctaggagtcaccaatgcctgtccccactaaccctctctgccaatgtgttttctagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttc

SEQ ID NO: 89674 - DNA, 1364 bp, Homo sapiens
gatggatactttgcagaaacaagtgaatgcctgatgagtcaccttctccctgtccctgtcttgttttccatatgttccagtacgtatgtgcacacagaaacacacataacacacactcgtacacactgacatcatggacacagtcttgcacacgcacatgcacaagcactggacttccaagctacatggggggtggtgaccggccagttttctggtgttgatttttagtgggggttgggggttgagggaaaggaatgagacctcagtgtcccctttttgtggagcttttggggcaggcatttgggaaggccagcttggggtgtctgtagggaaccgctgctctgggtgtgtgtgtctgtggctgccccagcaggccgcagtgtgcacatttgtatggccttactgacgggcacctccatccaacactggctgctacttaaaacaacaacaacaacaacaacaactgagtggagccagtgggttcccaggtcctaacacgcctgtaaaagttggagccagttagtgtcctgggctgccccagttacccagcctgctggggcagcaggatgcggccccatcttccgccatggaccccctgcagggtgcaacccatcatcattgactctgaacccagttactccagaaacacaaaggccacaccaaaacacatctcacactcaacccctgctttgtgccccccaggtccccaagaggaggagctggggctgcagggagcgagggcaaggccctgaccgacgtggggcccttcccctctgcttttccccctctgctgtccccatttttgttaacaaatacaagacttccggtctccaccctgctgccacaaaccacagcgttcctgcagtctggctgggctggggagatttatggtcccaagtctgaggcctgcccgctggctcctacttaaggaggagtcagaatgcccgccgccggggctccctttccctccgtgtgaccccccttttaaagtcctccaagtgcctgttgaggaaaattaccttaccagaatcaccccggcccccaggctgcctgtgggaagactgtgtagggaagcggggcggggcctgcaggggagggatgagggcggagcagggcgccctgcaggctccagatgcttctgtggaaggaggggagagagggggcacccctggggatgggggtgccggcagagaaggggagaagggggacgcatctatttgagacacataatcttctgtctgggctggaggaagctttgttaaggtagcccgggttaataccggtctgcatgttgtgatttggcattttgacatgaattcaccctttgtgtacagggctgctgctgacacactgagactgttttc

SEQ ID NO: 89675 - DNA, 1074 bp, Homo sapiens
aacacaggctgaagtcctctcctttctcaacacccacctcccccttccctttaaagggaggattttatgctttaagggaaatggggaaggttgggggggggcaacaccttaaaggaattttaggcagattcagcatttttctggtgttgctccaaaaattccccacactgtaataaaaagatacaactgtgagcaggcatctgattagtgagctttttacaacacagcttttcttttggatgctttaaaatgaacacatactgttttaaaacaagcccctgtacagttttctggggagggggagaagtttgtggaaaataccggaaaaggttataaagctgagggaaattaacaaaggactgtgagttttgccttcagaggttaactatcagcgagaggccaaggctcttccttagtccttgtactgactgaacttcccagcccctcgacacgtggcccgggaagtccctgggagcaaagcgtccacacagacctttgtggggagactcgtgtgggctgtgggcccgattcagggaactgtgtttctgtgaagatgaagctgagcatttcccagaaatgagcccaaatggcggggaattcagggcaaaggggaatctctgtagtggcaatgggggatgtcgtgcggggtccccagaaggtgtgatgtccacacaagggtgtgtgttcgaggggcctttgctgttgccgaatggttttgctggaaagcttgttttttgtgtgtgcttagagatagtcccggcaggaggagactggagctgtcctaacgggaggacagaggctgctggtgggggagctggaggggacagcgagggaggagcaggcaggagtctccctgcggtgggttagggcaccaaatggacttcagggcccttgttcacacacagcagcattcacgacatccatgcattgcagtttttctgggctgggccattaacctcagcagaaaaatgctttttccagggggtgtctggcagcacattgctggcgggctgcacagatgaaacagaaacccacctgacacttccccgtcctgctacagatctcaggctccag

SEQ ID NO: 89676 - DNA, 1924 bp, Homo sapiens
tctgggcttgaattgcagctctgcacttcggccagtgacttgtgcctcacccctactactccctttttttaagataggctggtgatagtatgcagcctcagagggttgtcatgagccacttagagaacacagcctatgcaaagtaaatgcttattaagtgtaggcattggcccagaactgttctaccatggggtgtggggatgtggagacaatcaggaagactggtgggcattttctgagcggctggagaacccaggagcctcagagatgagaccaacgtgtgtgcagcactctccacaagctggccccaatcacttttgcatcaaattggtacagcaaccttatgaggctggccttgggggaaccctgttttagggatgagctgaacttaccgggaggctgcatgcgaggttggtgtgaaatgcatatctggctttgtagctggtcggctcacctctggggttggcacaggggcgggggttctgccatggctagaatgcgctaaggggtggaaacgaagcctgctgggcccgggaaccagagagcagcctggcctttgaaggagaccctgtggcaccccctgcccacccccaagtccagccatctcacttcactggagatgctgcaaagcatgaaaaaaaaaaaatccagtgttctcaggtcagccttccaccagccaggattcatcgtctgatctgtttggggagagagcatggggtggtggagatgggttgggccccagtgttttctgattaactcgcagtttacctgaaacattttggtttgtttcctccatgaggaactcactctaaaccccagcattgtctgtgtttcctgaggagtctgagggagctctggggtcctatttcctcttttggatgaggctgtgagcatggtggattagagacagccccttaaagttagcccagatatctcagcaagttttacgcgtctctatttgggggagggattcgcctattgaaaacaagagaccagcaagggtccttgtgaattatgatggtttggcgtgagaatagatgggatggattggcactggagtccccttttatcttaggcttgtccctgaagagggcttgttgatatcagaacagccaatttcctgacagggttgggagcaggggatgggtgctgttaacctttgagatgtccgttgtggagggagagacaggatgaggcaaccgttggtggcgcctgggtcctgaggagggaggaccctggacctggcgttagcgaggcgtggtgatgtttgcgctcccaggttgccaggtgcaagctgtctgtgtccacatttctgcccttcatttgcccctgattggcacagggagcctgcaggaggcggccgtgcctgcccaggcgcccttcctccccaacttctccgtcctcagccttctgctctgctggaccatggaggagggggctgataggcccgtggccctgttggactttggcagaggaatatcacttcattatccaagtgcctcacagagatgagagccggtggagacccgtcctcactcgcctttgaccccagctcccggtaccctagcaattgggcacatttaaccgtgggtcatcagctgatggagctcatgtctttactggcttttttccccaagcttgcccttgttcctaaatggaatcttgggggaccccctccccacaagtacgttctttgtgtgtctgggcccagtcaggcccagatagcttctcttccacgcgtgcccgtgttctcataaccccatggctgttcttggagctgctctgcctctctgccctctgccttcaggtggagaatggtattgttgaggcactgagcaaggcctttcccccctcctcccatttttcttctttctcatctcctgacgccttcaaattaaaaatttaagaaggggtctgggtgcgg

SEQ ID NO: 89677 - DNA, 1797 bp, Homo sapiens
tcctgtgatgccttccaaggactaggggtcctggtagcctggggctttattaaaacgaggcccacagcaaaagtagcttggtttcttgcacacacagagcccccccaccacctgcaaaaccagggaaaaactgtcctgtccttctaggggttttgtccttttggaaaattggcttaatgatgcagtggtttgtattaagattttcatgatgctttaacgtgtgtgtgtgtgtgtgtgtgtgtgagtgagagagagagagagagagaaagagagaaagagattgagagagagagagagagaatgaatcagcattcagtgccagctgcccagttgggaatccagatagggaatttggggaatctcctacactctcagggtggcaggtgggtaggtgggtgaggtaagagacttgacttggtagtttctcttggacacgacagactttctgttccatgcttgtcccagcccttgtgtcttcctgggggtgccagggtcatgcccagagggaaggcagctgagcagacaatgccatgcagggctgagggcttctgtgcctgctaatatgtgaaccccctttctgaagagagctgctctgagttacttggggggtaacagtgggaacctggttggtgtaccatggaggggaagtatctggaaatttgaactcgagaaatgattcgactgcatgcacactaaacagcagccagagaggccctttactgtcaatattatgaatggagttggctgggtcgggagtccccacccttcctctgaggcctctctcagaggagcctgggcagagtgggcctcctcagacagcagtggctgcaggcagctgggtacacgctgtaatttgcatggctgaatgctggggcacaggaagccgcgtcagcctgactggcgagacagacaagagcttttgatttgtgtggctttcctcccctgccccgtgccaccctcaattacattctccatggcgagataaatgctcttaggagcattcatccccaggttgggggcttcagactcagatgcttggggggttttgggaggtggtgtgggaccagtttggggagccagggagtacattttagttctaggaattgattatttaacataatttgtaaggacacagtcactaattagtgttctagaccagcaggatctgcgaaatatgtaggcttgggagaggtggcaaggagggcggtgatgggaggagaaacttcagggaaccaagcctgggcagacagtggacggatgacagtgataaaagagatcctctcttgggggctcaccgtctcttgagggtgatgaatagtaagacagagtaaaaagtcatttctgactctgaaattaaagaaaaaaaaaagttggtttagagatggacacagcaaaacctgactcaaacctcctttcccttttgattttattttgttttattgttgcaaattaaatgcaaaaatgtaccctgctcctcaaagtggttttcttactctctggaaggtagtaaaaataaatggaaccagtgttgtttaatactgagaatcagagtccagccagagaccatgaaggcagaagggggcccatggggccatcttcccttgtcccctttacattatttatggacaggtcaaactgagaccctgagagggcaagccacttggccaaggtcacagagcagcttgctggcaaaaaagccgtatcaccccccacttcttgctgcaggggagttgcaccccatgcgcagctctaaaagctggtgcagcatttccaaagtgtgttctgaaggacactttg

SEQ ID NO: 89678 - DNA, 4933 bp, Homo sapiens
gggttttgccatgttggtcaggctggtcttgaactcctgacctcaggtgatccgcccgccttggcctcccaaagtgctgggattccaggcatgagccactgcgcccggcctctttgctcctttattattgttgttactgtgtcataattccttgcagaattatgatggccaggctggtctttacttccttcggtccaggccttgaactcggagcagcactctcaaagcagttgtcttcacctggcagaagaaaaaaaaggtgtaaagtgctggttcctggacttgctcgcacactaaaatccctcgggattcagcttcccagataactttcttgcttctttgtagagacatttgagagaaaactattattaactatacatggtccactgttttgctttgctgtcatgaatgggattgtaaaagggacccatgggaccgggtttccttttgggacgatgaaaatgttctggaactgtagagtggtgatggttgcacagttcaccgaatgtattcaatgccattggtggcacattttaagttatgtgtattttaccacaagtttgaccaaaaaatggccagcggtaggttttaaatacatgtagatacttggataatctataaggaacagtgattgtggagagtaaaattggagagacttctgttagttgcctaggacctgatgatggtagacacttgttttggtggcagccctgaggtcacatgggaagtacattgatggaccagggagcaaggctggtagcctgcctgggatctcgtgtgtgtgtgtgtggtgtgtgtgtgtgtgtgtgtgtgtgtgtgtgtgtgtgtgttttgagatggagtctcactctgtcaccctggctggagggcagtggcgtgatctcggctcactacaacctccacctcctgggttcaagccattctcatgcgtcagtatccctagcagctgggattacaggcgtgccacaccatgcctggctaatttttttctagtagaaagggcgtttcaccatgttggccagactggtctcgaactcctaacctcaagtgatcctcccgacttagcctcccaaagtgctgggattataggcgtgtaccaccacgcctggccttctgctgtgtgttacctgagcaagcagacacatctgtgctgatccttcgaccttccttttttcttcgtgggttccagaaatgagagacaggaaagttccctctggtttgattcccggcctgacttttctgctgggggaagtgaatatgcttgttctcactctgcggggtccccctggcctgcccatcccagtgactgcgaaccaggatggtgccagggttggctccaaaagctggtgatccagacccttcctgggcccctggagaccccagtccctgtgatgtccttgcccaagttctagggctgcagtggccgtaggtgactggcccgggcaccctccctttgcgggagcctcgtgaaaggatactgtaagcacagccacagggaggtcaccactggccctaccacctctcgctcggtattgaatggctagccccaagcctggctgcctgcctactgtcacacagaggcttcctctccgggctattttcagcgggaagatattattaactgctgaggcacagttctcaatttagtggttaacacaccaagaaagcaacactcacctgatcccggccactctacctaaacctgttggctcacttgggggactcggctgccccccagcctctctgtttctctctgtgggttcacctgggagatgtgggcttccactcccgtggaaggtgccccgtggattcagtatctgctagagagagaaccaggcttcttacgaagccaactcttaaaaggtgtagaaaatgatcgtatttatactctaagatggggacattttttgataggggtgggcactggctgggaaaagggactttcagcggtgttgaggacagttatttaaaacagggtgataactttcaccttgtaagttaacaggaaatattgggacaagacaggaaattgcatcatctttttttttgagaataactccagagaaaagtggttcgtgaaaggtagtggctgagaaacggctagcctgttttctgttttgtgttttttttttcttcccttccactcccacgagaacatgtaggccattttctttaagaaagaggctgtttgagaactttatgttatttttattatttaaaaaaatattttaccagaagggtcaccttcagttgaaatgttaactgccgccttatttcccattttactaaagaatctttcatgactttttcagcttccttccccaaatggtaaggccaagcagctcttggctggaagctaattttggtttggctggggagtcctcaacactgagccccacccagtgtcattagctcagttttaacttgcaaaaaaaagattgtatttttttttttgatggggggtacgtaagaatttactcacgcctttagcctttttacccacccccggtactgccttcccctaacagaggcacctggcacttagccgccgggaactcagggctgccttcgtgttttcaagccaccgtgtccccctcatcctgcaggagttctgtaactttcctgagactatttctagggtgctagtgaggagtggaggggaaatgggtctcggagctgccctggtacagctgtgtccagtaacggtgctgtgctttggaggaaggagtgatatggttcacctagaagcatctcccagagagggggcttatcacagccctacagtggtgcagataaggtccagttccattttttgtctctgggtttctaaatcccctctttgttgatgtcattgttctaatgacacagggcatgggacagtgccccggcccgtgctgccaaggagccgtctttaggacagagaccagaaagaaagagacctgtgtgtgtggctggcccgctctccactcacgctcacccccaccctcccagctttttccttagcgtgctttgttttgttttcataacacaacaagggccctggggtgtgtaaaagcattgttgaacacttggtgagggcaacttgtccaaacagagcaggacgccaaagcagaatgctgtgggcaggtggtgtgcccacagaggttggtgggccggcgccggccttggaaacacctctcagtggcatatgccgcggcggctgagtgtgacctagcgcagaacagggcttccctcttgtgtcctccgtggggagtccaggagagggacttggtccttctggctgactccgtgcttggaaggtgtgctcccctctcaggtgggttcacatgtgcctccctctgccgggtgtgaagctaggtgggcccgctgctttggaagaagccagtgtgtccctgtggtttgtttatggagcaaatatgtattgacacctattatgtgccaggctgtgtgctgtgcagaggaccagttcctgggctgggttagaattaagaattggcagttggaatggcttgtccgaaggtgatgttgaatccatggggatggagccggcgggaggggggattgactaggagttgcctctacctggaggcaggcaggggcagcttctgtaggacagaggagcctggtccctccatgaagccaggccataggtgggggaggtgcagggtgggccccctgggatgggcctagctcttgagtcatccacttctacttctgctttggttgtgtggtctgttgagaattgagataaagcaaagcttgtggataaacagaggtaggtctcccgggttttggttccagcccgcctccccaccccgcttcttgctgattgtaagatgacagcaggaagaacaggagctgtggttataatccaccctccagaccctggtagtacctggggcacagcacagagtggaagtgaccagcctagcgccaggctcctcagtggaccacggccaaggggtggggaaacatctggaaagacagtatctaatgtcttgacagccagaggagaagtgggatgttttcaaagcccaggagtgactttccctttgtaactccagaggacttgattcgcaacgaagaccatctgggggatgaaggaaattcttgctttttaattttaaatctgagggttaagcccgtttctgaggtgtcagccctgtgtgtgaggccctggcctgtctggggttgggtttggatgaaataatctaagatgcagttaccagggtgtttccttttcacattcatccttctctgtctgttcccccggggccaaccgatggcttccaagctctgtggagttcactaattgaattactcttctcgctcctccgtgaagccccaccaggaagaaaaggcggggagagctgcttttgctggggggtttgatcagagcagaaagggaagatctggtctcaattccaatttcatcttgcaaagtcgggactttctttcagccagaagacaactcagataaccaggccagcgactgtgtgctcatttcagtattgctttcttacgttttgatctgcgactgtcactcaacaggaacaaaaacaataagacgccaagatatgactgtgccgttggcagattagctgtctgcattttctggggtggctcactcggaggttaaatgattgtccctgtcccctgtcccaccttccagtcacctcatgaagctgttaagtgtctccttcccctgcaggctaagtgaggatcatcaagagctgggcctggggaccttgtcagcctcactgcagcctctgagccagccctgccccaccccctcatgaatcagtaaccaagagggaaaattaaaaagttagttatcagtgtgatctgagtgcaccataccgttcttacaaatagatgggccccatctcctgctcagtgggggcacaatcaaaaccctgctgggggggctgtt

SEQ ID NO: 89679 - DNA, 3478 bp, Homo sapiens
ctcactgcaacctccacctcccaggttcaagcaattctcctgcctcagcctcccaagtagctgggattacaggcatccaccactgtgcccagctaattttttgtatttttagtagagatggggtttcgccatgttggccaggctggtcttgaactcctgacctcggatgatccacccaccctttcctccccaagtgctgagattacaggtgtgagccactgcgcctggccgatgggtgggctttttttccccaaagctcttccagtcctagaaagaaactgggggtaaaacaatcattaactccttcccctcacccctccaggtaattgtagacacagatattaataaggagctgccaggaagaagcagtgactctctgaagggcagtgtggcttcagaagactgcagagagaagagggggccttccacatggcaagagcatttgttttgaatttcagctcttgatttactaattccaaaggcttcaaagtttgagctccttcttctttccgttcagagttggtgcagtgtattcataatgggccatggtggggagggtacactgttttgggggttgatgtcaccggcttgggggcgtctggaggggaggtgatgggcacggagaaaacctagggctgtcctctttgtagcgagaatgccttccaaaagggaactttattggcccctgtccagggcagagagttttgtaaatggagaaagcccaaacctcctccttttcaagaagttgatcgttccatggggggtggcctgggtgtgtctgccttgctgtggatgaggccagtgactggatgtggcagggctggatgggggaaggggcatagcagacactgaggttggggggtgggagcctggcagcaaggtggggagcagtgaaaactgaggagtttctccctcctcctccttgaaataacctctctgagcctctttcacaggccctgtgtgctgttttccttcctgtcctgccctggctgagagcgggcttaatgaatggggctcagtttagggtgggaggaaggtcggcagcaggagccagggcttgattctcttggcaagggaagaagggaaagaaaaaacagccgaatgtgaaaatgtggtgcctcggaggtgggggtggggtgtgctcaaaggccggtcctctcctgaaatgcaggggtgactccaaggctggcccttccctttcctgcgcccttgcaaactgcccgggaggaaggggagtgggcgggtaggagcccgggggcggggctgctggctgcaggttggaattccagcattgcagctttgttttgggggggtgtgggggggtgggtagacgacaggcctggtcgttagggacttgcagtgaaacacaccccacccttgcaagtttcctcggtctgggaaaatgggacatttttagaaggcagtgacttgcttccaggagattgtactttcatttttgacagctggctctctgagacagatggattgctgggtgcaagcttgtgtgtgtatgcgtgtgtgtgtgttgtgggggtgggtgtgtgggtgggtgggttttgccgcagacgtacagatagacaatcccgtgcgcaaacacatgagagcgtgcggatgcccacaggcaggctctgggatagggtgggtccctgtcgctggggtgggttgatgtcagggcggcctctccaagaggttgtggacttgtggggtggagtttgtggattgattctgctttgtgatttggcagtctgtgcctgactctctgggatgggtgtcttttgaaaggcatgcaactccagaacaggtccttgctgctgcttggacatggatgtgtcatggctcaggaagatcacctgggagaggtctgatgtagctgggaagcctctaggctcagctccgtcgtggagatggaaaggatttgctcccagagctttccggggatcactgggaatgcagagcatgtgttggaagctatcatctttgcagcctccatctggagtttctgtctgggggctttcattttgcctgtctgctgtcctggtttgagtgggttgagggagcagcatctcccttgtgagttgtaggttattcagctgcagactcatcttctagcctcctcctttatatatgaatgtctggagctggctgggcctcagccatatggacctgcccagttagggtagggattggaagccagcaaccacttgtagttatttaaacttcaaaagaagtgctcccatggatctcaaggagggaggtaggaggcagtggagacagaagtgctcacgtgtcctgggaaactccatctcttggctgtgcgaagtcatgcttgttggagagacccggcaccatgcctccaacccaagggtggccaactctttgcttgagattcatatgtggctactagtccccaagtctgggggatgggagcgtccttgagtcagtatccattcagcatccaaggatgtttctgtctccttctctttgatccttgctggcatctgtcatagtctcagaggagagccttcaaaaatacctatataatctgaaaatgcacccctggctcagtccacagttgacttgggctcaaaccaagtagcttaggaaacattgctccatcctgttttaaggaaagttaatcagctgcacgtgaacaattattcattgtctggcttggaattgtgatcatgaactgggaacctgggcctgggcgcctgttgctctgcttttaaattaagtcacctccccctgcctggctacaaaacagctcatggtttcactgaggtctctaatgccattgtggagtgagggcagggggcacaggttgagctcacaggcatgtgggcctttcatccaaatgctcatgagcgtggactttgggggactcaggtggacaggtgcttgtgaccatgagcaagctccttccttcccatccccttagtaccctgcaggccactgtgagaaatgacggcctagaactcaggggacaccttctgcctctccttaaacacctgccaacaggatgagtcagggctggggcgggctcacctggtgcacacccacaccctggtgaagaccagtcctggaccccgcctcttctgcagtgccccaggtcatgcacttccccctggagaagggcttactgataaaaccccttttgtcctggaaagaatgaggcagtccggcaggggttaaatacagggtgacagcatttaaaatctctggagcaaatttgggctgctctgccggccagacaagatggtctgctgccgcctcacgcatcctgtccccaggctgaactgggccagcaaagggagagggccaggtgaaggccaggctttgggtggtgtcacttttggtgacactgtagcatgctgattgcccctcacttcctacacacacacacacacacacacacacacacacacacacacacatgcctttacttagcaaagcctgactgtagctgcgtagacttgta

SEQ ID NO: 89680 - DNA, 2872 bp, Homo sapiens
ggagtgggtggaggagagggttgagaagcctatctctagaaaatgatgaaggccatcaaaatggtttagaaagtgcagggtatacaccatttaacaagtaactccatttcctgcctgcctctattgttttctgtttgattaagtgtatcctgtaaaactgtatattcctgttaggaattagactttaccctgataaaatgagattacacacacagtcttctttccccctacccaccgcagccacctcacccccacgcctgcctccacttctgcccctcgcccgcttaggagagttcttgaaaagttgtccttccagccttgagaatgtgggagagggagtgaccctgagttagagagagaaacttagcattaagagggcagacagcagaaacccagagatggtttggggctatgtgtaggccactaaaggattcccatgggctacttgcccgtctgctctttttttttggctttcctatttgccagcatggccaagtggttccaactggaaacccacagggacattgtcctggtggcctggggtaggaggcctggtgtctgcacgatccaacctgttgtgtttgctgcggacctgggcagcacctttccttagccgggctctccgctaggacttcagggagtttggcgctgccagtggtgcatgacaagcttacagggtcttgtgtatttgtgtttcatgggactaatgagttgtggttcatggacattaggttttgctttaattgcttggagggcggttgtggagactgtttctcagctggaattgtcattatcctcattaacggtgaggtcactgtgcagagtacctgagggtgacagaagttgaagagaagtctagttaagggcagatgcaatctaaaggtaaaaatcagtgaggaaactccgagtgttgggtgccaaatgttttataggaactgagggcagagagccttagcaggtctggggttgcctgggaaggtttccagagatgaggggtttggactagcctgggagaggtagaacatttcccctccggctcggagccttgctgagaatgttctctgtcttgatctggtggtggttacacagatgtatacatgagtaacattcattgcgtctacttgggattttgtatactttgctctacttaagttagtcctcaattaaaaaaggggaaagaagtcccggcagcccaacatcaatcttgagaatgttttcaagaactgggaaacctgtctttaaaaggatgaaggcagagaggacatgggctccaaggagagagccttctgcccttgatgagggatgacagagcaaccagggttgagaaagtccaacccaaacctcctttgaccttgggaaccacctggtatccgtaatgggggactggtaatgcaagagaaattccagccagtctcattgagcctgactcgagtaatgattaactggctgcccggagcccagacgggtgacaaggtgctgtggtctgtcttacgatgggcagtgaagcctgagcagaccattaataatcagcatcaaggccgcgagtcagccttttggaatgtgtggtttgtctttcatgctgtttagagcgtgcttaaagatggatcttggtgtttttatttgtgtatttatttctttctctccccttttcaaatccacagcagactgtccagatgctgtgccttcctccgctgaaacagggggaacgaattatctggcccctggggggctttcaggtaagatgctttctcttattttcctggcaattccaaccttttttgaaattgctaaagactggaggaatgggggtggccttctgccaccccagctggtctggacttcattctcatttttatatgccttaagttggatgcatcggtggtgacattgtggtgcccttcagctcctcatcctgcagtcctttacgctctggacactggatccgttccgtggacggggagacaagagcgagctggggattgctttggtgtgtgaagtgttgcccggttatttttaagcagctcctggcttggggggcttcagcttggtgactttggtgtcattaactcatgcatttgagctctttttttgcttttgctctttgcgcatgggggatgtaaagggaatggacccacctttagggaacttgttgaagacagatcccaagcatacgatgggatttcagagtagatctgaggcttccctcccaagttctgattcccagcccagcctgctgcaggattttgcagcacatgtctggggctgggagcaccagggtgggagcactgccaacagtaggagctgtaattgttccctagcggggcaggttttcctcagggctcacaggtatgcgtgaaggcctggaatgccagtgctggggggtcacggggctggctgacaggcacggggtagccagagcattgttgttcctgaggatgcgaaaagagggcagtacttagagaaactcactggttatgtacatgggacgcatttcatgttgttctgaagaaatcctatttctacctgtttttccatccccaccatgtcatcactagattttctaagaactggctgaagcaagagggaaaacgaccttaaaaacagaaattccagcagagttttgggcatttggcatttccttgcctgtaggatcacgtggtagcagctcgaatagaagctgtgccctgttgtggtgtatcctcttgtgtgaggggcacccttttttgtggggtacctgctctgactacttggtggtgtgtcttccatggctggctcaggcaaagttcattcccggacggctccctccccggctctcctcttcaggaactgagcttgctgagaacgtctttagggagacccttgtttgttttca

SEQ ID NO: 89681 - DNA, 4585 bp, Homo sapiens
ctcccgagtgcgctaggaatgggcagccccgtgtcccccgcgcgagtgccgagcggaccggcgggggcagaggtgaattgcacgcctggggggcgggccggggcggggagccgaggttgctgggagctgggtctggagtccgaggacggggagggggcatggtcgccccccgccctgtgaactgtgaagtgcgcggctccggccgagccggtggtttccagccgggccagccgagcgcggcggctgcggccgcagacgtggaggagcggagcgccgaggctggcgccaggcggcctcttttgtttatctgacagctaaatatcaaggcaatcaccgcctcgcggccctgcctccaacccccacagctaagacaaacagttgggctaaaagaatgcctctgttatcataagtttctatctctcttctcatggctgggcctttattttctcttgcttttttaatttcagagtctcccccccctccttactccagatacccgatggattttctcaaaccaactggtgagtagatgatttttaaaatatcctgcttatcttaagttagaaatagagcctctagaacgtggctttttgtgtgtaggcaaaggcttggggaggtgctgggcttcacgttggttctaggtttcctctgttggaagtttggtgaatttttctgttgtggctgggttttttgctgtttttgcaaagacgttcccttgatatgctttacattttgttcctttttcatgtatttgtgctgtgtagccggtgggctcagctttaacacgtggaagctttagtccagagagaagtgtcttgggaaccaaataggactggttgatggggataactcggagacttagtgagtgccaggagcatcagtgggaataatggaaagggtgattcgatagatgggaagacggtttaaaaaggtgcaaagaagactttggtctggagtagacactagaacttttcagaagtataggcaacagccagtaaaaggggggggggggtaggttcctcctgctccagtcacctgcaagtcagtcctctcccggggttttctcagtattcgccatagggactatcaaagtttgaagcatagctctgcctgtctgctgctttgtcactggctggcatgaagccatggcagaagcccatttgagactggcaccagccctgttgtggttgtctgcattcaacttctggccggcagcagcacaggggtccatcctctggacatcacagtgctggggacagggtcagcaaaatgaacttgggggtgacaacaaggacaaacccaaattcctggagctccctcttacagtaggagatagatctgtttgctaaaagtacaggttgtatgtaaccttggtttttgtgcctgtatactggtgcctgaaaaaaacattaatacttgggacatttttattttgccaaggttctgggagaaggaaaagtgaagggttgggcaccatttagctcctggaattctgcaagtccttccgcctcctgcgttttggctgttgggcctttccccccactaattaaaagttttgctggggcgttgtcataaattaaatactttaatgaacgtgtaaccgaagcccatactctgcagccagtcctcctgggactctaccagctccctcaagttgggaaggcgttcctgcttgcctggtgccggtctaataagtggcccgcaaagcatgtgatattttgctttcgatttacaaaacaccagataaatggttattaataaggagatacccagctctctgtatttgtaacaaacgttaactggaattaccaagctctgttttcctaaagactgtaacttgactgggttttggcttaaagaatcaagaattcttttatgaagttcattttccaaggggccacctctgacctgttttttttgtccttccatattcttcaaatttggaggttttccttaaaagagagagaacagtgaccttagccccagggataaagaccagcaggggtaaatgttcccagaaacctccaaaaaccatagaaaagaaaggccatgttcccttgggtttcctgcagagacactgggataaatctgttctcaggatttaagcagtcattctgccaggccagggcctcattttcggtgagtggagtgatatatttattcattagcaagtgttgacattaggtagcaaaatgtgtgtaaacagagaagccacaaagacaggaatgtgccatttccaagggggagaaaagttctccagatcagccaataggaagtgattaacctgccaatcggaaactaagacagctggttactcacccaaaacgttttgttgaaaatagaacaaaaaaagaaatgagaaaaggcgctgctgtgtaagaatttagcatcagtaatagacaaagcccccacgaagggaattgtcctgccacattggaggacagccaggtctggagctggagcacaccccccccgcccccctcacaggtctggggctggttttgccagctgctgtggccgggggcattgaggtcagaccacagatgggcgctgacccaggtcttcatccccattttgcgtatgggagaatgtttggcccgggaatctacatggaccatttacattcttcagtttctatgtcccttaggttgaatttttggtcttgggttactagatgaaacaggcacaaagttttacagtggacaactgttaaaatcttaaccagttgcacaactaaaggaatacatcctgtgaagtctccatcttaggaaaaggtggtgggaatggggctggggcctggtaccctgcagcctttggagacacagagggctcaaagctaggaactccattttgctataatttaagccactccactcagcatctgggaggcctggactttagacacctaggtactgtgtggtccaaccaggagagccttctttgaaagagtgttcacatgactgaacctaggggaggccagttgtgacttgtggctgtcagaagtcagaaagacacccccacctccacatcccacaagaagtcagaatttgctgtttaaagctggatctcggggatagctgtgtgggctctgcttcccgtgtttcattgtatctgatggtctgaaaggtttgaggaatggctggccttggggggttgctgggtgagctcttgagggacccaggtggccagtatccatgggcagatccagcctgcaaatccagatcggaagtctggtgtcttgacctgagatctggcactgcgtttctctcttaaccgaggtccctcttaacttttctaggcctcttttaaaatcagcatgatgaaagagattaggtcattcattcatttattcattcattggttcagtcattcattttacaggcatgatgatgtgcctacctagaaatttgaggattccgatgcagtgctgtgttctttttttttccgagacagtctcattctgtgcccaggctggagtgcagtggcccgatctcggctcactgcaagctccacctcctgggttcacaccattgtcctgcctcagcctcccgagcagctgggactacaggtgcccgtcaccatgcccagctaattttttgtatttttagtagagacggggtttcaccgagttagccaggatggtctcgatctcctgacctcgtgtgatctgcccacctctgcttcccaaagtgctgggattacaggcgtgagccactgcacctggcagtgctgtgttcttttataaccagggttcatttgagttctgggttggttgaactacctggggcagagctgggacccttggggtacagtggtgagtaggggctcctctgtctttaacagtacttaggaagctcagaacgcagttgctgagactatcgtgggactcccagctcctttaccttgtactcattctcaatagttcgctccttggctgctccccagggttgggttttcaaagactctgttggagctgctcggagaaaggaatgagtctttttctctcgcagaacctagtgcttaccaagtgcttgataacacttagtgttgcgtgagtcaggagtggcctagagcttctgtctgccagccagcctgggctctggggaacaggcgacacaggcctaaggtgagaccctgacttcagagatctgtctatgcggagcttttctgtgggtgagagatggaggtatggctcctttaaccttgaggccagtctggatggcctggccacctccaggaaagagggtagggactccatagcctgcctggggagtgagagccatgggatagggctggactcttgggaatagcccagctcactgggtggccctttgagctagtcagtgacgcctcagtttacctggctgcctatggaacaggtatactttgcttcttcacaggggtggtagggaggcttaattaacgtttgtaaatccctcttgagatcaaagccactgcagaagggcagagcaccatttcacaaaaatgcttgtggttgcctgtgtggagctggcttacctttgatctgagatgggctgacaccctgaatgtggtctcagctctgctctgagatgcccggcttttc

SEQ ID NO: 89682 - DNA, 1024 bp, Homo sapiens
ccccgccgggctcagccgccgccgcagcatcttctgcccctgcgcccgcgccagcctcgaggaagtccccgccgaggacctgggcccccaggagcgcagggggaaagaccagagactcccctaaaccacccagatgcgcaggattgaagcggtctagccaaagctttctgtggattaaaaaaatacacgatttttttttttttttttggcagaagaaaaggagaggaagaccagcggggctttgcaaggaaacggggggatgtaactcgtggatacatttttccacccatcaaacatcttgttatactttgtaaacattttctttttttaaaccccagttccagccggacgcccccagacctctgaggttcgaggaggtggtggttttcatttggggctttgcatatttggttgttaggttttgcgagagccttcttattttgccagacgtctcatgcggggtgaagtccactcggccccctcccctgagtcttcgtgtgcgcggaattcgaggagatccggttactaaggatatagaggaaaaaaataaatcgcttgcttttttttttttaattgcctgcttctccccacccccaaattaagttgcttagcaagggggaaagaggctttttccttcttccaacagcccagccgaacgcctttcgttttttgcccccgcggaccttccatgtaggaagccgaggctggcgagcccgacattcgggagccactgcgggggggcctctttttggggaggcgccgacgggggcaggctcggccgtccccagggaagcggcggccgggttcctccggggcgcgccggggccggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgcccc

SEQ ID NO: 89683 - DNA, 1023 bp, Homo sapiens
aaaaaattagccaggcgtggtggcatgctcctgtaatcccagctacttgggaggctgaggcaggagaatcacttgaacccaggaggccgagggtgcagtgagctgagatcaccacactgcactctagcctgggcgacagagtgagactccatctcaaaaaaaaaaagataaatacggctgtcaggatgacacaggcacaggaaggagcctgcccaatctgagaaaatgagagctttgctttttggaacagaaacgtgttcacatgattttcaattcatttagccagcactgattcagagctgattggagtcaggatccaggagagacctctgagggttataaatgtgaggattaatcagcctttgccctcaagaagtccacagtctaggagagccacaaactctcatgaaatgggatcagtgttaccccagcagcaagaatggaggcactggctctaagaacagaaagtcaagggactcattctgtctgggagaggcctcaaaaggtttcccaaaggaagaaatattttagactagattagctgagttgactagccaggcaaaggtgatcagagtcctaattgtcctatcaaaaagaaaaaaaaaaaagaaaggattacaaatatgagccaccacacctggaacaatgcctggtgtgatggctcacgcctgtaatcccagcactttggacagctgaggtgggaggactgcctgagcccaggagttggagaccagcctgggcaacatagtgggaactcgtccctacaaaaaatacaaaaattatggccaagcgtggtggctcacgcctgtaatcccagcactttgggaggctgaggcaggtggatcacctgaggtcaagagttcgagaccagcctgaccaacatggtgaaaccctgtctctactaaatatacaaaaattagctgggcgtggtggctggcacctgtaattccagctactcaggaggctgaggcaggagaatcgcttgaacccgggaggcagaggttgcagtgagcccagactgcg

SEQ ID NO: 89684 - DNA, 1020 bp, Homo sapiens
aaggagcagaagttattcctctctttcctctacagccaagcaaatgcctcctgtttagctgaagcccaccaacatttggtttaaggacttatcattgatgaactaaagttacacagcaataggatatggaggaggaatgatagtgaggctacgtaatccccaaatttatccttcacccccagaattaaaaaaagaatgtaaatgcgtcctctgctattttacgacaggatctccaaacctgtgtagttttcatctgagcaggactgcccaccacaagccctgcacgtgctgtctgtagtcactaacccatcactcccgacctgcgccatctgccaacagttactggtctgccttgcgaccagcaatctcccatttccttgtctattcagaggcttaatatggtcttgaattttttttttcaatctgctatgtagctattggattttaaattgtattagactctggacctgtgccaggtgcttgctagagtttctgatgctatcttatatcatctttaggtggaagggggaaaacgccattcaactttcgtggtaataaaattattgcagttgtgccctccatctgttcactgaacttcctgtgggttttcaccagatcacatgactgacagcagagatggctttcaggcttttggtctgcttgttgcacccaagtctcaaccaccaaaccagacccttgctttgtctctgagctgggcgtccggatgtcccactgtggtaggttgactcactggagctgataaaaacattccagccaaacttgagagtctagcattacctctggctccaaaaatcaaaacaacaggattgctgtaagtagctttggattgagaccaagctacaagcttgagggatgagttttctctctttgttgagctgtgtcacaggacaagtatctcggaaagagaagcgtgaaagccaggggctcctcaccaaagtagcctgagcttgagataaccagtgccctgccctgtgccagccagttctagctgaattcctg

SEQ ID NO: 89685 - DNA, 1051 bp, Homo sapiens
atcgagaccatcctggctaacatggtgaaaccccgtctctactaaaaatacaaaaaaaaaaaaaaaattacccagttgtggtggcatgcgcctgtagtccctgctactagggagtctaaagtgggaggatcgcttgagcctgggaggttgaggctacagtgagccgagatcacaccaatgcactccagcctggccaacagagtgagactctgtctttaaaaataataataaaataaataaagcaggaatcatgaatgaaaaagaataggcttttattaatggagattcaatctttgtttcagcttacaaatacgaatatttttacactcattagccctctgtgaagattctcctctcctcagtggcatgtagcctgagagccaaatcctgtttgatttctgatcacatcacctgtcccttgcttattagctttctctactttggttttggaaaacagagtttcaagtattctctttcttttctactctgacagtgtcaatgaaaatggcctgtcttcagtggcttttaggggctctgtggcaatgctagcagaaagcagggcctgagcccatttggtggctcttgagtctctgagttgtctgaagagtcctgcctccatttcaggaaagtgggagcagagggtgacagctgaagagacaggaacgacttgagaaaccccaaagtttccttcagcctgcacctcccccagccccctcattactcacttcccctagccaggctcacgtggctgctgggctgagtcgcctcagctgccgtggcagtgtcaccacctccatcctcactggccagcagcgggaagccgttgttccattagagtcagccgctggttgcttgttcatcttttggtgtgagccctcccaggatatttcctggaacgctggagggaaacatttcttcacccagcctttccaggcttcagctcatcgtagtctttgccttcccattctcacgaaggcggggagacctttgtccaagaaagggaattcaggttactcacccacagcatgctgctgtgctttcgtttagcatt

SEQ ID NO: 89686 - DNA, 1416 bp, Homo sapiens
aacagccaggaaaacagctaaggatcaaccattgtgttagggtcctggtacagtcacagctcagtgatgcagacccatcaaccaggtggcaaagatgaccattattttgtatcaccattgtatttgttaaagcactagtgattacagttataatgtaaatattaataaaaaggaaagaaggatgcatgggtgagcaggtcaccttttgtcttagttcgctggggctgctataaccaaatactgtggaatgggaggcttataaacaacagaacttacttttcactgtcctggaggctgagaagtctaagatcaaagcaccagcagatttggtgtctgctgagggcccactttgtggttcgtagacagcaccctctagctgtgtccttacatggtggacgggactagctggctggctgtggtcttttctataaggacactaataatccttgcaagagggatttaatcagaagttttatcttgaaacatctttcttcatcagaaagtgtttcgtatgcacttagaggtagaaaccatagaagatgtatttacagtataagtttctctttaaataagcacatcattctgtcttccttaaatctgctttttcattgtacaagttccaaaactcagatgttgtcaccccttttgtgctgagcatacattagttctctctaggggaaatttagagttttcactttttcttatgtataacaaattttgatttaaaaaaaaaggtatgttctacatcctcttgctctaaataaccccaaatataagtgtcttattatagtatgttgattatttaaatttggaatttccttttgaaagatcctttaaaatgttttatgggtgtttccaaggtaactctcaatgttgtttaattttcatgcttacagtgtataacaaattgaattatctatcattggtcccttaagagataagcagtgtgtctttctttattgaaatatgtaaatttgtgtcaggcagtgtggctcacacctgtaacccaagcactttgtggaggtcaagtcaggaggatcacttgaccacaaaaccagcctgggcaacatagtgagaccccatctctataaaaaatttaaaaatttgccaggcatggtggtgcagacctgtggtcctagctactcaggaagctgaggtgggaggatcacttgagcccagaagtttgaggctgcaatgaactatgatcatatcactacactctagcctgagcaacagagcaagaccctgcctctgaggaaaaaaaaaaaaaagaagaaaaagaaaaaaatgtaaatttagcaaaattggagcctgtgttataaaatatgagtgcttgctcttaattccttgttttgaaaatgactagagatctccaaatgcttcatctacagatgttttacttgccttctggggcat

SEQ ID NO: 89687 - DNA, 1031 bp, Homo sapiens
acctaaatttattttagttgcagatttagaagtgtgaaaaggaaaaatatatacgtattttgaacatgctatcccagtgatttattaatagagcttaatacactcttgctggagatttcaaatgcctgctagcctctccacatataagtgcaaaggctaaaacttcccttgcatcagtctagctagttttgtgttatttttagttttcaagtagaatttaatcaaatagatcatagagcggccctcagaaagtgaatgggaaatttcttactgttaacagtttctttagggagtatgaagtcatagaccctggtgtggagagcttcacagaagtggatctattttcagaattatgtttgatgtgaatttttgcacgtttacttcaaaggcattttcattataagtgacaaatgacttctgaggaggatagaataaaaagattagcttaaaataattgaaatctgagaagttaattttgttgaccaacgaataggtttatgaagcatcccattttgaaatcagaaaatttatatttccaaactcgaatctgcctaaaaatgctacttttccaggcatggcagttgttctgattagattttgtataatgtacatgattagactatcagtttcatgtaggattctatataggtttataaattgtaaactctcagtatataataaattaaaaataagaaggctagtccttttgggagtgactggttctactgtctcccttctaaaagtaaagttattttcattgtttttgcatacatgactgtattcagattttttcccaatgtctaaagtgcttcttccctacccaaactcacccctttctcttagggtttagaaattattaccttcagccaggcaccgtggctcacacctgtaattccagcactttggaaggccaagtcaggtggatcacttgaggccaggcgttcaagaccagcctggtcaacatggcagaaccgtgtctctacaaaaaatacaaaaaagttaaccaggcatagtggcaggtgcctgtaatc

SEQ ID NO: 89688 - DNA, 1113 bp, Homo sapiens
atatgtttcaccacctgagacaagagctaatttatggttagagcgtttaaagagtccaggttttttggaaaaaggaactatatacgagttaagcttctgaggaagacttaagagcattctttctccacattccttctcgcacagcccagaactagtcttgtaacagaagaaaagctatgaaagaatcaccctgaaaaaccaggcttctttatgtgcaatgagaagatttttcatctaaatatattatctgttaaaaagtgatcagggctgacagcagcagtctgttctgtggcatccacagcctctctatggtgttcccacggagaattctggtaataacagataccatatttttgcagtaccttcaagggttgttttaaagcagaatgtacaattcacctcttcccaggtgtcatcaggatgtgaacatgcagcactttatactgttattacattttacatgataactctttatataaaacataaaatggctccagaaaaatgattttatatggtacctactctgaaaacctaaacaaaatggtgcttgttattacattggtgttgtgaattacttgaactattacgatagcatgtttcactaaaacatatttcagtagtttacttttggcataatatctgcagcatggagaataagtgtcatctcaaagtagaaaggcatggcatttttcttaatgtgtctttcagactcaaagtttaaaacatcataatatttttcctgtgattgctactatttttatattcatatatctctacacacacatacacatacagagacacacagatacatacagagaaagattattccccaaatgaaaatatttactttgagcaataaaattaagggtgagttggttggttgatccgttttgctttgcttttttgaaatttactttaatgttgttatactgcctgtacagtaacagggtgcccctgctaacacatttctgacattgccctatcaaaatggaggataaacattgccacagccccaatgaaagaaaaaatgtgttatcaagcttttaagtgtatggggtttaaactcttctcatgttacatcagatctttactgtaaactagccagaatatttc

SEQ ID NO: 89689 - DNA, 1459 bp, Homo sapiens
ctatagtatataggagaggagaggagggatatggccctgtatggttgtgacagttgtatagtttacatgaagtagtatatatatatatatattttaatttttgtgggtgcataggtatatttatggggtacatgagatgttttgatacaggcatgcaacgtgaaataagcacatcatggagaatggggtatccatcccctcaagcatttatcctttgagttacagacaatccagttattctctaagttattttaaaatatgcaattcagtttttactgactatggtcaccctaagtaatatattattatctgtaagttgactgagaaaagttaagagtgtatattgtcatctctagggcaaccactgtaaaagtaataaaaaaatgaatagctcaaaagccaacagaaaaattagaattcttaaaaacattcaaataattttttccccaaagcaggaaaggaggaacaaaacaagagaggatttgagtagaaagcaaaatatgatattggcagatgcaaacctaaccatatcaataattacatggaatgttaatggaccaaacactcattaaaaagcaagaattgtcagaatggataaaataagacccaactatatactgtctgcaaaggatatgctttaactataaaaatacaggttgaaagcaaatcagaaaaagaggtaccatgcaaacagtaagcataacatggctttactaatgtcacataatacagatttcaaaacaaaaccaaaggtgaatgaggatacttcataatgatcacagggacaattcaagaggaagacataacaggcacaaatgtgcatgtgccaatagcaaagcttcaatatcatgaaacaaaaagctgacagacaactccactgtgttggagacttaaccctccctcagcaactggtagaacgtctagaccagaaaaattcactgaagacatagaaaatctgaaaaagactatcaactacctcaccttgattgatattcccagaacatttcactggacagtggcagaaattcacattattttcgaatgtatataacacccttaccaagataaatcctattttgagccatagaacagatctcaataagtttaaaaaattagaattgtcaaagttaaattgatgaaatcaataaaagctagaaaaggcaaaactgagagagaaagcagatctgtggcttccttgggcccagggggacagcacagaaaatcatgtgcaaaggcacaggaaggggctttctactctgcatcttaattgtggtgtggtcacacaattgtatacaaacgacgaaatttatgaaattgaacacttaaaattagtaaattttatcttgtgatcatctcaagaagcaaaaaataggggaacagtcagtttggtcattttcatctaacaaatgccagagttcaattttaaattgtaattggagaccagaaaaacattgccaaa

SEQ ID NO: 89690 - DNA, 1031 bp, Homo sapiens
gcttgctgtcccaaggacctctcagcccaggctctctggtggaagactaagggtctcttaccgctaagctttccctgctagttggttttcctgtatttggcccttctccttctaccacccttctccttctgtccccagatttgcttctcaggatgtatgcacccacctgtccctttacattaatttgcatcatcatcatcatcaccgatatcacctataatatacaagcaaagcatctcttacaaatgtggtttgtttcttcctactgcagctcgttattttacccccactttgaccacaacattgctaggacgttggggaaacagaagtgtgtaagacaccacctctgccctcagaaaaatgtatcatctttcaggagagaaaggcacccccttgcgttgcagagctgagtagagcagggcactttacgctgcgtgtaaaatgaatggtgtagaagttaagttctggaagaaggagtggagacactgctgggaagaactagtcagggaacactgaagagaaacctggacttgaccttctctgtcttaaagggatggtaaggtttccataaagctgggatgaaagagaaatccagatggggaaatctgtgtgtgagtacaagagaaggcccaaggcaagttcagcttagtgtccaactggaacaataggactcccctatttctctctgctgtattaatgtggcttgtattatttaatggtacagtaaagtaattagtggttttcaaactctttagactgccacccacagcaaaaaatacattttacatcatgatacaattcacacatttatatacaactgaaatgaaagtttgataaaacagtacttaccatcattaaatgtgatgggctccgatattgcctattctgttttctttttttaaaattgctagtcagacccattaaattgatttaatgatccagtattatttagtaactcagagagttttaaaaataatgtgtcaaggctgggcgcagtggctcacacctgtaatcccagcactttgggagct

SEQ ID NO: 89691 - DNA, 1767 bp, Homo sapiens
tttatatttgagacagtgacatataaacaaaaatgtaactcttttcgtttttcagaattatggctaaatagagaaaataattgatctatggtgggtcccaggcaagttgactctgatttagagcaagatcctattgaggccaaggtcatgggtaaatttcttaagagggccagttaatttggttctggaacatagcaagaagttgtactcctgacctcagcttgccaactcacttcatggttgcaaaaggatagaagatggatgattcagtttaaaaacaaaacaaaaaaaaaaaaacactatcaccagtactagaaaagattacatttactaaaattacatttacccacagatggtgagtcatcctagttggtttaaatgatagcatattattaccacagatgttactagaaataaaaggctgtttatccttacaatcaagccttatctcaattattttaatcatctttttggattgagtgtttataataaaatgagtcacttaaaatctctagagtttaattcacagaataccacggtatctaaagttgattcaaaattcaagctgtgttgagtaatgtttacatgatactacatgacagcacattatagtctttggagtagtttactaatatatactgataaaataattgtcgggtgtgtaataatagtttcatacatgatattgatgtaaaagagttggtttcaaattggaaatgctgtcttaataagccctctatgaaaatgtggaataatatatactaattgatttgttgtttcttaaaatatataaattaaacacttagaaactcagaattctttactactaccttctgggttgttaagaggatcacagcgccccttactcatgaaaaattcaccagctaatgtcagctgaagccgatgagccaaaagttttagaactttcccttgcattgtagaattgaagccaactttgtagaagtagtattcttccaattttgggcaagtaaacagtaagatctggaagcccatggaagagtaattgacttccaaccaaataaaatatttttcaatcaaatattatttgacatagccttctaaaatatttgtgtaatatcctatgtgggaatgcatactatttggataaatctgtctatatagttaaacaacttggctgttcagagtaaatagtattaatatcattctaaacattctcttcttactggtattctgtgaagtctgggaaaggcaataccaggtaattattttttccggagcctcctgcttaaacagagacctaaagaacaggctctgaaatcctgagtcacttatttctcctttaggatttggaaggaaataaataaagttagtatgtcctctgggagccgacttagaagccgcagctcaaagctctcactgtctgtatccacaacagggcatgttcctggctcgcattttgcttactgtggagcaatttgaatgtcatggtgatgggtcagaattcttccagatccgtgcgtgttctcataccactaccacctcagattttattatgttgggctctcaagtcccctcttttcttcagtttagtgaattatctatgtcatttgaggattaagaattttactgtatttagtgtttgaaaactaggtagtgcttttcaaggggaattaaccagaagataacttatcttttagtgtaaataagaaagtgtggaataatatgttattgacattaaccaaacttcatttactcaagacacttgataagtcataggaattaaaa

SEQ ID NO: 89692 - DNA, 1714 bp, Homo sapiens
attgctgtgattagtaatctgtaattacccagattattttcaatgacattttaatgagtacaaaaaacatgttttgtatcattggtttttttaatctaattgattttatctttatctcattcttttaaatttattttatgaacattttataatatgtaaaacatcagtgctgtagtatattgcatgatttataaagaactagaacatatattgcaagcacatcctcatttttttacttgtagatgtgtacaacttgaaaagtttggaaacctctggtctggattctgactgatcatcaaaatcacctggagagcctgatgtataatagaaggtccctgactaggccctgggatcagaatttcacaaggcttctcagctacttctgatgatcagccatgcttgagaactactccttgtctgtatgatctactgctataaacaaaacaaaaatccagtagtgaaatatcagctttcagcatgttagaaagaaaaaaaaaattcagtaagcctaaagcatatgtaacatctatctactttttaattaccatttttttattttttagaatgtgtttttaacagatatgctcctactttttaaatattttttggtcaaagaagataatatgcataggtgttagattgacccatatgaaatttctaacattaaaccatttttttaccaacaaaattggcatttcatatggttaaccaattcttttctcagaaaaactatgctcagtttacaacctgtgaagatatttacacaaaaggaaagcatttattttgtgtattcattgttgcatattttaaaaataggattttaatctattacaatatgttttgctatctgtgttgtgtcttttttcagatatttattcactatattataaaaatcaatttttggacctgctgtgtctaaactctgtgaacaaaatattaatcccagaaactcaaaaagaacttaaaatccgacatggggaagaacaaggcccacaggcacgtagcgaaaagcccacttgtggacaaaataagcagcttgcaaagtagctggtggtgccagcaaactgcttgagaaagaaatggtttatctggaatcacaagcagtgtcaccagccatgagctgcctttgttctcactcattgccacagaattgtgaggcacatgcttgttaatggctgtggcgccagctaagtctctttaccttccagaacaaatgcatttagtggcatttatgtaatatagtgtactttccactagaatggataagacaaaagttattgtactcttaaacaattagcatttaggagagtaattctgaaagaaaatgcataaaaacgtttgtgaaggattgtttgtaacttaatatattttacctataaaatagaagacataaaaggtaatgctcaactttacaaaaacacaataattttttatatttttgcatgtctgactataaacacctaaatgttattctcttgaatttaaaagggatctgcagtcttcttgatttatgaacattgtggttttaaaaataatttgctgaaaaatgatgttttgttttcattttttagtgacaaatatttagggaccgtgtatttccagaatgctactgtgttaatatcttgctgcatactttgggctgtgctataacatgaagcaaaagtaattataggttgctatttgttatccctggtgatcatgataagggaaatgt

SEQ ID NO: 89693 - DNA, 1037 bp, Homo sapiens
tggaggagacgaatctactgttatttttagtgggcagggagttgagagttgattatttttggttaagacatttagcagcactcagtatctcagaagacagaagtggctaaccttggagcacttttaacgtctgcagaaggaattagatagatgtttttcaagtgcctacatttttattacacactggtgcctatctcgcccatctaaaacataaggtgatatgatcaggctgaattaagcagcaagacaaggtagaatataacaccaaacaagagagaacataaaataaattgtctggttacctaagaaatggctgaatatgagtagaggacagatgcaatgaactataaccattgtatagtaaggtacaggcaagaaatcttgttatctctggacattagatcttgtgtatttccagacctgaccatccttatcaagctctaaactagcactttaggctactgacttgacagtcccacaattgttaaacaaggttaaatcataattcttgattttctgcaaaaaccaatgcaatataaaatattttcttctatagtctttcttatcccaatatatgacatcaatatctacccagttgcttaaggaaaaaaaaaagagtaagaaaggagaataatgagagctcgttagaataccggtaggagattgcagatttaaagaatgtaatcaggtgcgtttgagccaaaacttgaagcaggtagagagtgagctatgcagctatctggggacagagcactctaggcacagagaatagtgggtgggacggagttatggggaactggctgggaaggtggagtgaacattctgtgataatgaggggcagatggttacagggtatgcatatttgtcaaaactggttgaactgtaccattaaaatgagtatgtttattttattgtatgaaattgtacctcagtaaatttactactaaaaaataaattccctacagtggacttctgcttaggatatagaaagctaggaagagttctaccctaacaaagagaaaaagaggtaaactaca

SEQ ID NO: 89694 - DNA, 1010 bp, Homo sapiens
gaaattaatattaaaactcttctgtcagcttaatttcattggctttcgttaagctgcttcaactatatacctaacggttgcagctatagcaaaatattttgccatggacactcttgtcactttcctaaacttatatcgacatcatttaggtatcattaacagaatcggggaatttgggtatagttgccatcagtgcaatcaagataaagcagaaacaccatttcacacaaggatgtttattttaagaatcaaactttgacattttaagggaaatctttatgaaccaggactccatgtagcttcactgatatttaggatgtgtgtgagagcatccttagcaacttctcgattatttcatctctggccacatgtccttcttgttaactctgagttttaattaagaagtattggtgttaataagatctctttaaaattgagaagtgtcagtgttaataagattatgaaacaaagttttgcctaaggaacacctatcacgagttaactccgtcttcttttatgggatagattatttttgacaacatggtaaattgtggtttatagtctaagaattcctgttagttttatgctttgatagaagatgataatgcaaaagtaccagttattaaggaaagtaaagagtccatgggggctgaggggtatctcatgggagaatgccatccctgctgtcatctcagctctcaaagaaactatctggaactcaagcagggcctttatccattcctcttaacagttattcctgcaagcagtcttaaggattataacattcagtagaaatcgttctctgtatgaaggcaactttataggctagctgtttacttacttctgaaaagctttttctaaccatgttattcatgaatttgtccaaattcatttctatttcttcccagtagtatttttggaggtaaaatactgagtttaagactcattatgcttgtgggtaaaggtttcacaaaactctttccccttttacatgagaaattggccttggg

SEQ ID NO: 89695 - DNA, 1034 bp, Homo sapiens
tcatgtaaagggaactattagaacaaatatataaaccttcctaaataccaaaaaaaaaggtaaaaactaaaatataaaaagaaaacaagtaaaatagaccacatattgaaagactacttgcataaaagacttgaatacatagacatatatataaggacattaaaaacaaacagataaatcttctacctacagctccatcagtaagaatttgttgaataagctttggtacattcacacaagaaagtattataccatgcagctataaaaatgaatgaaaacatctccatatgaagctctatatgccaccacataggcatcctcgggacaggttgatactcatttgtatctgtttatattttggaaacaaataggggaaggacaaactatagaaaaaattgttaaacagttacctataaagaaagtgaagaaattgggtaaaagtgaaagaggaatgaaactcgacttctttgaatattttttgttctttgatgtaacttaagaactccataaatgttttacatgattatgaaacaaaagtttaaaggagcagtgtctaaaatttaaataaattgaaatcagtgaacctaaatatatatccatttggtggcataactgaacatctaagtgactattcctagtaggctataccttaaagacacaattgaaaaaatagtttttactaatgacatttgtatagaaacctttatattgttacttcaagacgggtgtaatgtgagtttaataaaacacattagtaattgtgaaatattctaattttgttttcccattggggacctatatttgtatattatatatataaattatatatatatatatatatatatatatgaatttttttgagacgggatcttgcactgttgcccaggctggagctcagtgtgtgatcatagttcactgcagccttgaacccctgagctcaagcaatactcccgcctcagcctttcgagtagctgggactataggcacgcatcaccacgctcaactaagttttttattttttgtaaatgcagcag

SEQ ID NO: 89696 - DNA, 1027 bp, Homo sapiens
caggataacattttctggatccctggatcctctcacggaaggccaactgagcatcttgttggactgtgatgcaagttagcaataaaatttttactgcattttttaaatgggaaaaatcttaatagacatttttccaaagaagatataaaaagtggccaattagcacatcaaaatatactcaacatcattggctattaaggaaatgcagatcaaaaccatgagataccacttcacacatctattttgatggccagaataaaaaggcagataataacaagtgttggtgaagatgtggagaaattagaatcctcatgtactgctcatgggaatgttatatggtgcagccattttagttcatcagtaattaaacacagagttgtcacatgatagagaaatttcatttctgggtttacatacaaatgaattgaaaacatatgtctacctgaaaatgcacatgttcatagaaccattatttgcaatagccaaaaatggaaacaactgaagtgtccatcagaagacaaatgaataaataaaatgtggtgtatccataccatgtgagataccatgtgagatactactagcccttctcagtgcatcatacgataaaaaggaattaaatgctgatacattcttaatcatggatgaaccttgaaaacattatgctaagtgaaaggagccagtaacaaggccacttattgtttgatctcatgtatatggaatgtccagaataggcaaatcttatagaggtagatagtagatgccttagggctggagtgtgaagcagaatgaggtgtgactactaatgggcacagagtttattttgggaggtgatgaaatgtttcaaaattaggctgtggtgatatttgcacaactctgtgaatataccaaaaaccattcaatcatactttagattggtgaagtatatggtatatgaattgtatcttgatgaagccattgaaaaaaaagtagtgctttgagcacggggggaaaaagagagctatttgttgggtgtgtgtactagtagata

SEQ ID NO: 89697 - DNA, 1123 bp, Homo sapiens
cagcctctggtaaccatccttcttgttaagtgaaacaagccaggcacaaacaaacaaacatcacacgttcttacttatttatgggagctaaaaattaatacaactgaactcatgaagacagagagtagaataatggtattagttcttgatggaaatgtcccttaaagatttttctggaagatttaaaggctggggtaggtaatttaacacttatataacatgggaacagttatcttagtaggtatgctgtcatatccaagaagtttgaaaagctgaaatttgttactcttaaaacagctcctttcacatgttgtcacttttgacaattgcttttgggggtcaacttttcatgcatttattctagtgatgataacagcaatcagaatattattaaaacttttgttttacattactttaccatggtataagaggtaaaaatgaagaaggcatagtacctacttacaggatagttaaaacagatacacaactaaaatacaattcaacatataaccaattttataaaagctacagaaccaaacttgtgggttgtcagaagagaaagtgagagagaaaaacttttaggaagaaggggaggtactgtggcagtcttcattgaaaggagttgaaatttgagctgggtaatatttttcaaaggagagattcaggcaggaaaacattccaggtgttatgcttcttcaaagagggcatgaaagtgaaaaatggtcttgtgtcattgtcactgagttgtttgtatccagcacagtgtctggtgtataataggtgttcagtaattatttgtcacccctcactcattctatacacaagaattaactcaaaatggaccatagacctaaatgtcagagccaacattatacaacttttagaataaaatatgattaaaccttcatgactttgggttaggcaaagacttcttaggtgatgccaaaaactcaagtgacaaaagaaaaatagataaattagacttcatcaaaatttaaaactttgtgtttcaaaggatgcaattaagaaagcaaaaagacaatctacagaatgggagaggatatttgcaaataatccatctgataagggactagtatctataatatgtgaagagatcaataat

SEQ ID NO: 89698 - DNA, 1070 bp, Homo sapiens
aatatatctagtaactgtttagaaaccctatcggggccagggtggcaatggggagttgggtttaccaaaaacttgaatttgggtcatctgcaaatgttttgttatttataagcaattattatttgatttatgtagtattcctgtgccatttactccacaaaaatgtgttgaatatgtatagttctgaagttctgatgttgccttagtagcattcttctttaatcagagatctataaaattaatatttgaggaaataggtcatatttactggtatttgccaaccatggaggtaattatgccatgataggacaatttgaatttgtaacagtcctgtgaattctgctactgaagtttacagattttagagtcactgattgaatattttcttcttgtataaaattttcactaagtaaaaatgaatttcttaaagcatctgcttctagaaatagtgggaaaattccatttggaatctgtcattgacaatccttttttttttttttcttaacatttatgtgtatgagactttgtaaatcacaacattttccaaatgggtttatgaacttgaattttgctgccttttctcagatttaattgaagagaatggttagcactgattcagtaggagagatgactgtgaatcactcctgatagagacctgaaaggtgattaaacaaacagcagtaaccttaaaaataagcaccgttgtatgttctttcatgatacttcaatgttttgttggtcattcccattgctcaaaacactgttgtataagtgatttacacatttgaaaccattttctcttttacattagtcattaactgggaaaatgaacatgttccttccttttctttcacagaagttttacttaagtacctttgccagtaaccacataaaattctgtgtcctggactaatgctttaaaccacttgttggtaaaagatgaaaaaggaaaatgagaaggtcttaatgcagcagtggattcctagatgtgtactttttttttttttttttgagacagagtctcacgacgtgtactttctacaccaagactgaatgtactgtattagcag

SEQ ID NO: 89699 - DNA, 1075 bp, Homo sapiens
tggggaggatgtttaaatcataagaattctaaaaaattttttaatgacagtttaaaattatgtttcaaacacaggagcatttttcataagattactatagggaaaagaatagtggcaaaaacctgagatgtagactatgactaactcatagtgcaatctactacaagtcacttgagcttgtgtattttctcatcttctgaaaaagtgtgttggacaagattatttctctactgtcatacagagtctatggttctgtattatagctttatttctcaaaaataatgattcaaaatgttttataagatttctgcttctggccatgacagattaactgatactggactaactctcctgctatcactaactgaaaactaaaaaaaaaaaatgacacaactgttttcagatgtaacacaacatgtgaagtaaaggattataatccctaacaaaagggagatgaagatgagccccataatggtgagcttctgtctcgaggaacattgcagactatggtccaggaaggtgggacccaaagagtacacagcagtgttgtgctgagctaaggcagagagaggaatttaacactgctgtggcaactgcattttgcaaggtggaatactagagaggagagaatttccagaaagcaggtccagaaatccaagtgtcttcttgaatgtttgtataaatgttaagctgtaatgtgcagagcaagactccacaaggtgtggcagtaaacaactacccaggagctgtaaattaaacagagattttggggaccataacagactgagggatattggagctccaaccagccagaagataaaaatcaatgaacatgaacatttagttgaatgcttagaaaggccatgctttaggagtcagactattctattctagagtgcaaattactttattctaagaggcaccctaatagagcaaaacaaacaatcttcaaagaatacagttgatttacattaaatataaatgcactaaacactccagttaaatgtcagagattttcagactggataaaaaagcgagacccaaccatgtgcagtttaaaagagacacatttgta

SEQ ID NO: 89700 - DNA, 1022 bp, Homo sapiens
attcctttctgcataacatcaaaaatgaggttattttatctttcagttgaaaaatcattggtatccataaatattatatgatgctagctgtagtgccccaggtatcaagtttatcatgttaaattgtgcaaggttaaaatttacaatcatttatcaattttctttaagttccttaatgtggagtttaccataggctactttctcatttctagaatattgacatttgttgcctgtactgtccatataggttactgataaataattgagaaaggtgttcactttaacattgttttcctatttaaattctttatttaatatgattcccatttatgaaaataacaactaatcactaccagagaacgaggatgggcactgacatctatagttttctggtttcaaaaggaacacagaaattaaacttcattttgaataaaagctgtccatgatttagataataatttatatctcttatcaagaaaaaagtcttccttacaaagatagacttgtatattctagcttaataaatatttactttttgactgaacagattagattctttaatctgggactgtttgtttctatctaactagcattgttatcagactagagttaggtttttccatacaacagatcacttgacaaataattaaatacatctattatacaaaagtaaactggaattaaatactaacatttatagtctaggtcatgtaatttcctctaccaaaagtaaggaaaatattaaccctctccactttagtataaactttaaagaagttcaacagattcatgctttgaataaagtatcttttgctttctttttttgccttaagtggaaatgatggtgctggtagtaagagattattttactgttgctatctctgctgattaagaatgaacaaaatatcaaagcatttacatacagaggaagcagtagatacttcgtgttaaacagaccttgggcaatttactttccctcagctcccttctctgtaaaatagggatagtaatatctaccttat

SEQ ID NO: 89701 - DNA, 1626 bp, Homo sapiens
attgacacataatcatccaaactacatagtttacattagggttcactcttggtgttgtatattctttggtttttgacaaatgtatgtatccaccattatagtagtaatacagtagcttcactgtcctaaaaatcctctatgctttgtatattcatccctctctcccctctaactcctggcaacccctaatctttttgctgtctccatagtttttccttttccagaatgtcatataaatggaatcacacaatatgtagcctttgcagattggtggctttcacttagtaatttaggttcctccatgtcttttcatgacttcatagctcatttttttagccctaaataataatccatcgtctagatgtaccaccgtttatttatttattcatctactaaagaataccttggttgctttcaagtttgggcagttatgaataaagctgccataaacacctgtgtgcagatttttgtgtggatataagttttcaactcttttggataaattctaaagagcacaatttctggattgtatggtaagagtatatttagttttataagaaactgccgaactgcattccaaagtagctttaccattgtgcatttccaccagcagtgaatgagagttcctgttgctccacatcctcgcctgcatttggtgtaatccatgctctggatttgggccattcaaatagtctgtggtggtgtctcattgtttgaatttgcattttcctagtgatgtatgatgttaaacatctcttcatatgcttatttgccatctgtatatcttctctgatgaagtgtctgtttagatcttttgcccattttttattctgattgttcattttcttttttaactttttattctgacagtttttttttttcttgggcaccatctagtgaagatacacagaaagctttgaggacataaaaaatgatttattttttcaaaggaaaactcctctctttctgtttctctccttttacctttgtctttcagttatacctgccgccacttgcggagatatgtttatgtgttggacaaactgtatttcccccactctcactgttctacgcttcagcattgcttctcgaccctcagtgacaatggagaggaactcttgtctttaacttgctctcacattctcagatcctatgcttccaggttattaacctctgctgtccatttactgcatgctgcatgttgtatatgactgacaattgcatgttttaataagacatgtgtcaattaaattattaaagagaacatttatatttgaaatggtactaaataatttttttaaaataatagctggattttgtttccttacaaatgtcttcttaagtaatttatattatgtttcacgggagagaggaaagctttcaaccacagagttgtctatataaacttgccagaactattctataccgcattccatttgggaatcttttgatttatagtagttggagtgctctgatgttttatatgaaatagactctacagttactatgacctttgagttctccttcatgcaagcacacctgagagctagctgtaggatttcacctatgttccgatagaggtgcattcagttgagcaggttgattttataggaaggcagaaattat

SEQ ID NO: 89702 - DNA, 1816 bp, Homo sapiens
ctcacctactgctatgtagcccagttcctaacaggcttcagaatgggggatgggaaccctggttctatgagagcagaatccatgtatctttttgtaccactgaatcccaagcatttcgtgttggtacatttttctgtaagggaatccgtgtcttttgttggcttttaaaatggccacctaaaaaaatttaggaactactataagagtaatgttgtcaaaatcaaataccactgttgagattttgaatctgtgaaggataattgcattcttaatattttgtcttcccttccaaaatcatgctagttagtatttcttcatttattcaagatttcttttatgccaaatagtaaattttggtaattttctttatataggccataaacatgtattattaatttaatttcttggtattttttaatctactaatgggtctactaatgagctttctcaaaggaaggagaggagggaagaagaagggacattggaaaaggatatacagaatatttttatcagtctaggtaaaggttaacttgcctctggtaatctcatttttttaagttctttaagcatatagataattaagaaaataaattggctaggcactgtggctcgtgcctgtaatcccatcactttgggaggctgaagtgggtggattgcctgaggtcaggatttcaagaccagcttgaccaatatggggaaaccccatctctactaaaaatacaaaagttagctgggcatggtggcatgcgcctgtagtcccagctattcaggaggctgagacaggagaattgcttgaacccggtagaattgcttgaacccgggaggcggaggttgcagtgagccgagatcatgccattgcactccagtctaggcaacagggcaaaactccatctccaaaaaaaaaaaaaaaaagttagaaaaagttcctatggaaatgtgttataattttattattaaagtactgaaaaatacattattagaaaacttcaccttggaatcttttttaagcattactcttttgcttgtggtttttgtcatcttttacagacttgaatgttgttctaggacagaatattgttgtactttattttagtgaagcataaccatatcaaataacatttcagaactatacattgcacaatcttggacattttcttgtaagaaggcactaaggaaattttatttttgtgaaagtaattcttaagtaacagtgactgttttttatgggctagctccagaccacatttgcctccttcccatgatcttgtttttctgatgtcccaagctgtaagtatagaggtcagaatgacattttagggctctaggtttgaatctcataatcttaaaatggatattattcagtttatcaaaaagatcagttctattttttttttcagattaaaaataaattaggccggacatggtggcttatttctgtaatctcaacactttggaaggccagggtggatggatcacttgagcccaagaatttaagaccagactgggcaatatagtgagaccctgcctctagtaaaaattttaaaaattagctgagtgtggtggcacacacttgtggttccagctatttgggaggctgaggtaagaggatcacttgcctaggtagtttaggctgcagtgagctatgattgtggcactgtactccagcctgggtgacagaatgagactgtctcaaaaaaaaaaaattagttttaccaaaaatagtgcaaataattttcatttacctttaactcacattcccaaatgttaaaattttaccacatttgctttactattgtgtttgtctcttttttttgaa

SEQ ID NO: 89703 - DNA, 1456 bp, Homo sapiens
cattcagattatgttttaatcaatggtatttttaatgttactaatgaaaagaattgttggtcaccagtgacctccatattgccaaatccagtggacattttctgtctcgtttgtcctttcagttgtatttgacactggtaaccactccttcatcaagataacctcttcttggtttcctcatcttctttatggtttttttggccactcttcaaaattctgtaaaagtttatctagatttgaagtgatcttgtgatactttaaatgttggcatttctcaaagtcaccctgtcttagttcgggttgctataacaaaatagcatatactgggtagcttataaacaacagacatttacttcccacagatctggaatctgggaagtcctagatcaaggcgccgactgatttggtgtctagtgaggacctgcttactgacccaaagagggcagttttttctcttgtcttcccatggtggagagtggaagcaagctctctcggactcttgtaaggacactaatcccatacatgaaggctgtaccctcatgacctcacctaatcctaatgccttcccgaagaccccacctcctaataccatcaccttgggggctaggatttcaacatatacatttgtgggggacacaaacattcagactgtagcaaccccttctcttttctctctctactcttttcctaggtgattgtagccactcccatccttacaccgatgactcacaaacatacatttagctagccctatcctctggcttcagacctgcatgtccaatcagatgactaatgtcatcttttgggtttatcagagacatctcaaactcagcatgtcgaaaatggaaatcttgccctttcccagagtcttttgatcctcttcctctgttgccgcctcattgaatgacaccaccatttatgcatgccagaaacctgagagtcaattttgacactccctgtcacctgccatattcaattcattaccaagtcttgtcagcaaccacccctcaaatccattcattctcctttatcatcgccttagtgcctactctcctgcagtaactctttaacaggtctgatgtcaactcttgcttcatcagtctccaaccagccaatcatttcaaaatgcagatctcatcctgtgactcctctgctatatactcttcagatacttcccattgttcctagaatgaaggcataattccttggtgattttacctacctctgttcttccccaaggtcagctccttacacattgtcctttacttttgcataggagacatgtttccttccagtctcagtcctatgtctgcctttttcctttgcttgtaattattttcctgcttatctttagtcatcttgcagatcttggctgaatcgttacttttatgaggaaactttcccttacctatctattcaggcaaaatctcatctatttcaagtttcatctgtagta

SEQ ID NO: 89704 - DNA, 1035 bp, Homo sapiens
tagatccactccactttatttgacaaaggaaacatgctgatcctaataaccaaaaggaatgtggcaactcgttcatgtatttcagtatctttcacataggacagtgtaactgtgacctgcattttcacttgggaaagagtcctgggaaagacctaagagaacttaagctgttcagcagtggctgcatacctttggaggcaccatcagagagatggatggaaaattgggtaaagggaggtctacccccaaatccaagattctgtgattctgataccttttactttaaagcaatcattttcaggttctgtgttttgttctcgtactctagatctcgtgctttctttgctggtgtcaacatgagcagccaccagctgctctgggatacccactctactcctcccagagcagctcccctctgctttgatctgtttacacgttgccatttcacatcagctttcattggaagaaagggttccattgctttaaatatatgcatacataagcgcatacatatatgaataaataagttgaaaattagaaaaccctttttaaaggatggagtaatgaggttgatcttaaggttctttgaacttctcaaaaggcagtgtagtagtctaagctaatatatctatctaaaagatgaatattgtgcattagaaaaatagtattcttttagtgacattcatgaagtcattttttaaataaataatggacccatttgattatttaagctctatgtgcattttaaagtatattcatcgtgtagaaatactcttttttgccttttacttatttctacatataggttattgagtttttctgcatggttctgtatctcttttgttctctgccctctgcagaattttatctgatagtagatagaatgtggattcttaaggagaaaatctgttttattaattataaggcgtatgtctcagactaccaaaccaagtatactgagtgttttgaattaaatatttagtgcttcattgactatttcctctgacttccattaagaccttgagaaataactct

SEQ ID NO: 89705 - DNA, 1020 bp, Homo sapiens
cttcactgacatgctatttcttacctatcagattagaaaaatccattttccaggttatgtggaaacagaccgtctcaaaattttctggttgaagtgtaaattggtacaactcctatgaagaatgtggtaatatccatccaaatttcaaataacatcaccctttgacccagcaatcctacgtgcatttgtgcaaaatgacaatgtactagtttattttgggagtattttttataatagcaaaagattaggaacaactcaaatatccaccaacagagacctacttaaatatggtacattgatctagtagtgtgcagctgtaaaaaaaaaaaaagagtaaggtactgatggaaggctctttcagatatattacgtgaaaaatacaagatatgaaataatacatgtagtatgtgattagtgcaggggaaaataatatttgtttgcatttatctttgtttacatgcagaaactctggaaggacacacaagaaactgataaaagtggttatggggtgggaggagagctagccttttcactgtgtatgtttttcctctcatctcttaccatgtaagcaccaaaggggcagtgatctttatttttttcactaatggtatccttataacaatacatggcacataaatatttttagaataaatgattcaaaaataactcaaagaacaaaagtaacataagctgattacaaaaaatagagacaaacttgaagccaactgttaatataatgtctgcttccaagtaatccttaaattgatgtcttgttgtataacactctagatgattttctacttgcgtatatgcaatttaaaaaaaaagttttataggcattttccataatataatctatgttgaaagatatatggcctcaaaatatcattgaatttatccagtgaatattgctaatgccatatattacgacatttaagttgtttatataaatgcatgtctagacacatacaaacagctctggaaagaaaatattcactcatgcatcagagacagtgtatg

SEQ ID NO: 89706 - DNA, 2483 bp, Homo sapiens
ttctgtttaataggtgaggaaactgagactcagactgaaacttagccaaggtcatgtagctaatagtgtggagctgaaattgaaatccaagtttgaccctagcgtagaaatgttctttttggcagacctgacattgataaagctgaaaaggataggcagacatcatctaccttatacctgcactcagattctcagttgtgagtgagtagaatgtccactatataaagtttctgtgcagtcttggatcacttctgtgcattgattctcgaagtgtgttctgtgggccacagagagtccatggagtctaagccttttataataagacatcatttgccatttccactgtgctgacatttgcatcaagggtacaatagcaaagttggggtaaaactgctgagaccttagcataaatcaagtggtgcctaactgtactagtactcactatattttccacaaccacacacacatttgtggtaaaataaaaaccatcttcactgaaaaatgtccttggcgaaatagtaaaaatgattagttgttataaatcttgacccttgagtacatctttttgatattttctgttgtaaaactagaagctcacataatgcacttctactccatactgggttccaatgattgtcttgaggaaaagcaggtgtgtgatagagttgtgagctgaactagccacttttctgatggaatagcatttttacacgaaagaacatgagacagtcttggcagagaggaaactgccagtgttggttgccaataaaaaaaattttcaagtcaaaattaaaatttcgaaaaacttatatttggcatcatgagtttgacaacttcctaataatttagacttttgttataacatcaatgatgttagtaaatatggattttaaaaactattatttgatgaaatgtgtcaacatttggaagatctgcataattcagtgaaccaatatctctcaaatgactaaaggggctttttcattaactgtattaatgttaacatgtaatgtgtttattattaaatttaaatgaattagtaaatatttaatattttctcagttttaatatctgtcagtataactgacatatgaaaaaattctttggggttctcattaatatttttaagagttgaaaggggccctgagaaaagtataagaaccagcactctaatgccctttcaggatgagataggtagagtggatgtgagcatgtctgtattacagagttcagtgtatatacttttaaatatctactatttctgaattataccttccttccatcagtataatcaatatttaactatatttgtattattcatgcttccatttaataaatatttattgagaacatagttatcagaggttgaaagagaaggggtatacagaatatataaatcatgtttattctctgtaagagctcatggtctctattctaaaaagtcataaaaaaacaatgttactgtactaaattgccttttaagtttattgcttatcttgcctgggtgtggttatgaaataaatttgttgctgttgtctatttctgtgtaacaaactaccccaaaacttagtggcttaaaacaacaatttgtaatgacctccacagggctttgggttgattgcttagctaactgattctctacttgtggtctcttgtttgccatcgtagagcagctgggctgggtgtccagtgtgctcccatctcaaggctggcagttgatgctagctgggagatctgttgaggtgttgcctggaacacctcagttcttcttcttgtgaccttgctatgaagcttggcctcctcaccgcaacgcaggcaggttcccaagaggggacatcccaagagtggcagaaactataaggtttcttatggcctagctcagctatccctgaatgttacattttattggtcaaaagcaggtcacgagaccagcccagattcaagaggaaagaaccacagaagggcataagtgctgggagatgtggttcatttgtggccatctttggatgctagctgccacaagactgctaggagactgttgaattaagttttataaattattgcttattgtagctgggaaaatgaatactttcattcttaagatcaatatccaggcttctgttcaaaatagaaaatttaagctgaatccattcaaatgctattctttgcatttttttcctttaatttacatttgacattaacattctctccctgactttttcccatagtttcttctgatgagcaggaaatgtccactatctagtacaggtgtcttcacttatagtcaaaatggaagaggagcaagtgcacagagttcctgtaagatgcatgttcatgtggctgcacttgctggccactgagttgttgatattgaccaaatcttgtctttagtctgagaaaatgtagggctgtgttatcttgtggcagtgtggcaggctggatgttcactctgacaataacagctcaagttctatacaagagag

SEQ ID NO: 89707 - DNA, 1065 bp, Homo sapiens
tttttaaaagatagaattagcttgctcttgcccaatgcccaggcaataaaaaggttccagtttcttcattcctttggtctttgctgatccttgtttgatcttggcatagcagtaaccaggaaaggaaggaggaatgtttgtcttgaaaatctggcttcctgtatttcctacagccagtggtactttgaaggcagctaagtttttcagggaaatctggcttggtttgcttttttagtttagtcctttcttaaggagttacattgagaacatttagacagctcctctctgaaaatttataagtttccagtagaaaatggttacctattcaaaaaattgctagtattgtacaacagggtgtcttggcagacttgatgggacacaagaaaacttcataattggtttaatttcagtttagactgctggcacattcaaaatgtcagctttaaagaaacatgtcatatgtttatcagattgtttatttcttataagtaaagacctttgtggacaaaattgccacacagcaaattaaactttaaaataacttccatagagctttattgaatgtcaccatcatgttacagaggtaacttggtgtggttcaactttgtcctcttagccatgaattattaagcctccattcctgtttatttttatgaaggttgtaagatttttacctactttcaagctaacaagtttacctgctacagttttgtagattctggtaggacacccaagactcctgggtcaaggacaaaggacagtttgttattgtcctttttttatattttttatcataaattattactcgcagcagtagtaggagccagaatattcatttcttgtgtggttcccatacccacagggcaacatgacaagggccaggtgacacctgtaagtgcagtgggttgcaatacaggagcggaacccagagcttgggaatccccagtcttttatgatagccttcaagcacacctgcccaacctttgctttgaagggagacatctttaatgtatttgatagtaaactactctctgctctagagagagacaccatctctgtcttcca

SEQ ID NO: 89708 - DNA, 1032 bp, Homo sapiens
aatcacaaggtcgcttttgccatgtaaggtaacattcataagtccaggggattaggacatggacatttttgagggagccattattctgtctgccagaaacccttgtctcttccccacccattgccaaagacatgactttttttttttttttttttttgagatggagtctcgctctgtcacccaggatggagtgccgtggtgcgatctcagctcactgcaagctccacctcctgggttcacgtcattctcctgcctcagcctcccgagtagctgggactacaggtgcccgccaccacacccggctaatttttttttgtatttttagtagagatggggtttcaccctgtaaagacatgactttgaaggataggaaagctaactaaccagtcataagtgaatatcattgcagggctttttagcatatgggggtacttttttgacttcctgtaggatgttcagtgttgtccaagtaggtctcaaatagaaccccagtgaagtcatattgtttcctttaattcttacttttggggcaatgcagggtttctcttcttcttttttttttttttttgagacagagtctcactctgtcacccaggctggagtgcagtggtgtgatcttggctcgctgcaacctccacctcctgggttcaagtgattctcctgcctcagcctcctgggtaactggaattacaggcacacgccaccacgcctggctaatttttgtatttttagtagagacagggtttcaccatgttggtcaggttggtctcaaactcctaacctcatgatccgcccaccttgcctcccaaagtgctgggattacaggcatgagccactgcgcccaggcttttcttgtttttttaaagacagggtttcactctgtcaaccaggctggagtgcagtggagcaaccacagctcactgaaagctcaaactcctgggctcaagggatcctcctgcctcagtctgggcatgtggttttgaccattcagttttgtttagcagtcattggtggtgataacaactccgtatc

SEQ ID NO: 89709 - DNA, 1024 bp, Homo sapiens
caaagtcatcgtttatcaaaaattgtggacatggagtaattcttttgtctgtaaagcaatcattttttacttaaacttttcttccccattacagatactaaaaaatattacttggtattcagaacgagttttaactgaaatctccttggggagtctcctgatcctggtggtaataagaaccattcaatacaacatgactaggacacgagtaagtattccagctgctattctatcttttttgcatacagtacaattaagacgatagtttaaagcaatcccaatttttaggatgctaaaattctcgtgacatatggtagaaaataccggtcactgtatagtcactgtattacatgatcctaatgtaacataaggtcttaatatttaatggcttgtatgattggagatattttacatgaaatagaaaacaagcaatgcaaaacatttagataaaagctattgtatgtctttatttggccagtaacactgatttgccttttttaatagcagcaaataacaaagtacaagaggatatgagcacaagaaaatatgaattaaaatgaaaaagaaaggtagaagagagaatattttaaagagtaaaagaaaaatttctgctggattctcttcacagtacctgggagcaaatttcagttctggttaatagaaatgtattattaaagagaagcagtgtacagaattcatagctaagagaaatggcatttttttttttttgagctacgattgtgccactgcccttcagcctaggctgcacaggagtgcagtggcacaatcatagctcactgtaacctccaacccctgggcttaagtgatcctcttgcctcagtctcctgagcagctaggaccacaggcatgtgccactacacctgactaatttttttttttttttaaatagccaaagtctcgctatgttgcccaggctggtcttgaattggttttgaactcttgtcctgaagtgatcctcccactttggcctcccaaagtgttgggattacaggcgtgagcccct

SEQ ID NO: 89710 - DNA, 1176 bp, Homo sapiens
ttcacttttttacaaaatttaggttacctaatcataaaaatctctatttctctattttgttgtaaatacagtcaatctttgtccagtttttatagcaaggattttctggccttgtgaaatgtatagacatgattcttgttctacactttggaactgctcattaccatattgtattatattacacagaatactttacagaaatacattcatctcattggtggcagcacatcctaacagggtgttttcctccccagcaggactctggactgtcttcacactaggtggtgtgggcagcaaagcggctgcctctccagagctttcttcccctctggccaaccagagtctcctgcttctgctggtgttggccaatctgacagatgcctcagatgcgccaaacccctacagacaagccattatgtccttcaagaacacacaaggtttgtggtattttttctctaatattctttgtaatggggagagtattgcttgttctatattgtttattgtcttatagttttggagatgagtgtccattgtatgttttcatattggtcaaacatgagaaaaactttagcttttcctgtcaatattatcaggaaggtcaagcatcctttatatctgatcctttatatctgtttaaatccatatttctttcatggacaaccaaccagcatgtgtttaatttgggtcagtctgtactacctgttagggataggaattaacctggaaaacccaaatgctaggttgttttaaattttcagttaaagtctgtgttctagagttttatagaactaaaaattaggtctcaaaaacaaaaaaaaaagattagaacacaaatcagaaaacctttttctgtagagggtagtggctttgtggagtcacatggtctctcctgcagtctgttagccttgccgtttttccatcaaagcagccataggtactatgtaaacaagttagatggctgtgctccagtaaatctttacttccagacaaggggcaggctgcccatgagctgtgtaacttggtattaataactcctaaagtagaaggtgagcatatggcttcatgttgaaccagtattatctcttctcaaaaggttacattctaaaagcaagattcctgtagtatagtcaagtgctgctcaacagcagggctgtgttccattaggcaattttg

SEQ ID NO: 89711 - DNA, 1049 bp, Homo sapiens
gtatgtcaaaatatatattattgttgattgtttctgataaaatctcatacataattcaggcttcaatcttgatttttatatggagaaagaatttcatacaaatatgtatatatttatgtatttatatatttatatatatatttatatatatatatatttatatatatagctttttttttttttctcgagacggagtctcactctatcaccaggctggagtgcagtggcacgatctcggctcactgcaagctccatctcccgggtttatgccattctcctgcttcagcctcccgagtagctgggactacaggtgcctgccaccacgcccagctaattttttgtattttcagtagagacggggtttcaccgtgttagccaggatggtgttgatctcctgacctcatgacctgccctcctcagcctcccaaagtgctgggattacaggcgtgagccaccgtgtccggaccatatgaatatttttatataaaatgtaaaaaatcatctgtaaaaatgcaaaatttaaataattctcattgttttcctatttaatgtaatacaaaagattgtgctagatcctaggagtacaaaggaatcaaaccatggtgaaggagggaaggccctctctcagggaacccacagtttagcaggaaagatgggtatgcatgtcagggttgtttagtagtggagggtggacagggtgttgcaaggttaaagtctgtatatcgtaaaggaactgttttaggaacagggcttgttttgtttgaagaaggagtctctggtggtggtatacactatcagatgcttaaagacttgtctgttttcctaaagggtaatatttccaaaactttagccacatccatgccactgccacgattttgtcttatatgagtacaacttgaattccagtttacttagttcactttagaatgacttactttttcaaaattgtaagcttattatttactttattcttgtactatgtgggaaagtccttgatcttctgagattgatgtgctagttatatatgtctaatatacataactattaaa

SEQ ID NO: 89712 - DNA, 1925 bp, Homo sapiens
ctgtcaggcttgttggaccttcttattctattcttcatgtatcttggtctcctagaatttccatttctcttccatctgcattttgggtaatttccttggatttatctttcagtccactaatcttcttttcagctgtatctgatctactatgaaatactttcagtgacattttctaatgtgtgagttataatgtgtgtgcaatgaagtacacatcttaattgtacaacttgttgcagatctaagtaagtgattaagtaaggtgaggacttagaatggactgttggtaaatgaatggagctggtacaatggagcttggtggttactttgtcatgaatcatttatttggaatggtgtttaggaagctaattaggatgggtttaagggagaaaggaagtcagagtataggcagaaaaataaggcaacaaatggaagggtgcatggattctagggaggttttttatttttgtttttgatcggaaatttttacatatttgtacactgtgataggaataattcagcttatttccacaaatatttattaaatgcctacatttcattgagcttacattttattcaaaacagagagattgatattcctaaatataggaggaagtatatttcatctgaaggcagaatgtacatgttgatacaggtgaatgtgtagattttaaggtggaaagacaaggtagttctcttctgatagattctgtctttcagttacaaagaggtaagagtcagctaagcatgaagattagggattgttgttagaagtttaaagagaacaataggtttccccagggactaggtcaatgtagtaggattgctgggcagagctgggggtgcacttgagatttgtggtgatgaacttaaagtaagagcaagtggaatggttatattgttcttcagctatatgtaactgccctgggacatggagtaggtggagagttggatttaatcaagattagggttttgccaggcaaatatggaggaaaagagaagtgagggaattgggaaggcatcagcaagaaagtgatttcagtactgaacttcagaatcctagttgggtgaggagggaagtgaggacatggagatggcgatggacaatgagaaaagtagtagagataacagagcgggtcaaaaactatttgagtcaggactagaggaagtgacctgaatgctgggaagtggtagtcagggagtggaatgcatgaattcagaattgtagtggcagtgcagtcaccagtggagagaatgtctaggcaggatgagactaaggggctgggtagctgaggtagaatagaggaagtgcaagcagatcaaggacttagaggctgtgttgttgggtgccttgtctgcagggacgtagaaatttacaaaatgagcacgggagtagtgtggagggaaagacagtgagctaggtgctcagattatcagaaaatgagcaggagtgatggtgatgtctgcagatgactcgagcaagaaacgttgatggatggagtagtctgatgggctatttcaaggtagctgggatgtttgaggagaaatgacttggaagcagtaatgaagagtcatctccatggtacgtggcttgtggagagagaactaagaggtcaccatttgaaaagccttctgagaaagagctgtcctcaggggacacccaggtttctgttagatcaagggtattcaaggaggctgaggttgacaatatagaaggttttttcctaatgaaaatgtgtgctccagaaggctcagtggaagggctgggatgaagagagctgtgggcaatgaacagggatataaagcataatatgataatgttggtgttttaggggaaggtaggtaatgagttctgattctagccgttgacaatttgttgggttaaggctgttggcctcctggccagggaagtgggtgtcctacttgaa

SEQ ID NO: 89713 - DNA, 1205 bp, Homo sapiens
agagattcaggtagatgatgaaagaaatatgttgaaaatttgataccatgaggtgaaataagttgtaacatttattttattttattttttttcatttgattctgtccttaccactttggacttttcttttaatatatttttctccaatgtctaaaaaaggggtgaagcaaggaagtgttgactttgaaatttcttctgtgttttaagttataagacaaagctgtaatgtcattataattatttcatattttgaagagtcaaatctaattaaatgtgttctgccaaacttcactttccaccacaagtactgaggttttacacaataacttctgatatatggtttttccatttgaatgagccatccaaaaaaattttttttttcctttgcttgcaatggtgggtgtccaagccaaattataaggccaaaggagtgtttatttctttaggcaaatgctatgatagagaaattcatacagtagaacttgaagattaaaactcatattcctaatttctgtttttgagaaagctgttgaattcattgtgatgggtatggtatgcagtaattataatgtattttacttgattgttatttttctcttcagttttggctttttctagggtgactcattgagagagaaaaactacagtaagagaaaaagtatgtggcaatcagaaacaggcatagttgtgaaaataacagatttctaattaaaacacttctaactttcaaaaaagaaactgcttaataaacaataattatattctcatttcatctctatttggaataatttgagagattttacgtgctcacagaaagaatgacttttttcccccccttttcaggattgaactcattttgtgacttataaaatatagttaatttctgtttactgtttctgtgcagtggttccttgcagggatacattgatgatttggaatagtgtttatgatgcaaaagaactatatttagttgtagagtagtaataaaaattattttatttttaattgctctttgacaaaagtatggtttcagattttagacttcttaaaaggtgttttaaaaatgatattcattggaaataatctaatgtcaaaatacagctttgttatctttttttcttgtaatttgctgacaaccacttttaaaccagttcccaggattggctttgggaatcattaagcccaccttctactctcattttctt

SEQ ID NO: 89714 - DNA, 1026 bp, Homo sapiens
tggagtgcagtgacatgatgtaagctcactgcaacctccgcctcccaggctcaagcgattgtcgtgcctcagctgcctgagtagctgggattataggcacctgccaccattcctaattttttatgtttttacttgagacatgatttcaccatgttggccaggctggtcttgaactcctgacctcaagtgatctgcccgccttggagctggaattacaggcatcagccatcatgcccatccgttaaagatgttttataaagcaaatgactgaagacccttacttccataatttgttatgttatgggacaggatgttagatggtaaagtattgtcttagcttgggctaatgtaacaaaataccgtaggctgggtgtcttgaacaacagaaatgtatttctcacagttctggaggctgggaagtcagagatccaggtgccaggagattcacttcttggtgtagaaccctattcctgacttgcagatgtccaccttcttgctgtgtcctcacagggcagagaaaggaagctctggtcttttcttttgagggcactaagcccatcatgggggctccactctcacgatctcatctaagcctaatcaccttccaaagctccaccttctaatcccttcacattgagacctgtggcttcaagataggaattttgagggtgacacaaaaattcagtccataccaggtattaagtagcttgtgctggaatgctcctcactgaaattctcaatttggaaggctactgatctcttctgcatgttggcatctaaggtacctttcagctctagtcattatcttaaaccacagctctgcttagtggtgttggtgaggactgtggccaaagtggatcactcactacccattctaaccctgctaacttgtttttttgttatgttttgtttttgttttttaaaaaacaaaaaacaaaacaaaacaggccaaaatgtgtaaggagcccctcagaaaacaattctgtgattgaaacacgttattctcttttctaattttgagggcca

SEQ ID NO: 89715 - DNA, 1442 bp, Homo sapiens
ctctaccagaccttgtttctccccactgcagaaaaaaagtatttaagtaatttgatcaatatcttatgatgtgataagaggaaaagcaaggattaagcctcaaaattgctctcaaagcccatggtcttcactgttgtgtgcagtgctcaatttctgtgagttgtgccaatagcccttttgtattaacagatagtgttaatggcagaattatttctgtattgttattcagaattagatgactcccataaatatgagtttgatttttttttcctttttgtatagtcttccatacaccagcaaacttgtgaagaccttattatataactttatcagacaagaaaagccacctcctccaggggcccatgttttccctcagcagtcggatgggggaggactgctttatggacttgcatcaggagtagcaagtaagttttatcagattttttcaattctttggtgcacataaattttatctatttaggcataagaaattctgtttgcttggctgccaccattaatagttacattgaatttgtgcagctggttcaatgtgaaaacaaagtaattaaaatattaatctttctgttttgtgcggtgatttatgtaaaatgtatgcaaataatgaatggattacctacaaaacatcgtttttcaggaagaatgtttacacataaatatgcgtattgcatgaattgtagctgtatagtaaaaataaaattaagcatttgaaaacttataacactacttgtattataagaggaaatctattttaggttattttagggtatattttggttaggatttcatgtgactaattaggtgcagttttcctattacactaagtgctttcttcagtgacaactgaatattttgcagaattttgtaataagctgtgaaatggcacaaacttgagttttgtttgattgggtgcagatttcttaagtgaagaaagctcttccctaccttacaataagtcctcatttctgcttcacttcacagtattcagactacagacactagaagtaagagagtagttctggtggagggcctgggtcatgtgaagttatataaatgaaacttcctagagcgacactttggtacttgtgaggtcggcctgggagttccttactcctcccaaacctgcagcatgtcctctccttaatcacgcaggacagagtcaaatggaacacatttccacagctgcattatggctgtggcgtgctctacactccagctggacatcagtttgatatgaaaaggtagcactgtgataacttactagtgttgggagcttctttggattcagagacctcttcaaaaagcagtagacttggtctgttaattgacagaaatcagtgaaccagactttcttagatttgccttcctttgatttcttttaatattatgaattgagtcacacttgtgatcacttctgcctttgg

SEQ ID NO: 89716 - DNA, 2197 bp, Homo sapiens
gattacaggcgtgagccactgagcctggccttttaaacatatttctatcagtaataactccttaagatatctggtagaatttaaatttttctagttctagaatcaagtcatcattaatttgtttaatgagctttcatttaagtaggtgttaagtatttttctttgtttttcataattatttcatttttataaaaatattttagtattcttttggtgctattgctctttttactgcgttgttgaggtttctacttccttggtcttaacatgttccccattataatcctgtttaaacttttgcagtaactggaaatttctggatgcctttattcctctgtgtgctttctgttcagctgaatctttttctttttatttgatctaagacttgtttcccaaaggggtttatgatcttgagaggacagagtaacccttcataatcaaaatatgcttaataaaacaggaataacttgtttactgttaatattttgctgaacatgcaaagttgaccttgagaaaggtaggcactagagacacaagatctagggtgtattattgttctgattgtaaagtgatcatcaacatgaaaaggcattgttttcttccctacactgtaccttctcttcagctttacaatctgagtatttgtctctgtattatcactaaacagaaatgaacatagatgtctagagtgaatcttcaaaacagaacactgctagtaactatttccattatacataaatagacttgtcatttaataggagatggaaactggaaaatagggaaataaagggataactaacccaaatacaccagctaatgacagggaaggagtttaatatttttgcttgacttaatttttgtattaaacgtattaacatttttcagtaacctgaaaatactgaatatttagatttgagtttttaaatgtatagttcatttagaaaagaatagtgtcttaatcttccaaagtgactgttactctgtttttcttccattttagagatattacatatgaaatatcagtagaagctatatcaacaatggttgttttcctttcctgccaactcttccacaaagaagttttgcgacagagcatcagccacaagtatttgatgcgaggtccatggtatgtttctactttaagtatgtctagttttttcattgtataaatctatatttctagtcttgtccttttacctgagtatcgtcccatatctccaaccaggtatttcctctagttgttctattgtctctttaaacccagtgcatagggaaccgcattctactttcctgtgccatctacccatcctccctgttcttcctgtcccgtagcttcattaccttctccagtggttgcttcgtagaattgaaactttgaaatcatctttttcttccatctccttcattctgtctatgtttaagcagtcaagtcatatttgttattcagattatttttgtatcttcctcttctcagcagtccctttgaaacacctgtgatctatgcccccttactctctttggacttctccagcagcctcttcgctgactattcctacttctttgagcctgcaaatatttgctgtgtgctatccatgtgccaggcatgttagactgtggggctatgctcttgagcagaagcttacgatctcctagagggtgtggatgcaaatgaccaacacatatgcacatacctgaccttttattaacataatcttcacaaaactttaaaaatgtaaaacaaatccaaataaagtacctttgaggaaagttctcagatagtggggagctttgtcttcttcatattctttttgctaccctgattattcctgtggcatgtatgttctttgaacatatttgaaaatcactgagggaaaggatctgggctttggagtcagaggtttgcattggaaccctctctgacagagacactcagaatgacactcagaatgaccgtggtttgaagtagtgctggcatcgtgggactgtgtgcatctttgctgaaacaagattgtgaacttcatcccttatagtgccagagtattcaagttgctttttaaaaatagacatagagggtgttagtgttcttattttctaagtaaggtttttatagtatcattatggtgccacatatttaaaccgtaatatgttctttacttatttttggggttcatcttggaaaccatatttaaaaagctca

SEQ ID NO: 89717 - DNA, 1017 bp, Homo sapiens
ggagtctcactctgttacccggctggagtgcaatggcgcgatcatggctcactgcaatctccacctcccgggttcgagtgattctcctgcctcagcctcccgagtagctgggattacaggtgtgcaccaccatgcccagctaatttttgtatttttagtagagacggggtttcaccatgttggccaggatggcctctatgtcttgacctcaggtaatccactcgccttggcctcccaaagtgctgggattacaggcgtgagccaccgcactcggcccatttttttttttttataaatcataaaaaaagtaatggatattttaatttgtgtgatccatccctttagtttatatatgatgaagttgataggtaatgtggtcgataacggtactgagtggcagttctgagactaaaatccacatttcttgaatcccaaatgccaagcactgtttcttctagtgttaagacttttataaatgaggagtattaccatgtctttgatttgttaatttttaaaactggccattatactaacatacttttgttgataatatctgtactatagcatattattttttagtctttccccatatttgactcctagaatctccatgttggcatgcattgatatttctaaattttggtctcaatcctttgaacttgtcagttgtttttattaaacttatgttccatttacagtaccatcaggtttcttatccaatagtaagtaaaaggaggatgtttttttcctctgtattcgttgactgctcttagccaacactaacacccatttcatgaagtcttttgtctttatccaagtgttccactgtgccctagcagtgcagtgcagggtcatggcgcctgtctctttttcttcacatgaaattaataacttgctccagcagtggtttgttctaggacatttccagagcagatggtggaaagttcttgggataatatggcagccaaagcagtattttggctttttaaggttgactttgttttggtgattgtgtaa

SEQ ID NO: 89718 - DNA, 1012 bp, Homo sapiens
cagtgaaactatattaagaatatggtaggcacagaattaatctctgtattaagagatcttatagatctttggaaacaagattttaagagagaagcagtttgaatctacttcatattgtggtagacacagtgagttgagttctccttatcttcctgacttcctgattgtatttccagcctcttttgaagccaggttttcgtttccagccttctttgaagctaggcatagtcagtgagatgtaggggaaggtcctccaatgaaacctctgggtaaagctctctaaaaggaactgattgagtcagctaggaggcacatctttttgatcttaacagccctttctcctgctgtctggaatgtggatagtcttttgagttgcatagccttcttggcaccatgaaccaagagacttacagaaaattctgttttgatgtcattgagctgctgaaccaaagccaacaactaccagtaccaccttttttcatcctggacttctcatgtgacagaaatagacccttatttgttaacactgctgtaactgggcttctgtcactgcagctcaatgcaattcctttgtgattcgaaatgttcatctcatttgttgcttttaaaaatttaaagtagagacagggcctcactatgttggccaggttggtctcgaactcccagcttcaagtgatcctcccacctcagcctcctaaagtgcctggattacaggtgtgagccaccgtgcctggcctcatttgttacttttaaagcagtgattctccacctttaaaaaaaagtattggccaggtgcagtgtctcacgcctgtaatcccagcactttgggagcctgaggcaggtgtattgtttggatgcaggagttggagaccagcctgggcaatatagtgagaccctgtctctacttaaaaaaaaaaaaaaaaaattaggccggatgcagtggcttatgcctgtaatctcagcattttggaaggccaaggtgggcagttcatgaggtcaggagttcacgacc

SEQ ID NO: 89719 - DNA, 1049 bp, Homo sapiens
atttttctgatatatattaatcagcttaaagtaattgaaaagatctaagccaggagagtgaaaggatggagtttagttagctctgtctgattgcaatctggagtttggattgcagaggagtaaaattggaactacaatactaactagttatgaaggttaaaggagtccaggagtcagttttctttctttctttcttttttttttttgagacacagtcttgttttgtcacccaggctggagtgctgtggcgcgacctcagttcactgcaacctcttcctcccgggttcaagcaattctcctgtctctgcctcctgagtagctgggaccacaggcgtgcgccaccatgctggactaatttttgtatttttattagaggtggggtttcaccatgttggccaggctggtctcgaactcctgacctcaggtgatctgcctgccttggcctcacaaaatgctgggattataggtgtgagccaccacacccagcccaggagtgagttttaatttagtaaacttgtttagctgcactgtggtgatgagataatgaacaaaaaagcatgacaatggtggaactctggggaacatgccaatagttgaaacgtattttgaggaagcagacactgggaagaaatagaaaaagaagttggttaaaaataaagtattataagaactgagaaaagaaagaatttcatgaaggagtaggtgtcagtaatgtccaagaccagaagtcacatgagatactgactgactttgggaatttggaggtcacttacctgtagtagtttgggataggggaacatttccattggaatggtaatttgcatcctgccgttgccacttatttattctgtgacttgggaaagcccttttacctttgactcattgtctgtaaagaggaggttggcctctttaatggggttcagtctatgatccgtggagtgccagaggttcataaaaggtaccttcaggccctcccatcaagaaatcaagggtaaggccagatatttgttggggagggagggataaaagtcctctacccctgcttcaaa

SEQ ID NO: 89720 - DNA, 2009 bp, Homo sapiens
ctttgttgatatgttttcttaatttttcattcaaatgatttgtaatctgaagagtgttttagatttaataaacttttatagtttattatattctatatactggagacatagataatcaatttttgagtttttaaaaatctcctttctagagaaagatttagtgtgtaagttgaatgtgtctattaactattttttcctttatgattttggattctgagataagatggctacttgtactgtttctatcattttcattttgcaaatcagtttttgatgttcagaattaagaccaagagcagcagtttctctcattgcttagttctctaattaggtatgaaattaacagtaaagttggtcactgagcaattttaatatgacatttggttttataaatgttatgataagctcactttgattttagttcttaaatttaactttttaaaaccttttcttctcttgcagttgaaaacaatcctcgaacaggaaatcttggtgcactaattaaggtcttcctttctagaaccaaagaactaaaactttcagcagaatgtcagaagtaagctggctaattaaaccatgtttgctttatatttaacaatgtgaattttagttttcatttattgatggaaatggactgtggtcttttgaaaatctctgtgaaggaattattctcattattaagaaaaaaaggtagagaggttttaggttagtgtctaagtcactggggtgagattatagattcgggaatctgatttcagctttttagacaatctttagattatattctttaagaaggtgaataatgatgtaattatcgttaagaaggtaattcccctcccccccattatcactgctgctgctatctagtttaaatgatgacttagtctgagttttatttcattctacatctgttgcagttatttccgttatattctttacatcaatggaaggttaactttttatgcactgaagcatttttcaaaaccatgtttggatgtcagtctctgaaaagattaaaatattttgcattgtcttgcttataaacaaattacattgaatccaataaagtttttcttgggagttcatggtcattaatacaaataaaaagtattttaccgtgctgctggcaatgcctcgtcgaaaattttggttacatatttgcatatattctttttatgttaccacaattttttaaattttttggtagctttcttctcttttaatcgcatgtacgtggtatacctattaagaacaaagaacagtcattcctacagtcatcagtaaagatttttattaagtagattcactatgtaaagtacatggaatgaactatgaagtaaaacataatatcactggtacaatgaaataaatcatgagccattaaaagatatggacattatcctaatattaccaataggatggacaaaacggttgtcaaatcaggaagaaatcatgaactagaaataaactatggtgcttatgtttaaatattgattcttgtatgattttggtctttctagccacatcttcatttggcagacacacaatgctttgtttattatttgctgtttgctgaaagtgttcatctgtcagatgtcagaggaggaattacaacttcattttacttatgaagaaaaatctcctggcaattacagtaagtattgtttttaaagatgttctggatatatcatgtgtaacatttaaggataaaatttcaggaataaaagtatgattttgaaaattccagttatccttataattttcattttaaaatgaacttatactgtcattttttctttttctgtgttaatttaaatgagtcaagactcaagcgttttttgtttttgtttttcgttttaaataagaaagctggtggggttgaagctttcatttattttgactttcatgcatgtggatgaagaagaaagtaatataaaaaataaaactcacacaaatatgtatttctttcagaaaacagaggtgtcagttttaaatatcattgccaagtc

SEQ ID NO: 89721 - DNA, 1050 bp, Homo sapiens
tgctctgtcgccaggctggagtgcagtggcgcgatcttggcccactgcaacttctgcctcctgggttcatgtgattctcttgcctcagcctcttgagtagctgggactacgggtgcgtgccaccacgcccagctaagttttgtatttttagtagagacggggtttcaccgtgttggccaggatggtctcaatctcttgacctcatgatctgcccgcctcagcctcccaaagtgttgggattacaggcgtgagtcaccatgcctggcctagccccatatttcttgtaactttgtatctgatgtctaatatatttataaatacagaaatgtgtgattttctttagtaagtttatagtttttttataggtagacaaagcatgatgacttttgaacaagtttaaagtttttatttttattttttataggttgtcttttggaaatgcaggtttaaggacaaattatctgcttaagctagaagatgggatcgaatagcagcagaatcggcgatcttcctaaaaatgagtacttgaaaaagttatcaggcacggaatctatctctgagaatgacccgttctggaatcagcttctctcattttctttccctgcaccaactagcaggtaagagattgcctggagattgaaaatttgaatagagggccatatcaacttgtgtggtatgctgattaaaaaaaaatttagaaatgttctgtctatctatctagtctatctgtcatacatagatcagtagaaaatccaaaagatttgaaagtagaaaataagcttttctttttacccaactcagtagccacctcccttctctagaggttatcactggtagcagtttattttgaatcgttctagagataatataggttacttaagcatatatcccatatagtttcacaaaattgtttaaatacaaatggtagcatactacacgtactgttctgtcccttgcctttttttccacagttaagtaaaatatatcttgtatatgtagcacatttgcaacttccttattctttttaatggctgtggagtatctgtagaa

SEQ ID NO: 89722 - DNA, 1036 bp, Homo sapiens
attacttattttgcttttattgaaaaagttcaattttgaataaaatctgaaagaaataatttattgggtagctgggagaggtggctcatacctctaattccagtgctttgggaagcctaggcaagagggtctcttgaggccaggagattgagattagcctcagcaacatagcaagacgcccatctctataaaaaatttaaaaaagttagcagggtgtgatggcatgtatctgtaatcccacctactcagaaggctaaggcggaaggattgcttgaattcaggagtttgaagctacagtgaattatgttcatgccactgcactctagtgtgggtgacagagtgagaccctatctctaaaataagtaaataaatttattttggaaaactagtctaagtgaaagaacattctgtaataggacaccgagtaactagaatatgagatcctaatatctcatcatgtttaatatggacgatgaagtaacaatatgtaaaaacaatcctagtggttgtgaaagaaagtacctattagtctgatttgttggcacctctctgggacatgtagattcttttttgtttgtttgtttttgttttttttgagatggagtgttgttcttgttgcccaggctggagtgcaatggcacgatctcggttcactgcaacctccacctccagggttcaagcgattttcctgcgtcaatctcctgagtagctgggattacagacgcctgacacttcacctggctaattttttgtatttttagtagagatggggtttcactatgttggccaggctggtctctaactcctgacctcaggtgatccacccacctcagcctcccaaagtggtgggattacaggcatgagccactgtgcccggccttgtggttttaattgagcattttatgagattagatttctcttttcttagcatttcaattatactttttttttttttttttttactgttttagtgtttaccctagagtttgtaatctacatttacaagcaatccaagattgcttttaaataatacaat

SEQ ID NO: 89723 - DNA, 1010 bp, Homo sapiens
cctttgacccagcaattctatttctctggatttatcatatctgtctactcatacatgtgtgaaatattttatatgcttatgtaagtgatagtataagatataagtaatgtatatatcttattggagaatgacatttattttttattacttggagaatgatttgtaatagcaaaagatgtagactacctaaagtccatcaatatggtatttgagaaattataaaatggaatgttacacaattgtaaaaaggaatgaagtgcttcatatatggatatataatgacttcctatatattgatgagtgggaatagcagagtagagaggaatatgtcatatgctatggtttgtttaaaaaggggttgaacatatgtttgtatatacacagaatgtctgtggaatgatgcccaagaaactgtgaatgttttctctgagttgagaaggtggttagaagatgggatgggaaggagattttcactgtctatcctttgaagcttttgtattttgtaccatgaatattactgatacaaaaagaacataaaataaacagaaacatctgacaaattttgttagtagactctttgatagtattgtttctcgttgttgcttcacctggtgggaggaggaggttgattccaaaatcaaattttgttcttttgaaaattcagcattcatgtacttaaactcctagagtaaaattgcttgcttttaagttaccacacaaaaaaagtaagatactggtctatttaactgagaacaaattgttatgattttcatttcttttgatctggtgtcatttttttcctgttaattttaatgaagcacagagaaggaaaattgagtacatggtagagccaggaggacccatatttaaattgctgtcagcaaaccaacactctttgaactaacccactttcatccatacagttagaggtacttattcagtacactaatattagacctacaatcctaactgctaattagcatgagtcccctgataaatagcacactgta

SEQ ID NO: 89724 - DNA, 1050 bp, Homo sapiens
ggagagaggggtgtgtagagcaagggtgatgtgctgaaggatgaaaacctggagggtggaggccgtggagaggaatgtagcgtccaccagaggaactcaggtgcttaggctgatgagttgagggctcaagagaagaacgaggtggaagggaagagaatctataggaatgggtgaatggttgttgcagaggatgaaatttatgaatatatggatttctggagtgattatcctgctttgaagttttattttagataatcctctcagcaacttggagatagaccggacaagtatgaatattcccattctgtaaatgaagaactagtcttttagaggttaggtgtctgccttaagctcataaactgagtacatagggcaaaatgagttggaataattgatgaaactatcagtcgcaagtggattaaatggcagagaactgagttggggcaatgttaataggaaggagattcagctattaagaagtctgtgttgttacgacatataggtcaaggagtttttatgtttttgcaccttttaaccatagaaaagttcacacagtgaaataataaagggtactcccatgtacccattacccagcttcagcagttaactcatgccaatttaatttcatctatgtccctatgcattcctatccccactcacaattattttaaagcaaatcatagacattcaatttcatctgtaaatatttcaatatatatctgtagaagattgaattgcttttttttgttggtggtggtgggaggcagagtctcgctctgtcattcaggctggagtacagtggcgtgatcccggctcacggcaacgtctgcctcctgggttcaagcaattctcctgcctcagcctcctgagtagctgggattacaggcacgtgctaccatgcctggctaattttttgtatttttagtagagacgggggtctcatcatgttgctcaggctggtcacgaactcctgagttcaggcatttcacccacctcagcctctgaaagtgctgggattacaggggtgagccactgcacctggcctgctct

SEQ ID NO: 89725 - DNA, 1577 bp, Homo sapiens
aaaaaaaaagagagagacagaatgtctcttaatatctttttgttgtaataatttctttctttttttttttttgtttttgtttttgtgatgaagtctcgctttgtcaccaggctagagtgcagtggcataatcttggctcaccacaacttccgtctcccaggttcaaacgattctcctgcctcagcctcctgagtagctgggattataggcacatgctaccatacccagctaatttttgtatttttagtagggacggggtttcaccatgtcagccaggatggtctcgatcttctgacctcgtgatctgcctgcctcagcctcccaaagtgctgggattacaggcataagccaccgcacccggcttgttatgataatttctaaaatgttttttcattttagggtgcagacatgaatggattaccaacaaaaggaccaacagaaatctgtgataaaaagaaagactaaagaaattttcctaaaggaccccatcatttaaaaaatggacctgataatatgaagcatcttccttgtaattgtctctgacctttttatctgagaccggaattcaggataggagtctagatatttacctgatactaatcaggaaatatatgatatccgtatttaaaatgtagttagttatatttaatgacctcattcctaagttcctttttcgttaatgtagctttcatttctgttattgctgtttgaataatatgattaaatagaaggtttgtgccagtagacattatgttactaaatcagcactttaaaatctttggttctctaattcatatgaatttgctgtttgctctaatttctttgggctcttctaatttgagtggagtacaattttgttgtgaaacagtccagtgaaactgtgcagggaaatgaaggtagaattttgggaggtaataatgatgtgaaacataaagatttaataattactgtccaacacagtggagcagcttgtccacaaatatagtaattactatttattgctctaaggaagattaaaaaaagatagggaaaagggggaaacttctttgaaaaatgaaacatctgttacattaatgtctaattataaaattttaatccttactgcatttcttctgttcctacaaatgtattaaacattcagtttaactggtagttcattttcttttaaagtctattgaaatattcaaaagggaaatttttcaccacgtcagaaggcagaatttggatgttgtgatggcatctgtgtagtggtgggacaacaattactattgttgcgtaacaagacactccaaaatttagtggttttcagcagcagtgactcgactgggcagttctttgctgttctgggctcactcatatggctggctgggcctgggtctggacctgggccgctatgtgatttttatcttgggctttgaaaattcagtgtagggacctataaatattcaaagatgatgagatgcatccttatatattttttgtattcactctgaagctgggaaagattaaaaggaactcctgcccttgggtccctaatgaagtctgggtcctaactcaggctctattaagttctgtgg

SEQ ID NO: 89726 - DNA, 1062 bp, Homo sapiens
ctttcgtgtgtgtgtgtgtgtgtgtgtgtgtgtgtgtgtatatatatatatatatatattttttttttttctttttttgagacaaagtgtctctgtgtcatccaggctggagagcagtggcatgaacacggctcactgcagcctcaacctcctgggctctagtgatcctcttgtcccagccacttatgtagctgggaccacaggagtatgccaccatgcccagctaattttttgatcttgtagagacaaggtctcactttgttgtgcaagttggtttcaaactcctgggctcaagctatcctcttgcctcccaaagtgctgggattacaggcgtgagccaccacatctatcccctttcagatatcttaatcttggtaaattctttcagttactaatctgtgatgaactaatttttttcttcacatatatcaacagttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaaggtaagaacattcacatgccttgaataagagcagtgaaagggggtggtacttgggtgaaacactagattttggaaggacaagttttagaaccagaagcttcaatagtttgtgtaacatttggcttaaattaaagttttaaagtaggcctctgattaatgcatttgtcctttggccaaaatgataaccatattttctgactggtaagtgcaatggtaaatagctaatggatgaggagagattatgctgatacaaaccagtttcactgattgatgactttgataagagatttaattagaaggatcatagagatttaaaaaaaaaacaatttttttaaaaatgagtggacaactctgttgtctttagaattggtgcttttttagattcagctttgtactcagctgcactaatttagccatccggcccgtttctggaagcaaaa

SEQ ID NO: 89727 - DNA, 3184 bp, Homo sapiens
tggggactaccgggctcctccactggtgggggcgccggcccgccgtggggtgcgggccgcctggggtccgtgcggactccggaggtccggtgtctagtggtgagtggtggccgcaacgaggaaaaagttttgggggaaagaaaagtcgggtggaggcgtaacacgttactacaagagtgttgcgtacaggagggctcttaaagtgggtcatagcccgaaggtgttgagagagacggcactcactacctgcagccctgacagcaaaggggtttctgtagagcgggagggaggaggtgtagagggttacggttgagttgtgccctgcggatgcgtcgagtcattttacgcctggaagatccagcattggattgaaacaggctgtattttcttccaaagggttgactggattggtgaggcccgtgtggctacttctgtggaagcagtgctgtagttactggaagataaaagggaaagcaagcccttggtgggggaaagtatggctgcgatgatggcatttcttaggacacctttggattaataatgaaaacaactactctctgagcagctgttcgaatcatctgatatttatactgaatgagttactgtaagtacgtattgacagaattacactgtactttcctctaggtgatctgtgaaaatggttcgctattcacttgacccggagaaccccacgaaatgtaagtggacaggaggtagatacccatttcctacttggggcttggcataagataccaaaaattaaccaaaacgttttattttctagcatgcaaatcaagaggttccaatcttcgtgttcactttaaggtatgcgattcatagttgtgatccaacagttcctcatgttccactcaaaaaaggtagctgcagtgatgactttcttaggacacctttggatttaccgtgaaaattaataaattctgagcagccaccttatatttaggcattgatgatcagggtgtaaggatgtagcgtttgtgaaattgagaagtagtaccagaaaaccatttgaaaacctagtgtgcagatcaagatggggcattttaattgtaattacatgatgatggaatttaaacgttttatagtgaataaatggagttttggagttttctctagcttcaacgaagtttacctggcttttagtcacaagtttttttaattgccttgcccccaaagaatagaaataactcgacattttgaaaagctgaaaattgaaaatttaacgtttactttaaaaattaaagctttgatctagttaaccaacactttattcttcatacttagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggtgagaattcttagttgccatttgaaaagacagattttaatggaaaagtgatgggataggataagaatggctaagatctgtgctgatgaacctatttctggttgctgtaatgacaggacaccttggattgatggtgaaataaaccatatcctaagaaaccgtgatatcagataaattcatcttggctgtaatgttaatttaaatcaaggaaaatgactcatcatctccattttctttcaggccaagcaatggggctggacacaaggtcggtggcccaaaaagagtgctgaatttttgctgcacatgcttaaaaacgcagagagtaatgctgaacttaaggtacccaaaccactaacatcctgtgcaacttgggtggttgtttaattaatgttggctgttcagatttatgtccttgattttcttgttttcagtaattaactcttaggattttttaaatttctacctgcagtttccacagaatgaaactatttccttttattttttttgagtccctttatggcaaaattctgtgaagatccagaagcgtgctctgtggtctctttaagcctaacacttagtatttctagttttctgctgtctttttacactggaggtactttaccaggggcttttacccctttttgtgacatacacctttggtagtatgattaattatcaaaatgattgccttagcagtgattaatgtggtttgtggcctaccttcataatggagagtcatgttgcatttcagaaagaaattgtttaaaatttcaaaaagtttaaacaatgacaaacttgtgttgacaaaacacaaatttctccattttgtatattacccattagccttttgcatttgaaggtctgggccagaactggaattagtttaggtctgtatggctccaaaccttctaagccatgctgagaaattttatcatcaagacttcgaattgggttcttccttacccctcagctctccacccgtctaaggatctttgggaaggccactcatagacaaaatgtatagcacactgagtttggtggcaatttagacatgtaaaggtgaaggcagacaactggttaaaaaaatgctatttgcagaataaaaggattgccttttaaaaatgatttcattgaggcaggactctggagcaagcctgggaattcatatttagcaatgatagtttgtggtgttttactaattaaggatgttcctggtttcattctccttcctttcttccccagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaaggtaaataagtagttgctcggttttgtttgtgatagtagaaagatttgtggttgctgtgatgactatcttaggacacctttggaataactatgaaagaaaactattctgagcaaccctttcacctgtcttattttggcttttgtaagtttgtttcttgactaataataaatggtaagttttctgtaatcccagcactttgggaggctgaggtgggtggatcacaaggtcaggagatcgagaccatcctggctaacacagtgaaaccccgtctctactaaaaatgcaaaaaaaaattagctgggcgtggtggcgg

SEQ ID NO: 89728 - DNA, 1040 bp, Homo sapiens
tcatatgagtaatgagttctgcaagttgaccgtccactctagacggtagctctgcctcttgtttatcctgaaactaccatctcaagtctcctgataggctccctggttctaatgtgctgtggtctggtgaacacggtcgttaaccatgtcctcctttcaggactcttgttggtcacatctcctcccagccttggtgtttcgaggccaggttttctcagcctaggcaatattgacatttggggccaggtaaggttttggtgtggggtgtgtgtgtgttgggattgacttgtgcactgtagaatgtttagctgtattcctggcctggccctgctagatgctagcaactctctccatcagaatgggggcaataaaaaggtctccaggaatttccagatgtcccctggggggcaaagccacttgtagtggtgaaccactgttccagcggcccttccttcctggcacatttcatcccttaactttctccaggtccttcctgtgtgtctgtggggcaaagagctgttctggttgggataaatctggttcccataatcacttgggcttggtaatagtagctaatactgacaggcactcagtctcttaagatctcacgtggactttgaattaaggtataaattcaggttccattttataaatgataatgaaacacagggaagtttttcaatatttggcccacagaatacctacttttaggatcatccggggaataaatatctatttctatgtgccataattcatatctacccactaggagttcaggcacttgggaatctgcattttatactttgcaagttctcttttggaatggttttacattaatgcagttttcaaatcaaaagatggtgaaagtctctcttactgctctgctacctgtccgtttcccttacccactctctcccccaacgcacacgcatacaggtaactagttgcttgtgtgtccttccagatttttttgtagctgtatggtggaatttaaatttaacaagctcccaatttcaaatatgagaaccagtgctctcaac

SEQ ID NO: 89729 - DNA, 1012 bp, Homo sapiens
ttacacttttcaaaagatttgtgtatgcattgcctaattagagtagggggagaagggcaactattattatccctattttacaaaactgaggcttagtgaggttcagccacatgcctagacttatatactagttagtggtgcagccagggagaggactcagatttcctggaggcaaagtctatctctgaaactccatgaagacttttgcagccagttcccaccaatatgccccagacgtgagacaaacaaggacttttttttttatatagagccatccataaaatcctaagcccttttattaatgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgattgctttctagccaaagcgaagcttgtacaggttgagtatcccttatccaaaatgcttggaaccagaagtgtttcaaattttagattattttcagattttggaatgtttgcatatacataatgagatattttgggaataggacccgagcctaaacacaaaattcattgatgtgtcagttacaccttatccacatagcctgagggtaattttatacgatattttaaatagttgtgtacatgaagcatggtttgtggtaacttatgtgaggggttttcccattttttgtcttgttggtgctcaaaaagttttggattttggagcatttcggattttggatttttggattagggttgctcaacccatattattggctgtacatcctggtcacttctgacttctgtttttactaatggaagctttgcaaattgaattctcagtgagttgtatatttatacacctggcttga

SEQ ID NO: 89730 - DNA, 1110 bp, Homo sapiens
cctttccaaatgatgtacatctaaataaatagtaccttcattagatgccttgtgttgatacttttccccacctggttaacatgctttatttatatttgaatattcaaactgcctgatttctcttactcaagtataaattcctgggaatttcttactactttataaaactgttacattttagactattaacatgcctgttgaatattaaagtgaaaaaatatatgtaaaataattgacataatagaaaagcaatatttagtgccaaatctacaagtttcttgcccttctcgccagatagagccccctcccttaaatgtatctttggcttttatacgatagttgtagcttgatttgggatgcacctatcataatttttgacactggaacttaaatttattgagtgatttctttttaaatgttagtattagaactaaagtgtcttaagcataattaaaagaagaggtggagaaacatttaaagatggttatatacattccacacttttggaatatttatttgaaaattttaggtgattaagcatgtgatgcctggcattgggaaataactaatagaacaaaggaaatctatttaacttgatagcgaaggggtaggcacaggtgtgatttcctctatgataatctctcacacaggaaaccatgatttcagacaaatggtttatctttaaatctcttccacttttagcagatcacagttcagagcctcaaagaggctgtttaatttattatatttgtgtcagcaaataggtaccactaaatttctcactttagacctcacatttaaaactattaaactatatcaactttgggaagttgttcataatcatttggaaatgtatacattctcaaggacataactcagaccatagttttcctaggttcaaaagcctagtttcactacctattctaggtctcttagtacctccttgaagatggctctgtatatagagtagaaagataatggtggatctaagcacatatgaggcaccatcttgagagaccacaaagtatagtaggaaagagcacaagactgaattttatcccaactctgcaaaagttacctttcttagaatgagtttccttatctataaaa

SEQ ID NO: 89731 - DNA, 1008 bp, Homo sapiens
attattattattattattattattattattttaactaccagggccgggtggtggcaccaggccatctggctatttatcttacttctgtttctttttaactttttgcttttttcttttcctcctgttttataaactaggcaaggggggcggggtgcgcaggagaagtggtggtcttcttccttaacagcatgcagtgcagttcttggtacctgcatgtaggtaaagatcaaactgtcaaactggtagtccttaagactctgcttccatgggtatgacttgttctaggtattattgcctaacagaaatttccattatctaattttaaattgtgtaaggtttcacagtgagattattcgaagcatttagaggtatttactaacctgtgatggcttacaaatctcttcttgttgcaataggtgtgtttgtagttgctgctaagcgaacgccctttggagcttacggaggccttctgaaagacttcactgctactgacttgtctgaatttgctgccaaggctgccttgtctgctggcaaagtctcacctgaaacagttgacagtgtgattatgggcaatgtcctgcaggttagtagagtaaaggaaggtgttcactcctattgcttctttgatcagtttctaaaaataattcctttaacatatcataatggtaaacaagttaataatagttatagactttttttttttttttttgagatggagtctcgctctgccgccaggctggagtatggtggtgcgatcttggctcgctgcaacttccgcctcccgggttcaagcaattctcctgcctcagcctcccgagtagctgggattacaggcgtgtgccaccaagcccagctaatttttgtgtttttaatagagacagggttttaccacattggccaggatggtctcgatctcttgacctcgtgattctcctgtctcggccccccaaagtgctgggatgacaggcgtgagccaccactcccagccaatagttacagactttatac

SEQ ID NO: 89732 - DNA, 1251 bp, Homo sapiens
gagcccaggggacggggctcggatagaccacaacgcgccttgagagcggactctttcctcacatcctcatttttagattttctccgtttccaaaccgagagaatttggtttgacacctctcacccatcatatcctagccccgacaggcgatgactcttcccctttgtctccgccaacaccctaaacactgggcaggagccaagggctgaggaacttggcgcgcgggcggccgcggccgccagctgggggcgggaccgaacgtcctgtgggcggggcgcggcggcggcggcgggattggctggggcgggcgggtgcgcagtccgctgggcagaggcttgggccgccgagctggacccggaccggttttgggtactgtactgggggcagggcagagaggtgggcggcagttggggtgcggtgattgtagtaggctagggcgctttcgggtccccattgcagcccccggatgagcccgcagtattttccttatatgatcaggtcccattgcgggcggcgccgcttgcccggagcctgagaggattatgaaaacgtggcgagcgaaatggggccaggggacctggagcaggggcgtgaggagagtaggcagcgggtgaggctggacgggagggaggtctagggaggcctctgccgcgggcactgtgagtcctggccgatgatgacgagaccactgcgcaatctgagttctgggaaccaggtgatggagtatgttctgagaacagactgaggccgggcaagcaggaggcggccgcggcaggggagaggcggagagcccctcgataccagggctcggagggccgggctgcctagcgagggcttcttttgagtgcgtaggggtggtgggtggcatggacggtttctctgagtcgtcagcgaatgccccccctagaatcctgcttttcaaacactttggtgacactcttgcaatgttggggtgtttttaaatccaaatttgtattatgaaaacttacaaacttacagaaaagtgggaagacttgtacagtggacacatatcgacccaattgttaacattttgctatattgctatccacctgttcttccatcaaaccatcttatctttttaatgcagaccttagtactctacacccatgaacacatcagcacacattattcatttacagttctttttaaggcaaaatatccacgcaatcaaatgtacaaatcttagacaagcttcacaaatgctcatgtataggccgggcgccgtggctc

SEQ ID NO: 89733 - DNA, 1043 bp, Homo sapiens
ctgtacttacgtggttcagaaagatcattcatgtaggccgggcatggtggctcacacctttaatcccagcactttggaaggccgaggcgggcggatcacgaggtcaagagatcgagaccatcctggccaacatggtgaaaccctgtctgtactaaaaatacaaaaattagctgggcatggtagtgcacgcctgcagtcccagctactggggacactgaggcaggagaatcgcttgaacctgggaggcagagcttgcagtgagttgagattgcgccactgcactccagcctggtaacagagcgagactgtttcaaaaaaaaaaaaaaaaaagaaaaaaaagaaagagtgttaatgtatataacccctagtaaaagtaataaaactagataatgtctgagccctatatgctggacacttttctacatgcttacacggattctctcattcagtcctctcctcagcccttgttctcaggaggaagggaagtctcagcaagtgtagagctcaggattcaacacagaccttgagggggtgagggtgtcccaggacaccacagagcctgtgggagacacagacaggagtgatgggtgctttgggagagggtcacgggaggggcagggctcaaccttgagagaggggcctctcaggataagtatagaagagaaaggggtgggggtatttcaagtaaaaatagcacagtaagcaaaggtatagaggcaggagtagtgagcattgtgcctatgagacagcaacgtgaccagttggatggttttgcaaggtattgtctgagaggggtgagtgggatctgatcagggagtcctcagacactagactagggatttcagacacaatggcaggagaggggagccatgcacttaagtgggggttaaaggaagagggcacagggtaggtgagaaggagcagagcctagcatctgaggctgtagcatttagcctctcttctgttgagattggaattgctcaaggttagtgaatggggcctgtatgttccttttccctccctccttttcccccaacccctgc

SEQ ID NO: 89734 - DNA, 1230 bp, Homo sapiens
acaacgacagaaggacacaagtctctactacctcaactttacataattaaactgaaacccagagaggtttagtaacttggataaggtcacacagctaagaagtagctgcaccaagatttgagcacttgacgtgtaaccattatgctctgctcctccaaccatgcccaaatgttcttaaatttccagaggatcctaaaaggactgccgtggccactgtttcaaagcggagagcaagtgagggtttgggggataatgcttgtgttttgttcttgattttattcttaaagtggggaggaagtattggcacacttgggaagagggaagaaaacaggaaatgtggtatattttgctaagcccactgtggaagcaggagcccctttcaataaagaattctgcaaattattgtttgggaaaaaatagtgccaatgggggaaaactgcaggtacagaaatgataaatgttctctcttcacaaaaagttcaggtccagatctgattgtggatggtgattggtttggtattcagcctgctgaataattagagtgattcatagttcatgcagagtgtgtgtttgggagtccagcattgctacaaataatagaggggaggtggtttcccctgctgttttgaaacttgtgaaatgtcacattatcacctcctgtcatggtgacaaatgagctttttcactgatctcagtactgtatccagctaaatgctttcaaactgcctgttgcccccataggtttttgagctacaaatgcttttaatgcaccattcagcctaccttgctatcaaagaataataatacttatgatgataatttagctccagggagtacaaagcactgggccaagtgccatgccaatattgaaatgcttgtggccaatgtcagaaaggtggcttgattgaaagtgtctgtaggaagtggcaggagtgagggagtgggctcagtacctattatttttccttggactctaactttggatgtgatttgatgaggccatttttgatagggatttggctgcctgtttcatagtcctattggtgtgctcaaagactcatggtacaaatgtgcttggatggagtgggatgtttcttcctggtagccaaagtctggcaacaaaaggccagtgagttggtgggttagagcctgcagtgtgagttttatcaaatagttttcaaattaggactccctttcaggactaagtttctatgcattctattctatgat

SEQ ID NO: 89735 - DNA, 1033 bp, Homo sapiens
ttttttatttttacccaaatggattacactttgttcacatcctctttaagagtctgattcacagagaagaacatctaaagagatcgcaaaatacaggttgagtcttagcactgggttaattcagatgtaataacccttgatgaaagtatagaacttaaacacgttcatcccagacagcaaggactagcttgtttggaggcctttgtgctttttcgctaaagatatctaggtgcagggtggacacagggtcaagagcacagcccttgccctgctccccagcctttcctacctgccatttatgttctggtgcaggtttcctcactggggttgccaggcaagcccagtctcctgactgcactgaattgaagctgctggcactccagcgggcagtcaggtcatcttgagggaaggctcctggtttgcttgcctgtagccacaatgtcccatgtaggaagagggctttccaaagttcttccttccagttggataagactctgccattcacgggctgtgtgaccttgggcaggtgacttcgccaccctgggttttgatttccccatctctaaagtgaggggcttgggctaacagccccaagattgtgtctggcataaatatttcttgacccctggcccatcaacctgctaggggttagactgagtgaaggcagaacctgcaagtgtgctgcaaaatactacagactataatttgccctcaataaatcataattaaactgagctactgtcttaagtcatctttcctaccttctagggaagtgacatagtaatttgtatattgggaagggctgctcctttaatttacaaaacaaagttaaaacaaatacttcgaaatgtatccgtttttggtaaatggtttcttccatcagtgtcacaggcaccagtgaagaccaatggtgtaaacaagtttgcaggcttaatgagaacaacttttgagtttctaaaacacctcattaatggaaaaccatccattttttctgatatactttggtatccctcaaatgacattttttttcctt

SEQ ID NO: 89736 - DNA, 1043 bp, Homo sapiens
atccacccactgcatgagagtcttgcttgaatactgggcttggccaattccatgtataacaaaactcacagtggtaggaccttgtggtatcaggaatacactgggaatccgattctctagttctggatatcagtgtactttcttatctgggccatcgtataagagaaaaaacagtctggccaatctctttgcactcactaatgtgctagcacagttcggcctttttttttttttttttttgtctttttttgtcagggtctcactctatcacctaggctggagtgcaatggcgtgatcatggctcacggcagcctcgaccttctgggctcaagtgatccttccccttcagcctcccaagtagttgggactacagttgtgtgccaccatgcctggctaatttttaaagtttttgtagagatggggtcttgccttgttgtgcaggcttgtctcaaactcatggagttctgccctaatgaacatgaggcctccaggggtggttagaatgagggtctttgctgattccacagactctgaacagccattctggtttaatcctcttaagaattcatatatgtcttttagtaaataggcacaaggaagaagatccattgctgcagatttttctgaattgagttttggatttggctgttatatgaggagcctcttctggctttctctctgtattctttcctctggttttaagggtgaaatacatggggtggggattgacactcactaaacaataaccatttatggttgcctgtctgggatcatccacaactccatttcaacatcttgacaaaacccctcctctatgcagccatgtgacttgggctgaaacaacactgcagaacccaccagaactctggacttcttgtcacatgagatagaaatgcccttctgttcaagccaggttgaagcctcccttatatccagagcatagtaactgatcatctatcatttaattattgccttgtatgatccactgtttccccagcagaatcagcccactcataatcgtctgaatgtaccttgagttttcc

SEQ ID NO: 89737 - DNA, 1077 bp, Homo sapiens
gtttcctgtcctgacaactggagccagtgtttctagatttacttggtgtttcattcctgttctcagctcacactgggacccttaattcctgctgtgtatgctgccaagggtgccactgtgatcctcctctgctttattttcacagatctatattcataaaatgccaactgtattggagaacagtcatctaattagctggctctaggctccagataattatgacatggattagctactttccatgatataacccccagcatcatcttctgtctccttaccaccccaggcttgccttatcttgttcagctaaatctaggtacctatatgtgtaccctgagccctgaatcttttcattaaactgtcttcaaatgttgattttctttcctcaggagacttcattacaaacacctaaccctagtattctggtaatcctgatggtgatattctaaatgtaaaagatcagattgactctctgtctcttaagagttttgtttctgtgaatcagcaccccagtatctcacaacttacctaaggatgacttgataaaactgttcctgaaaatacaaagctcaagactatggattttatggtggctccaggaggtgcagaaattgcatcaagcccacccagcaacattgtttcattcattcactcattcattcattcatttctattgaggacctcactgtagtaggcattatgttcaatgctaggaatacagaaaggaaaaagatataggctatgtgatttcattaagtgtatctatatatattcaaatggtacatgcatttctaacttttttagtggacatttctgtaaaaacagtacatttatagaaattcaaagtagcccaaaaggtcaggaacacactctttgcattaaaacttctgggcaccatagaaataggaataaagttctaccaccagctttttttcttttccctcctctcttcctccctcacttcatttcttccttcttagtcaaagatctttcattatcacaactcgttatatatccatatacatatacacatatatatacacacacacatatacatgtatatacacacatgtatat

SEQ ID NO: 89738 - DNA, 1447 bp, Homo sapiens
ggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattatttcgtggctgaaaagctgaaccagcaattcaggaaatggaattcgtatttagaaacataccacatacaaaatccgaagtgggtggtttacaaatgattaaggaatgctaatttacagtaaattgcgtccttaagagggcatacacattagttgtacttattatatgtcagtttgacgtaggtactgatttgttgcatgtgctcacaagtgttctatgctcacccccactttagaatgggagtatcacagtgtcattcttaattggcttttaggtattaccaccttgctcttgactggaaatgcaactgtggttaccacctgtgctgcaggtccgtcctggttccctgatttgtgtttcctgttctgcctggatcctgattctcagaaaccagttactggacttctgatccacatcctgaccctggtccactgtgaccctcagactcttaattatgctccaccaggtcgtgccactgccccactagtccatttgatctgcccccatcctaggatatcctgagtctaagccctggtttctgccaatggcaaataggaagattttattaacaggttttaaaaaattattattattactggttatttggtttgacaaggcacttaggctccctgagctttgccttagctggaaaataaggatagtattacttgctattctatcaaccctgtaagatatttgcggccacgcgcggtagcgcaccctgtaattccaacactttgggaggccggcgggaggggcagtggggaggatcgcttgaacccaggagcaggagttccagcctgagcaacatagcgggaccccctgtctcttcaaaatttgtttttaaattagcagggcgtggtggcgcaggctttgtagtcccagatactctggaggctgaggcccaggaggacgaggctgcagggagccatgatcacgccactgcactccaccctgggcgacagagcgagaccttgtct

SEQ ID NO: 89739 - DNA, 1039 bp, Homo sapiens
gttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccg

SEQ ID NO: 89740 - DNA, 1403 bp, Homo sapiens
ttgtaggcagagagatggactttctgtgttgaaatgtgatggaagtaggatttgtcagcacagtgaggggttggctgatagagactttcctcaggtgaactctgcccttctaatggttgcctgtttcctacttctcccaggcagtagacccaggcctgccttctgtgaagcaagagccacctgacccagaggaggacaaggaggagaacaaggatgattctgcctccaaattggccccagaggaagaggcaggaggggctggcacacccgtggtcagtgctggggatgccccaccctgccctgaccctgctgtagccccaacaaccacattgacctatggtgttaattcttctctagatcacggagattttcagcctgggtggaacccgcttccgagatacagcagtctggttgccaaggtgtgccccacacagtgaggggtggggaaggagtgggtgttggccagatgtgggccctgagttttgaaagtatagccggcagtttggcatggtgtggtgggaggtaaaggcccatacccactatgctggtcacaattaatgaggggcgtgtgtgtaggaccctagagatttctcctgagatccagcccaatagcattccaggttaggactctcctttgggggtaggggaaagacttggtactctatcatgagatttgaaagaaaaagatagggagtctggtccctattttcctaaggaatttctataggggtcagctttaatatataaattcttattcagagaataatcatttgggtcttgaaggcctttagagtctccaggagacctctgggtgggctgttgcctgacattgagcaatgtgtaccagagaaatggtgctgggcttgcctgggcagtggtatgggcaggagatctgggttccgagctggctttgtgagctgggttcacacgtagttgtgtgatctctggttgccctgcacttcctggagcggcctctgtggaagggcttgggctggatctcttgagcctttcctgagcctattgaggttattaacttcagatgccttgcagaactgtccctgtagtcctggcatagaacaaagggtagatgcctgtaaggactagggtggttgggaggacagaggagtgctggctcctgcagaatattgacagaccctgcatagagccccagacactggcgatgtaaactattggcctaagcacttggattcctttgctcctacaaaccagcccaccaggctagaaaccctttcatctatacttggccaattacagaagtattgattgagttcctgttgggtgcacagcattgaggacaatgagccctgcaaagcttacccttcaggagacacaggatacctaccttcagggagcttataatctgactatgtacaagctgtcta

SEQ ID NO: 89741 - DNA, 1046 bp, Homo sapiens
ggttttcaatgtcaatgagattggcttgttaaacaagaatattggcaaaaaaccttacataacacatacggcctccaagtcccctggtttgagtcattcaaagaccatgcaaataatcatttgtaaaaaaaaatatgtattaagtaatgtgtgtttaaacagaaacacacacaaaacaaaagttcagatgctctcaggaacctaaccctgtatttcttctaggagcaatggttttgtattcaatgttcatgatagctttgtagaacgtaactaccataactaatgagagtcaacatagatgtttataagcatttacatgtgtttaagaaacattattaagtttctatattctttctgattttttaaatctaagttgctatctttccaggtaaatatcaaattacaaattactttttgtttatatttagttataatttattcacatatttatgtacttgtataaaactttcaaaacttaaaagtgcagttgtcaagaactataaagaacctgagatttcattcttaggacaagataatagtgaatttgtcagaattttgtagatgctggtaggaggggtaagactcctgggttacagatcaaagacagtttattacaacagttgcaggatccagaatacagtagtctcccccttatctgcaatttcattttccacagctttagttacctacagtcaaccaccatccaaaaatattaaatggaaaattttagaaataaacaattcattagttttgaattgtgtgccgttttgagtagcgtgatgaaatctcacaccatcccgctcagtcctgctcaagaggtgaatcatctctttgtccatatccgtatccatatccatgttctagacacaacctgcctgttagtcacacagtaaccatctcagttatcagatagaaaaaacacagtacatattacattagggtttggtactatccacggtttcaggcatccactggggaacttgggatgtatcccctgcacgagagggggaattactgtattactatttttgtgccagtttctgaat

SEQ ID NO: 89742 - DNA, 1060 bp, Homo sapiens
aatggagtggttaaaacactgaaggagggaaattaggaactcctgggtcaaggaaggggggaatgagagactactgaagtcaagtagtgagggcaagagaaatggggccctttggggctgaggatggggactatgggggtcttggggtgataaaatagagggatagaggcccttaggtcagtgacagggaggaatgagggggaaggatgaaaagtttctggattggcagtgaggagaaatgatgggttgtcagtctgaggatagagaggagtaggggattaggacactgagaataagaaacagggatccttgggttgaggaatgatgatatcctaggcccagaataggaaagaatggggtgagaatatgaggggtttcttttccatatatgggctggttgcctgtggcaggtcctagggcttgggcaagcactaatggataccagtgatttgtgtggcctggggcacagtgttgtcccttcctagagcctcagtttccctcatcccttccaccccctttcaggctactgctgcttcctgtggcctccatggctgaggactggctggactgcccggccctgggccctggctggaagcgccgcgaagtctttcgcaagtcaggggccacctgtggacgctcagacacctattaccagaggtactgggtgggtagtgggcagagtcaggagtggggtagagcctgattctggtaaaatcaaatggtgtggttaaatttatggatgaagtttaaattatgcacatacagttaatccttattagcggattttatgtttgaatttcacctacttaataaaatttatttgtaacttaaaagtcactactcacagtgcatttgtgattattcaagaatacgtacagagcagtgaaaaactgtcactcaatgcatgtatttctagctgaggctgaaggagcccttttcagctttaatactgtaaacaggtgtccttttcgtggtctgtttagtgtcacatttttctaatttttgtactttttggtgattttgctttttaaaatggtccccaagcatagtgctgaggtgc

SEQ ID NO: 89743 - DNA, 1580 bp, Homo sapiens
tccagatgaatggggcatgacctggtatgctgggctggcagaacacccccaccaaccctgggtagacagagtggggccaggtgttttcaggtggtcatgcatgttggtacagatcaggcagggctgagcattcctggcaatgaggggtagcggggaggtgtgtctggggaggtaaggccaggccaggtgggtagggctagggcaaggccgccctccatccacctggggctgacctgggccttcctcctgccggcacaggaatcgtacaagtacttcccttcctcggtgagtccagccccccagggtggggtggggcatgcgggcagggcggtcagggccagtcctgagattctgccctgcagctctcaccagtgacgccctcagagtccctgccaaggccccgccggccactgcccacccaacagcagccacagccatcacagaagttagggcgcatccgtgaagatgagggggcagtggcgtcatcaacagtcaaggagcctcctgaggctacagccacacctgagccactctcagatgaggacctacctctggatcctgacctgtatcaggacttctgtgcaggggcctttgatgaccatggcctggtgagcagacaggagcatccactggtggaagggtggaggttacagaagcagagagtatccctaatgaggagacagagggtatggaaggctgatatgggacatgagtaggtggtggggttgtcacgagcggggcaggtgggtcagtgcatgccctgcttgcagccctggatgagcgacacagaagagtccccattcctggaccccgcgctgcggaagagggcagtgaaagtgaagcatgtgaagcgtcgggagaagaagtctgagaagaaggtgatggagagggtaaagtggatgtggaaaggcagagggtggggttgagggagaggcagaggtcagaggctgaatggggcaagagccagaaagggctagaatggagcaagggtctggggtctggggctgactttgactccaccctgacctgacttgtcttgctcaacagaaggaggagcgatacaagcggcatcggcagaagcagaagcacaaggataaatggaaacacccagagagggctgatgccaaggaccctgcgtcactgccccagtgcctggggcccggctgtgtgcgccccgcccagcccagctccaagtattgctcagatgactgtggcatgaagctggcagccaagtgagtcattcctgagaggttcaagggagtcaggaagtgcatggtagggcctgaccacagccttctgtatgtctaccagtcaatcagctatccaccagtcaccaaacagccactacccactcacccatccacctacccacccacctgcccgtgtgtccatccagccaccattccgccagtcacctatttacttctccttttgccatttgcgtctattttgccattctcacttactgatcacctcactcattctgttgcttgctaccttccctgcagccgcatctacgagatcctcccccagcgcatccagcagtggcagcagagcccttgcattgctgaagagcacgg

SEQ ID NO: 89744 - DNA, 1024 bp, Homo sapiens
gaaatctgcaggcagagtggggatccctgctgaccacggtggagttgtaatggggggatgagccgccacggtgggggctgcttaaggatccgtaatgggggtgtcctgcaggagggagatggttcagacccagagcctccagatgccggggaggacagcaagtccgagaatggggagaatgcgcccatctactgcatctgccgcaaaccggacatcaactgcttcatgatgtgagcgcgggagagatgggcggggctgacactggcagggtggggtgaggccgatgggccgcgcccctcacatctccatcgcctgccccatcctctgcagcgggtgtgacaactgcaatgagtggttccatggggactgcatccggatcactgagaagatggccaaggccatccgggagtggtactgtcgggagtgcagaggtgagggccatggatggacagggaaggcaggtggggcttcaagggaggaggaggagccacaagggggggttatggggattagtgatacacgtctgtggtgagctggaatggggctccattgtgagtaatagaagatcccacgggaagaggcagctctgccctggacaggggtgcagagtaggtgggtgggtcagtaagggagcgaagaggaagaaagaggttttgggaccattcaagccatccagtgctcactcactttggccctactctctgccccacagagaaagaccccaagctagagattcgctatcggcacaagaagtcacgggagcgggatggcaatgagcgggacagcagtgagccccgggatgagggtggagggcgcaagaggcctgtccctgatccagacctgcagcgccgggcagggtcagggacaggggttggggccatgcttgctcggggctctgcttcgccccacaaatcctctccgcagcccttggtggccacacccagccaggtgagtggctgcataaagtgaatggatgtgtaaagtggttccgtttcagccctgcctgggtccatgatttctgttc

SEQ ID NO: 89745 - DNA, 1037 bp, Homo sapiens
ccggaaagagtggtggcaggtgaagtcggagacgacagaggaactggtttcctccgccccgcaaggcacacagcctgccgacgccccattaatacatgtggaaggggaaagagactgaatggaggaatgaatacaacttgatccaggtcgtgcttcggaagcggtcactttacctgtgaacctctctgcctgacaaacgggcaatgtacggaatcaaccaccaagatggcggcgcccgtgaagaatccgcaattaggtcgccgtcatatgtcgcctaggaacgtacggaattcgacccacgtacggaatcggattccaagatgacggcatctatgaggaagtcacgcagtaggtgcagccatgttgcctgtacgtcgaggccgtacaagcagccgccgtacggactctactgacaaggtggcggcgccctcgggaaagccacattagagcgcggccatgttcccggcgaacatatggattcggccaccatacggatacgataagcaagatggcggcgcctgaggggtcttgggggctctaggccggccacctactggtttgcagcggagacgacgcatggggcctgcgcaataggagtacgctgcctgggaggcgtgactagaagcggaagtagttgtgggcgcctttgcaaccgcctgggacgccgccgagtggtctgtgcaggttcgcgggtcgctggcgggggtcgtgagggagtgcgccgggagcggagatatggtaagtagcgggtccagggaggggttcggcggtggaggtcggtcggttggcaacagtggggtctgtcggccgactcaggggtctgtggtgagccataaccggagtctgtggactgaacggcgggagtctatgggcagaatgatgaaccatctgggagttctatggtgagccacggtggggggctccttaatagaagtttagtggggactccgtgtggcagttccgtgggaaaccatgatcgggggttcttagggcagagggataagcgggttgtaaggagtcacattgagtggtctgta

SEQ ID NO: 89746 - DNA, 1013 bp, Homo sapiens
aattgcaatgtgattatagtgattgttccctgaaaaaaatccagtagagaaaaatattaccaccatccaaaaacagctctagaaaccaattttttattgctggattcattgctttttcacttcattctgcattttcggtactccagtcaatgtggtttttttttttttttttttttgagacgagcctttctctgtcgcccaggctggagtgcagtggcgcgatctcagctcactgcagcctcctcctcccaggttcaagcagttctcccccctcagcctcctgagtagctgggactataggcgcgtgccaccacgcccggctaaatttttgtatttttagtagagatggggtttcacagtgttagtggggatggtctcgatctcctgacctcatgatccacccgccttagcctcccaaggtgctgggattacaggcatgagccaccgcgtccagccacagtcactgtgattatggttcactgttttccctgctctttagaatatcttaaaacacacatggggaggacagagacttatttgtgagcacttttaaattttaggaactctgtgaatctcttgaagaagattacaaagacatagaacatcttaaagaaaacgttccttcccatttgcctcaagtaacagtaacccagagctggtaagtgtatttataattattcttgctatctggatttataaacccatgaaaacaagttcttcaaagccttttgttctttcatatacttgcagttttgtcagcgatgatctagttttttgtcacctatactaaaaacagtatttccatgttcaccagttttcttatcttggtgtctctgaggaaaatctaacacttctttcccagtttgccaagggcaagtctctctagcctctcttttttcactcatttctttccctgagagcagtttgtcaactgacgtttgttccttgacattttaggcaggttaattttttgttatgagaataggacattgagtagtgttcttgatctctgc

SEQ ID NO: 89747 - DNA, 1049 bp, Homo sapiens
gcagattgaatccaggggtgacccatgatcattgctggcaactaaaatgactccgcaatacacagggactgacatgagcaaccatcaggataaattagaataaatagaagtctaagataactgatgtttccagattcagagttagggacgtcaggaagacaagctgttaaggggttagaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaattaaaaaaaaaaaaaaaaaaaggaaaaaaaaaaaaaagagaagctattaagccgtaaagctgttaacttactgactttgaggagctggtgggacaactgatgaagatatcatgttacacgtaaataaatgtagctatattactgaagatttgggaacttaatttttcaacatttccttcaccgtttaatgttcatgaacaatagacatagggatagaaaaaaatgttggcaataagattataacaggatgagttacgtatttaatattattttcagttgggaaaactgtcagtatgctgcttatttctgaaaattgcctgtatgtatgtacatctgtattctgtagtgttaagggatcagatcttgatcctgaagaaccaatcaaagttgaagaacctgaacccgtaaagaagcctcccaaagagcaaagaagtattaaggaaatgccatttataacttgtgatgagttcaatggtgttccttcgtaagtatttaagataaataatgttcaaccccttaataaacataaatgatcgtttaaataataaagcttaattatattaattgtaatatgctatgttcaaatattgatcttttaaaaaagtttcacattatactatgaaaatgcagtaaattttttgaagatttttgt

SEQ ID NO: 89748 - DNA, 1023 bp, Homo sapiens
gataatagctagtcctgttgatatagctacttactgtatggcagagagtgtgccaagagcttcaatccttacaacacccgtatcacttactgttattactcccaatttgtagactaggcaaagagagcttaacttacttgtccaaggtcatccagttaaatgataacactgttacgggttttattcttataaccactatgtcacattgcctcttgaaaagtgaattgttcaagcgataccaacagatagctagtgacctaataaatatcatgcatgcaacttctgttgatagaataattattattttagcaagaatactagttcttggttttattggatactaacagtaaaaacgactaataccattcatattcacaacttaatgtattaaagactcttttgcaagttggccttataaaaattagcactaatatctttatttttaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttgagacaggatcttgctttgtcacccaggggcttgctttgtcacgcaggctagagtgcagtggcgcaaacatggctcactgcagcctcaacctcccaggctcaagtgatcctcccacctcagccccctgaatggctgggactacaagcgtgcgccaccatgcctggctaatttttgtattttttggagagatggggtttcaccatgttgcctaggctggtcttgagctcctgagctcaaacaatccaccctcctcagcctcccaaagtgctgggattacaggcttgagccaccacacctgacctattctt

SEQ ID NO: 89749 - DNA, 1950 bp, Homo sapiens
gtgttgagtgaacaatgctgcagaccctaataagattgggtacagatcggcatgcgcctgtagtcccagctactcaggagaattgcttgaacctaggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtgataatgtgatataataagaaatatatatttgatcttcctatctagttccttgttcagagctcctaaaacccttgtaatttccaaagtgatggagtacatcttttgttctagtatttggtctttgaccccagttcctgacacaaagctcctaaattcctttaaatttcccagtgataggagaattttttgttctaatgaggtcactcttgatgggcacctggataactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaacacaagtaaagcatttccctgagttctgtattgccgtatcaaattatcaaacctgaggagggggttgtgggaacccccatgtgtagccatgttggacagaagtatgggcaacctggggacctgctagttgtgactggtgtttgaagttggggatggttttatgggactgagcccttaaatctgtggggtctgcatcaactctaggtatttagtgtcagaattcaattaaatataggatactctgttggtgtctagagaattggaaaattggttgggatggggaaaaaaactccacacatttggtgtcagaaatattatgtgaatgtagtatagaagaaaacaggcttttcccttgttggtgaaaaacatgataaaataatgtgtgggtaggttgataatagtcaagaaaaatgggtaatgggattgtaagaacttagccatgtttctctcaggcacctggggagactggtctgtctatgtctgtgccatctgcttggcaggcttgtccctgtagcagagaaaaaatgtgtctcaccaagcctgtggcctggttaacaccatcactgtgatgaacacacagacgctgcatatttactgttatccttttgttttccttaatttaaatacaggcatgtttaatttttcatgcctcaacttaagtgaaaataatggcattattctttattttaagtattgtttgatttttgatatggtttggctgtgcccctacccaaatctcaccttgaattgtaataatccctatgtgtcaagggcagggccaggtggagataattgaatcacgggggtggttttccccatgctgttctcatggtgtaattaatgagtctcacgcgatctgatagttttataaatgggacttcccctgcacaagctctcttgcctgctgccatgtaagacatgacttgg

SEQ ID NO: 89750 - DNA, 1051 bp, Homo sapiens
tccgggagggagggggcgccgagaaggcgggaagcggggatctgcctgagcccggtcgccgccccgccagccccgcgcggctgcagccgccgggggcccggtgggagggtgggtggggagaaggagccggcggggaccggtgggctctggaaccggggagacccgcgcgcgcgggaaggggcactgggccgagggtcgagggggcgcggagcccaagtgcaccggtccccagccggcctgggattccgagcgggccgcctgggctgtgaatctgtgctcattggcatgaccggaataaaactaacaaaagagaaccaacactttgggatccagaggaaagggacagaagaagccactggaccctaacactggtaataactggtgcttctgtggtgccttcagcgagcccagagctgtgggcaccgatgagggtcgtcactgaacgcggtgcgtcccgttggaatggttgaggcgctgcttttctaggcatagaaaagtctgataacctaaatattgcataatgaggtcactggtggctttagctgcccatgagccttctcctctcccaactcccaaagccttccgagtgagacctgcgttttggcactttcatagggtctgctgtgtactgcagttattcccgcttcgtcccccacctctacccccagaccctaatacaattccagacgcttaataattgttgcaagaattcgctgtcgaattttagcgtgggcaaaacataaaaatgaaggattgtgggatcatattggaaaatgcactaagggtttgcacagtgatggtggtatgaagggtaatgagtgttggctgccattagtacatagttgcgctgcgactcctatgtgtgcaggtagtaggtttaggatgatatgctaagttagagactgcagttatcaggaccttcattaacctcagagaatagttagggataaggaaggagtgtgtaacaagcgagtgtgtgtatatctgtggtaagacattccaatgtgtcttccccaaagagaacattttaacattttgcttccttgatttt

SEQ ID NO: 89751 - DNA, 1048 bp, Homo sapiens
atacagcgtcctctcccctcgccacccgacagaggcgcctacactggcggtaggtagcccctgggagagggggagtggggggaccccgccgctttcgccgctgggcgacccagagccccagcctgccggagagggcagcggctcgggtttgacatcccagctgggtcccgggccggctccctgagcctcctcccgggttgctctctatcaggaaagcaatcggaagtcaggccggcttttgcttttgttctgccagctactctacggaatcgtaggtgaagccggggtgggcggatgccccgggagggggctgtggcgggagttccaggtgcgtccccgaaatgaccattggaggcggcggctgtttcccgcccctgggtggggaatggattccgatcgctaatcgataccctggagccagcagtgggtcagcagcgtcccgacagagcgcagcggccgcgtactgtcacgcgcctctccagcactctcgaaagcactacctcgagacgtgcatttccattcatggatctgtgcctgggggttgattaatgtcacccctgcctgggttgaggagtgtccacaactgctcagtagccatttactgggaggttactgtgtgcaaggcagctatcttaaataaccttaatgtaaaatatacttattgagcacctactatgtgaaaagcaggtatactgcagacttttcaattgaatggatatgtattgagcacctaccccgtgcgaaggtgaagcgtcatgacgttctcaatgtaacagatatttattgagtacctactatgttcaagatagctatgctatgaccttattgtaatatgtatttactgagcacctactaaatactaaaggcttttttgctgaagggttgcccagtgtacttttggggtacggatagaaacaagggagagaaaatataatatcttctgaacctcgagtcttcaactcctttagtgacctgcgttttaacctttccaaaccgcttgtgtggtgtatgaagggctagtcttctacacttgagggtacacttctat

SEQ ID NO: 89752 - DNA, 1536 bp, Homo sapiens
acagacaaaaagacacctcccttttaatgctactgtcataccgtgcttaaacagctattgtgggaatactcagtgctttaaactaaataacaaagcaaccttggatcatctgatccagaagttctagacaactgacctaactcctagaattctgcttttgagcagtgagggattaattgtaatttttcttcatgtcagaaattaattgcatgtatttttcaattactaaaaaaaagcaaacaaatagaaattagtgatttgtattaatccagaacctaatctgctttaactcaattactccagatgcgtgaatctcctgttgggttggttgcaagttgactcaaattcgttgtttcacttttgctgcaggttaaaagtctgcctcttacaaaccctggctatatcaccctcttgtttctaactaaacaagattttctcaaataaacttcattctgcattttggccaataaaaaaaaaaaaaaaaaagacacctcctaaacaaggaaggaaccaataggggaagggagagggaagcatgaagacagggccagctgaaccttccagcccctcactccaaactgataccagtgatgttggggtgagagagtctaagtcccatcattgcccatggctggggccctaggactggaattaaatagttttcctgctaagagatttgatgaatctgttactctgataatcttaggatcttgagatgcactggaatatccagattggcgagaaaatcatatccattagcaaatatttgagtatttacaatgcaatataggcatttatcagggaaatgtagtctaagacgtagtctttgtcttaaagaactctggttcatgagataaacatgtaaaatgacaacttgggcagcatatatgaaaagccaggagcaaattcctcctggaatttgacataaaaaatattctcaccacatggaactgtggtttttctcttatcagacattgagaactctctacgtgccttgtatgtttatctttttgccttggcctctagaaattcctggtaatggctttatcccagcttcttggtacaatgatttttttctccctaaattatttctgagacctctcttttaaattctttataaaaaactatattacaggatttttgttgtgaacttgaaagcctctctgaaatcttttctgtaagtaagcccgttatgaaagatacatagaaaatatggtaagtattagatgaatgtgctcataagaaaagggggaaaaactatccggaatttacagagaaaacaaacgggctttgcaagatgaaataggattcagatgggcaaagacaactaacaaagactttcctcccaaattgagggaaatagcgttggcaaaggtgtcaaggaaaacaaaccgaatttagagtactttaggtatttgatagatcttcctctggaatagtttccattcactcaacacacgagtgctgctggaacattttactgtgtcaaggactaggctaggtgtcaggtggggggcatcacccagaaccaattga

SEQ ID NO: 89753 - DNA, 1081 bp, Homo sapiens
tgcttatgtaatttgatggaccctctttaaggaaacgacaaaacgataaggggagcacattgctaggacccctcccaggccttggaagggtcctgtgaggacaagtgatgggctctgaatttaagtttcattagcttcttgggaaagcagtctttgggaaagcagtctttgggaaaggttttgaggaatgactggacagctgtgtttgcaagaataggaagctagtcctacctgtgactgataggagctaagagaatgttctcaaagtattgacttaaattgagagcacagatcaaaatggaattgttaaacctagggtgacctatacttctgttaacatctgccctcaaaagtaagaacttctgtatcgtcagcagccccaggtccacatgagcagcatcataggtgaaatgaggggcagggatcgttccggtttagcaggaggctctgtgttccactagtgggtagtagtaacttactgcaccttgtaaacgaggttggtcagtgctgaagttactgcctcgggaaatgaatgaaactctttttcaggtcactctaatggtatttgaagagtttataacaggagtacgttgattcaaacttttcttttggaatacctgagcctgggatgagatgtccttgcattaaaacaggccaggcaggaaacacttgccccctcattttggggagcaagtaatttaagtacagttgtgtgctacataatgacatttcagtcaatgaagggctgcatgtgggactgtgaaactgtaagattataatactgtatttttcctgtaccttttccatgtttagacatatttaggtgtacagatactgaccactgtgatacagttgcctacagtgttcagtacagtaagcatgctgtacagagttgtagtctaggagcaataggccataccatatagcctaggtatgtaggctattccatctaggtttgtgtaagtatgctctatgatgttcccataaccaggaaattgactaatgatgcatttcttagatggatccccatcattaagtgatgtatgactgtatgactttaagaacttaaaataataaggct

SEQ ID NO: 89754 - DNA, 3639 bp, Homo sapiens
agagttcaaaagagaattttaattaacttcttaaggttttctggggtatcagcaatagtgggtcaattttggggcttcagattttctagatcacccagatgacatgaagccagactagtttactttttgttctgtcttacttctagggtctatcagagggtgtccaagggagacaatacagtcgtgggttcttagtttccatttctggttgggccagtaaagccccttcctcatccttgttttccgcttatcactaaagatagaaactaaaaaccatggcttcaggctgctaaaagcctaaaacaaaacagaacaacaataacaacaaaataaggtgggttagacaagcttggagctctttggggtcctactctaaatgtaaagcggtttaccaggcctcagggaggccctggcctcttgattccatgaggccgtcaatacgctgctcagcttcctagcttcctattttggattgacaggcccagcccctccaactgggtaaaagcagcccctagtactgaggcctacatgtctagatctctttcttttctcacatcttaaacctgaaattcctccctatcttgttagctttttggtgcttttaggaaggtttgttgtttgtttgttgttaacctcatccagctttctttgttgtgttcactgggaaagttggctcaaattacccagttcactgctggcaggaggtgggacccagtcagatcatcttagagactgacaggagagaaacacaagtgaccagctgctctttgcctgactgtgactagagaactttatctgctcccaacacaacaccctggttgcagctggaaagcagaagttgggatggatatatttcaactaactggacatagccacatgtagatatatttccctgcatagatgaaactaattcctcaggctgttcctaataaggcaggtgatgtggctgagaaggcagtcacaggagtgctacctggagccccatctcgaacctgcttcttctcacctacactgtcctgcaaaagatgggaatgtaggaccaagggaagtgttgaggcaggaagatgttttctctttcagcagcttttaagaagtaaaaactgtaggctgtattttagctgggtaagtttccttccattcaaactggaccccaaaatgttcatgtttaaggcagaacttctcttccatggcccagacaattccttgcagaggctgaaccatcagatccaggctcaggagtcaagacagcctttccagatgactctgcttgatgctaaggtttggagctttatgatagtttttggcttttagaatgcttttctgcatgctcaaccacgtgttcttggaatcagcagccacatctattttccccttactttcctccaactcttcccccaactttcaagaagccagagaagtttacaaaaagcaaagtgtatttcctgagtttgaaaaggctggacaaagggagcctgagtggtgggaacttctcatcctccaccttaccagagcctccattggtttttggggtgtgggagtggggtggtggcggcttttatttttatttttgagtacctttttccctggaaattttagagctgagctatcctctcagaaaatcactgtctgcccagggaaccatagcctcctccctcacccttcaggtgtgtaatcattgggtaaagagaagggaggtgtgggtgtgcccctctagaaagggccctgtcttagggggaggtatcccactgactttctggagaccaccgtataccatggagccttttatgtattccacaataatttaccctgcggatttttaatttcacagtacttcacacataggaaggactatagaaaaattagtccaccatattgctagaaatagaaatcctccaattcgatttcagtaactgtccataaaagaacaaatctgtaaccccactcccaggtaattctagattgtgaccgagcctttggaagaaatgaaaaatgaattaattaattttgaagaggcaaattttctgttctcctagaagatgtgcccttccatgattatttttggaggcagaatggccagaaagccctaccagccataagaatttatgaaccatgacatttgaaaactttcagcctgagatgaagtaaattaattcctccagcatgattcactttaggtacaagcccaaatttcttttatcagtaacttgggctcttaaggtgatttttctaaagagatatagttatttgagacccatcagggccattttctgtatttcttttgtcaaattttccatttatgtggatttgagttttttccagttatttcgagaccatcttgtctgctaataagagataatatgctgccttttcaataacatatgtgaaagccacagggagttcagacaaagttagctgagcaaattcctgtacttatcagagaccatgacatcaccttcagtatgcggtgggctttttaccaagtgtccagcacctttaaagaactcagaatggtaaagtattatagctcattcaatagaaaaaaggaacagagaagttcagaaatctgaaatgattttatttgtaagaggagaataaggaagatgattactgtaaatcacataggaagaggaggtgagaaatatgtaacaatggtgtaactatggtggattgcttttagctttccagatcagaggtgagaaaatgaaaaatttcttatgaattattatgaagtttcaatacttgcagtgtaggactcgaagagggctttaacgacccagccatctgctgtgtaataaagccagtgaaatatgctccatcaaaatgacacagagaagaacgttagggtacacagagtaggagcgagagttttttacactatgaatgagaatatatctagtaagtagttctgggtatgttgtggcctgaataactgtccatttttttatactttactattttcttgagctgaatggagactaaggacaaaagaaagaagactcaggtcattatgaagtttgttgggtctctgcatgattccaaagtgataatgctctcagttgaagtacttagttaaaagctcaaagtcttgtttccatatgtctatacctgctgtcatttttcaaaagttattcagtgaatttgttaatactgaaacccctcctttcttatcagcagtctttcttctgagattctcataagattctcaatcttatgaaatgcatttctgaactagaggcagtaaaaaaaagtccgttgtcttttctttccagtttattcagaagcaaatctccagaatcaaaaatctatccaccatttacctgctgaattttctcccttcgttaaccaacaaacaacagtgttttgctctacaatttgagttcaggatttggcttctatattaagtaaccttctagttttctcttccacctctgctattgataagaaataataatcacattattatttaattatcaccaccaaaagcaacgtcagatttcagtaatctaaaactatattgccttaaacttagattatttgaaataagatctttcctctccagtaatggatacctagaaaagcaggtgtatagctgtctatacaggggacacactcaggagcatgtacagttatgattatggg

SEQ ID NO: 89755 - DNA, 1037 bp, Homo sapiens
tgtatgcatctcccatacccagccctgtacacagaaaaattgtcttccatgaaattggtacctgatgccaaaagggttggggaccactgctctagactaatttctcattagaaattctggtttttgttaatcatcagaccaaaatctataggaacatatggtcaatataggtcacatatatcctccatggttttgtgtaacttatattctgcagcattttttcaagtcctcttataccaatgtcttctttgagcctcctagtggtgctgtctggtattttgagccagtattatatgatttccattttacagaggggaaaactgaagctacgggaagatgtgtggcttgtcttagatgatatagttactacctgcttccctagtattccaggactagaagccacttctgattccacatcggcgttcttttatccctggtaaaaagaattttgctctttattctagacattctttttttaaatactccaagctgcctcctctctggttttgtgccattgcatctatttcattctgtcttgaatcatagttagatgattgttttcctcattaatttcagcaatataggctgtctctctttttgtagccttactgtgtctagtacattatggcacatatattcattccttagtcttttcttttatggaattggatttaaggtattttctcccaaataattatacatttctaggaaaacaaaaggaataaatgaagccctttctacaagactaatgtcattgttcacaagagaattagaatcacatgttgtttgagttggaagaaaatcatcgagagtatttattctcttgttttacaaatgaggaacctgaagatcaaataacttctgaagatcccacagggaattagaggtgacatggtatacagagcccagttctcctcacttctagccgagccctccttttgctgcaacagttattacagagattgaccatcaagttttagatgaatggtcaatgctggcaaaaatcaggtcatgctaaattaaaactacaaatgtga

SEQ ID NO: 89756 - DNA, 1081 bp, Homo sapiens
caggattttaaatactgtgtgtgcttttggagtggcaccaggcagcaactattatgcttccccctacatgaatattgtttttcaaggaaaatgaagtttaaatgaatgtcaagggcaactttgaagcagatgagttacaaaaatgcaaccacttgagaggtatgtgtggaagtggagtgggacagtcccacctccttagtctagatgagtttggggaggaattgttctctgcctgttctgttttcttttttggtactagctgggagtcacgcttttaccttgagagcagattaaaagccctgagtcatagcccagccacctgctggcagctacatttccccacctcccaggcctattccccttcaatttgggggcttacccagggaagtctcccaggtaccctcaggatggtgccagtgctgggcattatggagtcagtagggctgtccaaaataggtgagacccactccatgcccatcacagttgcacaccaggtgtgcatgaagaaaatggagaagagggtgacagtgggctaattgttggctagggacaagtgcaaagggtgttagaaggggagtgagttctcatccattcctggcccatcttaaaagaaagcaacagtgatggattttacttgtggtactactcacttcaatttggtgatgaaaatttgatttgtggtttcctctcacagggctcttcatcacacagtaattgatacatctccaagaagctcttgaggaaatctattccaacaggtcccatcagcacccagggagcctagcagggatctcagcaggctccacctcccctgtcatcccccttcctccttcagtctgtggggtttcatcagaagcctgagtaggctggaggaggaggaggcaggggtcacaccaaagggattgaagaccagtgttggcaaacggtctgttctcagtagtaggggcatcaagcaataggtcacctttgttgaggtggctttgctgctcaaaaccaacacagtagatgtgggaatgggctgcaggattgggagccagcggctgcctcaggtgagaagggtgagaagggcaggtaagagcag

SEQ ID NO: 89757 - DNA, 2064 bp, Homo sapiens
agataaattagaatttatcaaaaccaaatatgtctcttcatgaagagctgttattaagaaaattaataggcaatccataggctagcaggaaatatttgtaatacataaaaatcaggccttaaaatgaaatatttgaagaactcctactaatcaataataaaagatgaaccactcagtgaaaaacatggcaaaagacttgaaaagacatttgatctacaattggccagtcaaggatttaacatcatttgtcataagggaaatataaatgaaaaccacaatgggatactattcacagccactagaatagctaaaatcagaaagactggcaacgccggatgttggcaaggatatggaatgactggaacacttctagagtactggtgggagtataaagtgatacaattatcttagagaactgtttggcaattcttataaggttaaacatacataccctatgacccaaccaatttactcttagttacacaagagaaatgcaaacgtgtccataaaatgactcatatgagaatgtttatagcagcttattcataataatcccaagttgaaatcaacccaaagttccgtgaaagcagaatggataaacaaactgtggtatgattttgaaaaatggaataatactcagcaatacaaaggattaaaaacccaagatatgcaaaataatctccaaaacataatagtgaatgaaaaatccaggaaaaaaacataccttccaaatgattctatttacaagaagttcaagaacaaacgaaactaatacagagtggtagaaatcagaaccgtcattgcctttggcgagggtgggtgggaattgactggaagagggcatgaggaagctttctggggtaacagacacattctatatcttgattgtggtgatggtcatatgggtagacacagtcttcaagactcattaaattgaacacttaagatctgggaaaattctacctacatgttaagagataaatggtaacatgtgaaatagaagatattatgacttattatgaacagtgactacagtagttttttattctcatgatttgaactttctgcttctattaatgtagactgaaattacgttagctgtgtttttcttttttggcagcttcatcacacgctttccatttattgtatttgtggctaatggtaactgccaagtttctcttctttttagacgtgaattactgccaagcagggctcctttatgaaatacctgcttcgtttgtctcagtgggtgtctatatgcaggccttgaaggaatgaatagaactcagataaacaaaggtgggatttctgaaaggagtaatgctgtaaataataagaacagattcccattaaatagtactcagcgctgggagcttttctagggcttcacacatgttcacccattcaattctcacaactccatggataggtgctattgtcatccgcattttctccatgggctgacttgaggtacagtgaggttaaatgacttgtccaaggttatatggccagtaaggggtgcgggtagagctggagtttgagtcctggcagctctgatgccaaaatctgtgcttcttccgcctgtgctatgttatgcctggcccctggtttgcttcttctgtttgatgtgttgactgtaattgacctgggatttgatctgtctctggttaatcctcttacaatagcatgagcctaggtcactcccctaaggaacatcatacccagagcattttatgaatccttcatgagaattctcttgtgggagaacctgtttatgaaggaacaacactgggttcattagaagagtggccctgatgagctccagacctcattacaggtccagcacagtcctctctgcagtctctcttgatgcacctaagtgcaaagaattccttaaatagcatccattggccataaggtgcatgatgctattctatgtatccaccaaaatcaacatcagtggtataatgtcagataagggaagcactgcttggtagcaattcatgtccaaaaggaagagaaacttggcaattatcattagccatagattctgtaaatgacaag

SEQ ID NO: 89758 - DNA, 1065 bp, Homo sapiens
agacaatttaccaatcttgtattgcaacagccttcatctattggaccctataataagaagccacataatgagttcttataatttgcaagagctaccattgaagacactatccattatgctatttaatatccctcacttaaagtctcatttaattaatttttctatttagtatcatggaattttttcaataaaattatacctttccctaatcaaaaatgagcattacataaccaattacatttccctttttaccttgcccgttggaaaccaggatttacttgatacttgaaaatataactgttttgactgaggatcatggtggataatgtttactcattctccccctgctcctccttcacccctgaggattcagatatctgtttctgactttaagttttaaatgtataacattttattgtaggtcactgaaaatccttcttggaagtagataagatgtcaattataatttataacttcactaggccatgtgatagcaagtcagtgagtagagtggagttaacattccgagcttctgcttccctcatcctggttgagagttcttgttgtttatcatctgagagtgtcatccctcagtgtgggataccttgaagatacagatccacttccttttttttacaatgacaactcaaggtgttatctttgttctaaactcacttcatgcagggaccaatgatccaaaagagagattttgggggccatcagatttgatgaaattagtcacagcagcagatgctttttatcaagcacttgcttgccagacattatactgcccattttgcatgctgtattatgtttacccctccagcctgtgagatatgtcttcttttttttattttattttattattatttttgtttagtatttattgatcattcttgggtgtttctcacagagggggatttggcagggtcataggacaatagtggagggaaggtcagcagataaacaagtgaacaagggtatctgggtttcctgggcaggggaccctgtggccttccgcagtgtttgtgtccctgggtacttgagattagggagtggtgatga

SEQ ID NO: 89759 - DNA, 1027 bp, Homo sapiens
gtctgcgtggtgactcctgacactggctccgaggtagggttcccgggcagtaggggctggggagggggaaggcctgcttcccattgtagccctccccagatgctgagttgcagctagttcagctaattggcaagaaaaggagaagcaaaaatagtgaaaatctgcgaattaataaaacagccttgaagcaaccgccaaaatgtgtacaaatcatgaagtaattagaagtgtgaagaattctatcgggttcgctgtttccaaatccaacatctgatcgctttaggaggccaagggctggcaggccacagggagtagaaattctttccattgccgtctgatctcgcctccctggggcctgggttcccttgaaatccttgcagggtcctggaagtttccatgggacttgctagaatcaaatgttggccttttgggggcccgttaagcacacgcaacgccttatccaagtagcatgtaatattttagaataatgctgttaagatttcgcaaagtgttttttggatccatgttcttatttaatctctcactatcaccaaatatttttatgtcagtgtttttcagaggagggaagcaaggcccagagagtgaagtggtgtcaactcaattttaagagcccatcaggagcagaactagggctagagccaggatcttctgatagcccctccgacctctcctctcccacccacattcctcctgtgggctctgctgcatcactcaatggtgccaggcatttgtctatcacaattgtctcagctaacagccaactactgttctctctggccatggtttattacatttaggtaagttgttcaacccatttgtttgattaataaaataagacccaggcacatttagtgatttgtcgatttttcattttattttatatccagattagactggggagaaaagtatttcttttctttgtccttctggaaacacattatagaaagagatttcagggctgaagccttgtggtatacctaatgcggaagggtagaagcaatatgtg

SEQ ID NO: 89760 - DNA, 1035 bp, Homo sapiens
cttgatctcctaggtatgggccctactgtggttagaggcttccaaatggggccccagagtgtcaaacctaccaagtatttcatgccgttgaggggaaaaggtggcatttcaggtggccttgggttaggtcccctggggcggcggcctcctctttgctggcaaaagccacgtatttctctccaaatttcacgtggctgggagttaccgtgggcattctgtggattgcagactctgtgtttcttctcttcagtgaggggaggccaattttctttttgttgctgtttgatttccaaataattagatttgcaaagttcttttgtgttatgtcagaatctgtcattccagtgcccgtctcaaatgtcaagacgctgctcctgatctttcccttccaaatgagtcatccagcatcccctctgcctgtagtatttccctcaaccttgtctcttgcattctttcatgttctgtcatgttctgtgtctcgttatggaattttgtgagttatattatacacctctggactttaatcattccttaaggacagagactgagtctggtttaatttttttttttttttttttttgagacagagtctcactctgacatccaggctggagtgcagtgatgcaatctcggctcattgcaacctcagcctcccaggttcaagcaattctcctgcctcaggctcctgagtagctgagaatataggcatgtaccaccatacccagctaattttcatatttttagtagagacagggttttaccatgttggccaggctggtctcaaactcctgacctcaggtgatccacctgccttggcctctcaaagtgctgggattacaggtgtgagcaactgcgcctggcctgattttttttatatataccgctgtgctaaaaacacaatgctataaaaacacaatgctattttgtttttgttttaattgtctcttggactgatggagtaatttactaaaagccttaacaaaggttaaggctgtagtctggattcctggacaataaggaaatgggtgtgccgag

SEQ ID NO: 89761 - DNA, 1042 bp, Homo sapiens
agggagctcttcacctggaggctgaccagttctctccctctctcaccatgtgtactgtgatccagtggcctcccacgggccctgaccatcaagactaagagggttgtgggtgtgtggaatgcgctatgggcctgcagggcattccttgttcctaggagatcaatgcgctccctggtatttctcctgctagaacaaggagccaagtgcaaaagcaagtgtacaaccacgtttcctctccagcactcatgtccctaccatgtgatctctgtggcatgtgggtctgactctcagggtttcataatctttccatgaaggaggcacccacagaggagggcagcggacacatggcggcagtcaggaagttagaaccgagggaatggtgtcaccataatggacttggttagccagttggcaattcattgtagattcattccttgataccccacaccacaggctggatgtctttgtgtgtcctggaagaggagatagaaataatttagcctgatgctcccgccagtctccattcccaactctcacagaaaagaaactcaaaacacatgtgcagtggtttcacctcttcccgtgtgaaggccaccctactattggaggtgtgttgagacttgcccaaggcaggagaaggggtcacactaccagcccctacagcccacttaattcgcgatgggtgctgttcactttggtataattgggttgtggtcatgactgtacttatttctggaagcacatctgtattgccagcccgattgttcttctctcatgagtaagtgggcagtgttgttattcccacctcacagagatgagacttcttgctggagtgctcacaggcagcggcaggaccagaatccaggcctcctggctccctggctttcctggactctgacagccccgtatggtccagggattgttgacctgacctgtcaaaatagatttcttcaccagaaaacagggagatgcaatcgctgggagagggatcacttttttctgctttaggaatgatttcttgttgcctctgagcaaaacccct

SEQ ID NO: 89762 - DNA, 1110 bp, Homo sapiens
aaaaaaaataatgatatgcaattgcctctttttgctatgcccttgggagtcagaccaggcttgtggggagaaagagaagcttcagtgtagttgccattacatgacttgggcagcaggagtcaaggagggagagaatggagagctgtggaggctctttgattcccctgagttaggtatccaggccaacttcgctagcacaggccatagaatctggttcactgggtgctcccagcactgtctcttagtggctgggcatcctcaaacagagtgaatggtattcatttatccattcatcagatggatattgaccctatgtatgctgaaagcactaagctggtgctctccaagccttggtatcctcacctgtaaagttagaactggaatcagaatcgatgtttctcagtggaagtgctgttggcattcaggggtggaggggtggatgtcagtggatgtgctctgggcatttgggcatggaggtgggaatgctcggtagaatggttagcaaatccggccctacccattaaataccagtaatgactcccagtcaaataaggtgaggagggcagtaccatctccagataaggaccacgggccttgttttcttagatttcttcccaatctgaaattctgtaagtctatggttgttttgttcctggacccagtaaaaacatgcagaacagaattaccgaagatctgacaaattatcagaatcttgagtacatcttattcaaatgtaagggaatgtttaactaaacagcaacaataggtaacatctgttaagcaattactatgttctagacccttggcaaatttccttcattagaagtctttacaggcgatctgattgtttactatttcagatcatctgtgtcccctaatttgcccccttaatttcagagcattgagttgactatcgtttttgcttcatttatctttgcagagttgtgcgaagttcagatagcaaagtgtctctataggaggccctgcgatatgagaataaagcagcagtctgccaagttcatgcctttgtgttggatacagtcttctttctttgtgtgtctgtggtctttatgaacttagaaaacctgccagtctcttagacgctatgat

SEQ ID NO: 89763 - DNA, 1071 bp, Homo sapiens
agcgctgatgtgtgtgtttggagagcataaaacaaattaattttccgaaggtcagaagggataattctccaccgtaatttgcacatgttaaacttgggggagcaggcactgacataagaggcacagcatctgatggtcttatcaaatcaatccatcttctgtctcttccaggggagtgctacgcacagcaggagggtggctgggcagtgcaaagccccggaatcccctgagcaagcagtgtttcagctggctggacagatcaaataacacttgggctggttaacaaaagacgcaagtgggaaggtgttggaagccggagtgtggaaatttacccaacgttatttctttgacagggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccaga

SEQ ID NO: 89764 - DNA, 1028 bp, Homo sapiens
gcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaaggtatgtctggctggaatggcggatactggtggtccacagaatccccaagaatacttgcagcattcccaagctattcctagctccatggtagtcagaggactagagttagtaattaggggaggctggagggtgctaggaagatcactagcctgaaaagttgttggaggcgtggagggagatctggttcttggtcttggctctgctatgtggctttgatcaccctgagctgtgcctgcagaagctggactagacgatctccaaaatttcttccagctctaaattctatggcttgaaaactatgtggttggtgaatttgcctctagcatcttcttatccctgctgtccacttagccatcccatgtccttcctgtgtgctcaggacacaccctgaggcttcccaccctgtgagcctcatgctctggttggtctcacctccctcatcccatccaagctgacccattcggtgtccatttctctcagtcagtggacagcaggcacaaattgttgatctgatgagctaatccttcactgtaccttatccagctaatgactctgttctcctgggtcccgtgatgctcttgcttctcagtgtgatgtgaaagccatgggtggcagacggtactattgcgattccccgtggtgggtgc

SEQ ID NO: 89765 - DNA, 1461 bp, Homo sapiens
ttacctttccaaagcaggtgaactcaagacctctagagatgctggttctcaaatacagctacaccttggagtcacctggggagctgtaaaaaaatcactgatgcctggttcccacccccccgcctccgcccccacagattctgatgtgattggcacagcaggagtcctgaacgtcagtttttttttttttttaagttccctaggtgcttccagcctgtagcaggtctgagagcccgtgctctagagtgccaccagatttccccttgaaagccagcgtgacagatgtctatttgtggcttgacagttaatgcatcttactaaaagaagccatttgcacaaggactggcctattaaaaattaatcactttggcctagcagggcttctcacttaaagattgctgtccattgtcatgcagcaccccaggatgctaatgccccacagaggagaacttgtagcccctccagcagcaaaatcagataaggaaactgaggcagaagcagcccaaccaaatcatccctccacccacctctctacccagcccagccactggtcctggtgaggatggtggtaatggagctgccagtcctggtacatcactgaacaaacagaacatgttatcctgtctttgaactgtaataggattcagagttcttgatttggaccccatgaggataatgtccaaagcttttatcagacggtgagctctagctgaattagaagacaaccacatttcaccgaagtgctttttaaaaagaagcccaactccattgctcccactttcctgctgtttaaaagtaaggagaagtacattacgctaaatgaaataagccagatgcaaaaggacaaagcctgtatgattctgcttctgtgaggtccctagagccatcaaacccatacagatagaaaggagcatggtggttgccagaggcagggggcaagaacaatggggagtcattgtttaagggggacagactttcagttttgcaagatgaaaagagttcttggctgggtacagtggctcatgcctgtaatcccagcactttgggaggctgaggaggcaggtggatcacttgagctcaggagttcaagagcagcctcggcaaaatggcaaaaccccatctctacaaaaaatacaaaaattagcaaggcatggtggcccgcacctgtagtcccagtcactctggggggttaaagcccgaggatcgcttgcaagtcttactgggagactgcagtgagtcatgatcgtgccactgcactccagcctggtgacagagtgagcctctgtctcaaaaaaaaaaaaaaaaaaaaaaagttctggagatggatggtggcgatggttgtacagcattgtgaatatacttaatgccactgaaccgtatgcttaacagttaaaatggtgaactttatggtatgtgtattttattacaattaaattttttatggcaattttattataattt

SEQ ID NO: 89766 - DNA, 1302 bp, Homo sapiens
gggaagggaagcggtctgcggagtccgggctgagggcgagggaccggctacatcgcggcgacccaggttccagcggccgcggctctacccggcgcgcgatttccaggttcctccgccggctggtgcctgggcgccccgctctcgcccgggagcgaggccctgggcctccaaacgccagcatctctttctcgctctttctgcacccctccacaaaaggacttctgtggctggaaaccctttggcaagcctatctcctttattcagtcgggccgagttaacggcaggagttaggctgtgtgtgtggctcctccctttaaaaaaagacttgctgcgggctggagagttctgagattggaccgattccgtctattattaaatgccatctgtggaccgggattggcaggtgtttctttcacgctggcgataactatctctgcatgtggtgttacctaggtggtcctaggtttcgactttcttttttggttccagagataattctagaaaatttacgttgcttgtggtgagaagcgtgatcaaattaacacgtgctttcttacaaaacgttttatcatcttctgtctgtggatttaccttcctgatgcttgtggctatcacctctaagcaaagaggttaatagcattgctatttctgttagtgttgcagttgataacgataacaatagtagcatgtattaattgctagtgacaggcagagcgctagtttctacacggattatctcaaaataaccctttgaggttgatactgttactgcctccactttacaaaccaggaaactaaggtttaggtaggttaagtaacttgcctaagaccacagttttaacgtgacaaagcctagattcaaactcaagtggtctaacttcatagctgcatcctccacccccactcccttaaacgtgtatactccttaagcattgctcatgttgttaagctaattgcgatgttgtacccataattttgattttcaatttacaaatactctgtaaattagatgagagaaacagttgtttttaaaaacatacatataggccgttcgcggtggctcacgcatgtaattccagcacttctgggaggccgacgtgggtggatcacctgagggcagctaatttttgtaattttaatagagacgggggcttcgccgtattggccaggctggtctcgaactcctgacctcaagtgatctacccaccttgaccttccaaagtgctgggattacaggcgttagcgaccgcgcctagctcctaatatgacttttatcatgcattaataggaaatgttgggcta

SEQ ID NO: 89767 - DNA, 1179 bp, Homo sapiens
ccaccagacaggtcaaataatgacattttcctggaatagggcttagaagaatctccagccccttcttcctgccctggtggcttccaggctgctgattttcatagtaattgtgaggtgttagttttcgatttaaaactcacaaagcttgttgcttactgaaatccagccatttttcctgaataactgctccctgattgctgcatttctttggtaaatttccagaatgttgaagaagttgcttctggttatttgtccagtgttcttgttgcttttatggaggaaaagattttccaaaggccttgctccagcattttcattgacattgctttgatacgaagaatttaacccatagtcaaatgccagaaattgaaaaagattttcttatgacatagattaattttttcttaagcatcatttcttctatccccttttaatggtatttcatggtatgaatataccataggatgcttaactctttcgtagttaatgggctttttgttagcttgtaatatccaagagaactagaaacaatgctacaactaaactttttgtatatgcctttgtgtgccattaagaatgtttctctagaatggctccctggaagtcagattgcttgatgaataatatgtatataaaaaatttaagaatactttaaaactgtcttccaaaggcctaaactagtttatattcccagcagtggtttgtgagaataactattttccacaccctgaccaatactgacatcagtcttacaaagttttgaaagcctgggcaaaaataatatgtcattgatttttcaaatttgcatttaaattatattttgaagaacaatgtcattgctaccccagtaagtaataatttttaatccttttatttctcctctttagggaatggcatttactttacaagaacgacaaatgcttggtcttcaaggacttctacctcccaaaatagagacacaagatattcaagccttacgatttcatagaaacttgaagaaaatgactagccctttggaaaagtaagagttgcttagatgtttctttttttattggtattctgattagaaaacttatgagcattatggttattatggcatgagaaatacacaatcttatataagtttgtgttttgtcagttaactacttttataaagattgtgtttctttcacttcggtg

SEQ ID NO: 89768 - DNA, 1022 bp, Homo sapiens
ctttttcttttcttttctttttttttttttttgagacagggtctcactctgttgcccaggctggagtgcagtggcacaatttcagctcactgcaacctctgcctcccgggctcaagcagttctcctacctcagcctctcaagtagctgggattacaggagtgcaccaccacacccggctaatttttgtagtttttagtagagacagggtttaaccatattgcccatattgcccaggctggttttgaactcctggactcaagcaatctgcccgccttggcctcccaaagtgctgggattacaggcttgagccactgcaccaggcagcaaacttaatatatatgaccaacccagtaactcatagccctgtcttctaaaagtcatcaacagacagttatgctatgattgttattggtctctagaccacaatgtacagtacaatgagaaaaaggtacaagcagatatattctgagagcatgcagagggcatctagctcaacttggggaatcagataaaagcttcctgaagggagtgatgcctaagctgaattgtaaacaggatgttacaggtagcaggcaaagtattctgggtagagggatcggtctgcatatagaactaagcatatcaattgagtttgttaagtataggagattattggtgactggtaagagtggtttctttgatgtgatagagcaaaagagatactgtgatagattgaaaaatgaatggagggggaggaaatgtaaactacccttacaagaagttcaggtaaggagggaaggaagatattaaataataagtaaagtaagacttgggattaagtatgtttcaagctggaagaaaatttaatgtttcatcgtagttaggaggaatgagcccaggagaaaggataattgttagagcaaggtctagggaaaggaaaaaggcatagggtcaaatgcggagatagagtggctggtcttgagcaagaacaaagaacagctcattctccgaagctggaataaacataaatacagatagtaag

SEQ ID NO: 89769 - DNA, 1085 bp, Homo sapiens
ttgtactgtgcaagggtggagggagctaatggatatatttgaaagctacttagcaggtagactctgtaggacttggtgatttataggattggtgttggggagggtaggagaggaataaatcaagaatggaatctgggtttcgcatttggtcacgtgatagcagaagaaacaaggtcaggggaaagataagtctgctttagacatatttaattcaagatgattactgactttcaagctttcaagctgatatttccctgttctctaaatttaaaaacaagttatttatatatttattgacatcaattgacaattgccttttttgtgctgcttctgcactctgtgtagaccttataatacttctaacgctcctgggttataaactccttgaaaatagaggtaacttcttatatccctggagaatagtgccaggcatatagtgttaagcaaatgtttgaattaatgccactttattttgcttccttgtttatatgtcagtctccttgaagactgattctttaagcgtaaggacctcatggtgatctttgcatttccagtgccttctacagagcctgacccacagttagggttcagtaaacattgtttctattgttatttcatcgtcatcatcatctactatttaagtaccctcatatttttgttaatttttagtcctgggtgttaaatagtaataatctaaggttttgggttttttttagaatgtgatgtgagaatggggctcaatttcaattttagacatttaggtttaactttcataagccaagacttttaatgtaatgcaggctgacttagacattatttactgtgcttcatttcagatatatctacataatgggaatacaagaaagaaatgagaaattgttttatagaatactgcaagatgacattgagagtttaatgccaattgtatatacaccgacggttggtcttgcctgctcccagtatggacacatctttagaagacctaagtaaggcttgtttaaaaaaaagcttgtaaatgattattgaataaggaaaatatcattccataacacccattacatttctattttatgtttgttagccaa

SEQ ID NO: 89770 - DNA, 1027 bp, Homo sapiens
ttcaggtgtctcatcttttgtgtgattttactgtaattttcttctctcccttcctgctccttcaaatttcaaattttcagtttcagtaagtcttaacaatagtttagttggccttgtactgctctcctgcattggtggcttgctttagattttttttttttttcctggtggtgtattgagtttatttgaacatgagatgtggttacatttcttcttgggtaaaatgactgtatcatttaacaataatctttgttgcatctgctatgaacagtaattacagtttgaagtacttgaaaatgtttgaaaataaaccagtgtgacttagctaaatctgcttggaaattataccatgtcttgatattttattaaaatatcaaaatatttcaattatgaacaaaaacttagaaacaaagctgttgtgaaatgcaaaggtgtttttgttctgttgcaggggattatttatttcgatctcagacagaggtcatgttagatcaattgtggataactggccagaaaatcatgttaaggtactaatagcacaaccctccttttcacaatgttttctcttttcttgtaaattacctctaaatctccaagaacagtttttcattgttgctctcatttattttgcacttatatacatgcagatttagtgctttgcagctgaagtgatgataatagtagtagttataaaatgggctactggtataaagtttgactctgagaaagaaattagagctagaatacaaggtgagccctctcggtatcagcaccactggtgtctcctgccttctcaatctccttttctatttcactaatattattctaggtaaagaaaatacattaaaatgccataaaaacttttgtttatgaatggtgttagagaagtttggttatgcctttttttcttttaaatctaagatttagaaccttagcaaatataaaaatgttaaatatagcaaatataagccctggcctatttagttatctttcataaaataaaatgtaataacttatttcaagatct

SEQ ID NO: 89771 - DNA, 2077 bp, Homo sapiens
aaaaatttggtcaaataattaaactcacagtatcatcttaagaccttccttataagtaggtattttttttgttctagacctttttctttttcacagttgctaaggttttttttgtttggcctaggttattgtgttggagtaccatgctgtttatttctaaactcttatttttctcttatggtaatctctccatcagaatcttgttcatctctgccatatttaatctttctgaagatatttaagttggtcctctagtcagaagaattctattcctaaaccgaagtcagagggaaatcaaatctagttaatgtctcataatactcagaagtcctagaattttaagtatgctttgttggtttacattggaaattagccaagaaacaattttatttttaagagcaaagagtaaatatatatgaagtgaatcaatcttttaaaaaatgcttttctttagtgccccatttttgacaacttttaatttgcatttttttgtgattaaggctgttgtagtgactgatggagagagaattctgggtcttggagatctgggtgtctatggaatgggaattccagtaggaaaactttgtttgtatacagcttgtgcaggaatacggcctgatagatgcctgccagtgtgtattgatgtgggaactgataatatcgtgagtaacatcattttccccctttatcttcctcctgtattttttaaaatgtgtacaatattccttttttgaaaatgataatttaagaagggaaagttttatgattagatttttttttcttaaactccacttttaatatttatataaataatagtaaattaagtctattaaaagtttcttggtccgggcatggtggctcatacctgtaatcccaggacattggaaggccgaggcaggcagatcaccaaaagtcaggagttcgagaccagcctggccaacatggtgaaacccagactctactaaaaatacaaaaaaaattagctgggcgtggtggcacatgcttgtaatcccagctacaaggctgaggcaagagaattgcttgaatgcaaaagacagaggttgcagtgagccgagatcacaccattgcactccagcctgggtgacaagagtgagactgtctcaaaaaagaaaaaataaagtttcttgtagggcaatacatttaaaaaattgtattagtaattttttattttgcaatttttattgtatgtgtttaaactgattatataaattattttatttttacatttggtttattttgtaggcactcttaaaagacccattttacatgggcttgtaccagaaacgagatcgcacacaacagtatgatgacctgattgatgagtttatgaaagctattactgacaggtattttttaaaagtttgagtatatgaaagcacctttaatggggtgggtggggtaagaaccaaagttttgttttgttttcctttatttctttcctgtgtagataagcaggaggcgattaaatttttgagaactttgttctgcctggctgtttctgcctgattagatgtgccgatatgaggtggtacccatggtctgccttgctttcttgagttacctgacattttgagggaagtctgccctcactgcttccatcaaacgcttactgctcagtacctttttcagccttgaccttcaggctcacgcccaccattccactgaagctcttgtgcagcttttgtattttaagttctctgaccattgggtcctcccacttctctacctctttgcaccgtcaactcaggttttcccacttctatgtccttgaaactctctcttctcttgactgctaaacagcttcctcctaacttggtctttctcccacctttctctttttttttttttttgtcatcttcacaggttcttgctgtctcttactaaatgtggataactacctagtcctcttctctttcagccatgtcaactatgacctttatgcatgttactactaaacccataaaaacccatctgtagttccactgctcttgtgaggcctgcatttctaataatcagaatcttccatctgggtattctgttatgagtgcatattcat

SEQ ID NO: 89772 - DNA, 1138 bp, Homo sapiens
gaatggccagaatctgcatcaagccctcctgtgataacagaatagaagcactcccctgataaatactttctgtgctccagggaaccccttttttcagacaagaagagataatgtcttcagttttatggtgttttctgtgttttgttctccctgaccactttggttgatgtattttttccatgcgtctccacatctgttggggtagacgtgttgattgattgcattgcccaccagcaccctacagtcagatagttgtgatgctttaattctaacatacagcccgtaccacatccaggagatgtaaaaagtgtgtttgtgaatgtcttcacttgtactctaattcagacttgccaaagtatttgctatttactattatgggtaatactcttctctggcctagttcttacagagctactaaaatagaaatttacttttatggatagaagtacagaattttgagaagaaactaaattttcaccaaattttaaggaaaaattgtcattatctaaaaatgttcttatatatctgcttcatcttaccttcatactctgaaattccctatagcagacagagctagggaaatattaaaaatttaccctatttattttctggaactaaatcaagccttaactataacattatgagagtaatgggaactactgctggctttaagtaaataaaagtcattgttttcaacagtgtataaaaatcatagtgtaacctttttatttaataaatatcttacatttaattgcttcagttatgctatcttattgcccaactagaaatttagatttgcttatgaaaaacacatatttttgttacttctagatgattctaggagggagtataagatacctaatcatatgggaacatcacgtgactttttaaatctaaattagtcatgcttcacatcaaaatgagtcatatttaactggagaaactatgcccttattccagaactgatgctctttattgcttgagataattttggaatgttactatgatactgtttctttgaatatcattagtagtgacaactctttctccattgaaggcagacttaatttttttaaaccaccaacattaatttagagctaaatggggatgaataaggttggtgttcatctgggaaatg

SEQ ID NO: 89773 - DNA, 1019 bp, Homo sapiens
ctacttgtttttttatgtgacagaaaatgtattaaaatactctgaaagctgtaaaactatgtaatatgaagatgtcttatgaaaaatgttatatcttattgaaaccatctagtggggctaggcaccgtaatcccagcactttgggaggccaaggtgggataattgcttaaggccaggagtttgagaccagcctgggcaacatagcaagacctcatttctacaaaattaaaaaaaaaaaaaaaaaaccaggcatagtggtagggtctgtagtcctagctacttgggaggctgaggcagtaggatcacttgagtccaggaggtcaaggctgcagtgagctatgatcacaccactgcactccagcctggatgacagagcaagacctgtctctttaaaaaaaaaaaaactattaaaaacaaacaaacaaaaaaccacctggtgaaataaagcctgtcttcttgtttttggaatcatgtagcaaaatgtaaatgaataagtttatgatgataagtagaacttttaaattcaatttactatttttaatgtaaattgttaggcttgtttcaaatagctttgtatgggtttttagttaatgaaaaatttccaaacgtatttctctatctcaatcaaaagggagaattaccaagatcttcatcacacaccttcatggagaccatttctttggccttcctgggctcctctgcacaatcagcctgcagagtggctccatggtgtccaaacagcctattgaaatctatggccctgtagggcttcgggactttatctggcgaaccatggaactctctcacacggagctggtcttccattatgtggttcatgaactggttcctacagcagatcaatgtcctgcagaagaactaaaagaatttgcgcatgtgaatagagcagacagtcctcccaaagaggaacaaggaagaactatcctgttagactcagaagaaaactcataccttctgtttgatgatgaacaatttgttgtaaaagcatttcgcctctttca

SEQ ID NO: 89774 - DNA, 1558 bp, Homo sapiens
ggtgcgtccgcggaccagcagcgcgggagagcggactcccctcgccaccgcccgagcccaggtaaccgcgccatgtcccctccccttcccccggccgggcccgcgcaccccgcctgtggcttccccgccccggggcgggctcccgacgacggcggcggcggcggcggcggctgggagcgcgcggaatcctctgggagggcgaccgcggcggcctgacgagccgggccgggcgggccggctgaatgccgggcggcggtgcctcgcgtccctcgggcccccagctccgcttgcagctcgtgggagaatcaagttaaactcggacgggactcctgccgcggccgccgctcctctttgttgttctcagtagtttcacggtcgccccggctgagcgcgttgggtcggctggaatgtgttgccttagggtctaagtgaaagttgtaaattgtttgtctaaatttattttctccagccaatttctgttttgtctttgtcccctactttctcttcctagtcttgtcatgccagtttacgcttctggctttgatatgtttactttttgagtactgagagtgacagcggtatgcaggacacattcttagcacctaactgaacccctccttgcccccaataaaacatgcttcctaataaaagacacagctgatcttactgttagcactgcatgtactgacagtgaaattggtgtagggtggagggcggtggctccatcacttgtcccaaactgctgttaggatttctcaaactagattttcaaagacacaagtgtgtttagttaacctgaaaggtttatttgctggtgcagaggctttaaaaagccctgttgaagattgatagctgtttcccttcaaaaacctaagtacgtttgtttttatttaaaaaaacacatttatttcccaattagtttcttaatgcatttagtttttgcaccgtagtttaaggtggaattgccagttatttaggaataataaacacaacaggataatagcggaattaccctgaattgactttctgcaaacatataatcttagctaatttttgttagtaacctttgacttttgccagaattagcatccttctagtcttagtagcagcttggttactcgggtgttttaagaagtaggttcactcctttttgctggcaaaaaccatttagtatcaaaaaaaaaaaaatgcgtaatttcgtaattagatttagaacaaggcatttgaataatttttatggtggatttcataaattacttttgccataccctgcagagactagataatatatatttcagttgaaatctaggaagttctaaaatgtaacttttttttaatgctaaggacttactctctctatattggaaagttctgatatgattagtacataatattccaaactgtaaaatgattaacatttaaaaatacggtttttaaaattagtgtttcttccataatgctgtcatgattttgtttacttaaatgggtttgttacagaacaaatgtaatagagatggaccaagcatttgtaattcggagtagctttaggtctaaagac

SEQ ID NO: 89775 - DNA, 1190 bp, Homo sapiens
ttgattctagttagtggagctggcctaacctgcgggggattttgatacatccccctttgaaggaataagctagatgacttgaaactctgcttcagttaaaagttttatgaaatgaggccgggtgcggtgactcacgcctgtaatctcagcactttgggaggccaaggggggtgcggattacctgaggtcaggagtttgagaccagcctgaccaacatggtgaaaccccgtctctactaaaaatacaaaaattcattgggcatggtggcacatgcctgtaatcccagctactcacatgcctgtaatcccagcttcttgggaggctgaggcaagagaattgcttgagcctgggagacagaggttgcagtgagctgagattgtgccactgcactccagcctagctgacagagcgagactgtctcaaaaaaacaaaaaaagttttataaaatgtatttttcagttatcagttattaaaattcagtttggtttccaccatcttttaaaacagtggttcccaaagtatggtccacagactcctggagatccctaggatccttatatttaaggggttcacaaaatcaaaattattttcataatgaaactgagacgttatttgccctttcactgtgaggacatttgtatgggtggtgaaggagcagtggtgggtaaactgctggcactttaaaatgactctaggcagttataccaaacatatgagtcctcattgtgttctttatagtcaaacacacataagcatttgaaaaaatgccggtttcacttaataatccccttgctgcagcagtaaaaaggtttaattttaaaaaaatctctaccttggagtatgtctttttaatagtgtgattaaatgggaagtatgcataaagcatttctgcacattgaagtacagtgttcttttctaggaaaagcacttgtgttattgagctgcaagctgaactagctgctttttagtgggacaccatttttatttttatttaacaggatgacagataagctcagatagctatttagatttgagtatttggcaggtaattccttggaaatgaataaagtgagctggccacttcgaggagaacatttatagccagtgctaaaatctgatgtttcaagtgaaaatcagatttttgggaaactcctgtcactatgacttgccagtttcttaatacttaaaga

SEQ ID NO: 89776 - DNA, 2149 bp, Homo sapiens
gcccccagttgatctgtgatgaatgtgtattatatcctaagcagaaaataagcttttgttttaagctactgatcttttgggggttggttgtcactgcagcatagactagccaatcctgactgatacgttgtgccaagacctaggttacctatgaactttccatgctccctcatttatagtcccaaatcactttatacctacttcttttagcatttattacttatgtaataatatgtttgggtcttccagattagtagttctcagtggagtaagtactgctctttaagggatgttgtagaaatttgtggatgggtttggtggattggtggccagggatgccatcctgcaatgtgagagacagcgaataattatcttgcatcccacaagactttcagatgccccagaaattcatgtaggaggaaaatataattagcccagaacctaactctataatatatattcactttgccaggagttaaatttcttttaattcatttttttcttgcctgcctgcctccctccctccttccctccctccctccctccctccctccctctctccctctctctttctctctgttttctttctttttccttcctccctccctgcctccctcccttacttcaggctctgttacccaggctggagtgcagtggcgtgatcttggctcactgcaacctctgcctcccaggctcaagccgtcctcccacctcagccttctgagtagctgggactataggcatgtgccaccatgccccactaattttttgtattttttgtagagaggaggtctcactttgttgccaggctggtcctggcaaccgtgcctttgttgccaggctggtcctgagcttaagtgatccaaccatgtcggcctcttaaagtgctgggattacaggcatgagccactgtacccggacttggttgttttgttttttatttttgagaccaaatcttactctgtcacttgggctggagtgcagtggctcagtcatagctcaccgtagccttggtctcctgggctcaagcagtcctcctgccccagcctcttgttaattcattttcttagttcaagttgtttaagagttcaccatttgggaaaatccatgttactgactgcagtgccattgtgctatttgagttgccagtataacacgtttgtcttggaaggtctgaatttgtagctgtcacatttgtaatgattctgtatataagtgctagcatctaacttctttattatacattctaacttagttggcatgcctgagtatttataggtggaagtacacattatatattaagcttttcctcctttttgttatagttagggcattgttaaattttcaaaatatgtttaagtagtttagaattttgtttcagtaaagctaaggtggtgatataaattatttgttggaaaaaaaatgggatgttggtctgagagagtccagacccactttcttactatgggcttcctgtttttgtatctgtagtgctttgtatatacagtgtttgttgaattggtcaatttatgtttcccacatttcttttatgtacgttgttgcatctaattaccacaataaatttgtgaagttgtcagggcaggtgtttccattttatagatgagagaattgagagagatgttaacattcagtcatgcggctagacctttaattagaatatataattttatttatatcgatattatgctcttgcctaccatacttccataatctagaaccatttaatgtaggaatacatctctttattcctgctagtattattttttatatgcataacttttaattatgtttcaggcacttgtggtcataggaatacaataaagagagagatgagaaagctgtttgtttaagaaagcgaggtcattatcatttgtattcaaagcaacttggtattaaaacaaactttgagataccgttaaggccccagcatagcataaattttagaaatgatgacatttgatggtgagattgtggtgaaatagttaacacttaaacattttaattgcattgtagattcatacacatcttttggaatataatatcagaaaatgacttcaaaagtgtctgcactcttctaatttgttgtaagacaattccacagaataaaaagctatggtcagtccagaaa

SEQ ID NO: 89777 - DNA, 1024 bp, Homo sapiens
gaagtagcagctcattgtggttttgattttcatttccataatgtctaatgtcgagcatctttcatgtgcttattggccatcgtctttggagaagtgtcctttagaatccttttgttcatttctaaattggggtttttttttttttttaattggtctcttttaacaaaggtgagtgttaactgctaggtagaatttcataccaggcgatggtaaatttttcataaatattagtaatagacttttaggtttaactagtgctgatcctcataagtaatcctttaaaaaagtgctggtaagattttcctttagggtgactagtaaagtcagtaagacttgattgagcatgccactatcataatgagaagacctaactttaatatttttggaatgtcaaaaacagtgacattttaattaagtaattttatttttaaaaattatttttaatggctaatattttgtaagaattttaagtaattttcaactctgagcatcaaattttaattatgtgcattgaatctctgacttaaccagagcaatttcatcttttcccaagtagtcagatctacttcgtaaaatgtgttctgatgtgtgtcttttttttttttcttttttaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggttagtcttataagagtttttctataccctctat

SEQ ID NO: 89778 - DNA, 1053 bp, Homo sapiens
gtcttacttttgcccaagctggagtgcagtggtgcaaaacatggctcactgcagccttgacctactgggcttatgcagttctcctgccttagcctcctgagtagctaggactacaggcacataccaccatgcctgggtaattttttattatttgtggagacaagggtcttgccatgttgtccaggctggtcttgaactcctgggctcaagcgatcctcctgccttggcctcccaaagtgataggattacaggtgtgagccaccatgcccagtcactttttacatttttaaaacctgagcacaggccttgaaattataccaaggtttaaattctaggtctgatgtatgacatggccaagttagttattgtgaattttagttttcttatttatgaaatggggattgtaatactgagttggtaggattgtgaggattaaatcagaatatataaaagtgtcttgcataatgtgacacatgaataaatggtcgtttatttttctaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattggtaagtagactttgctttcatcctaagaaacataaagggaaaaggatctcaatagtgtttcaatttttgtaagttaaattataaatttggaagatagcccgcgactttaaataaggttaaagaatcagacatttttaatatacgtatttaaatttgaatttaggaacaaacttatattttgactgctaaaaccgagtattgtagttgatattttgcccctttagaacattgtttttgagaaataagatggaaagcattataaatttgaatacttagttatgtattgttagatagcgtttatgctacttctgaattgaaatggttcatgaacttttgtaatctttggtttaaatttacattctctgtttttaaatgga

SEQ ID NO: 89779 - DNA, 2056 bp, Homo sapiens
ttgtgttcagttttttttattgatacataatttgttacgcatccttttgattatctttttgtttccataaaatttctaaagaggaactttggaatgggatttataggtcttcagaatatcatcttcatgacttttgatgcatgaacatacttcttaagaggtttttaagaggttgtacatagaaacttgcacaatggatgattattactgccttaaactagtctcaatttaataaaaagtacccatgtaacttaactgatatttacatgtagtagattttttttcaaaggttgacatagggaaagataagggaaatgatatgctggttcttaatgaaaaagggaatgtctttttgtggtctactaattgactgctttaagaagagaacctactgttagttcagtggattgttaagttctggagtagtgttagtttagaagcaataaaggattggttgctaaaggtaaaaagcaaaccttaaaacaataacctaaaaacaaatgggaaggttctgggcagagaattaacattgttaatgcagttcagtttcagttttctttttgtcatacagcagagctaactatttcctggttggttaatggaaagatgttatgctgtatcagctggaatctagctttgcttatgaaggtgtaatcacataggtgaaagatgttgattactgagttttctcacaccatatattaatcaaatactcttatttgggttgggtttctagagggaaatttcagtttgacttttcatttataatttttccgtttggttctaaacctataggggacattacattcagtacacttcatttttaaagaatatgttgcttaacaataattctagatcctgggattggatatctatcagatcccactcatatctccacagtgtgaaattaacaaaaagatatagttaaatactcagtctctatttagaccgaataattgtttttctcagctggacacattttccagccattcggtttttgcctgccttatgtatttaggtgattattcttctaggtttatcaagaaactgaggagtacctttttaggattgttgctggaggctgttgaaacatagactagcttcaaatttgagagtcagattgattgataaaatatatctcatgctgttaccgctgaataaatgacttttgctggtaaagtagtatgcttttaaaataatatgaaaaaattctgaattaaggttagtaatttacactgtaattgattttaggtgttattatattacttgctaataagatttttttttctgggaatagaagcttataaaaatttaaaatatgtttaattttctatatagctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtgagttctagaatcagatgtagtcagcaagttgagttttcctaatcattgcttatttatgtgtagtcacttggggggaaactccaagtaagtaaacattaaaagtaactgtagtatctttcataggtaaacaggtattaaacaggtatgcacaatcacttggaatttaagtaatggctttgattataatattgatttaaattaatgatctgatttatactttactattacatgtagcagtaagtagcctcttaagctcccagatatattttggagaaatatttaaataattaacaagtagttttgatccaagatgtttatgaaggtctgtgttaatggaattgcaacctttcttttaatgcggtgttcttattttggtttttctgggacaatattaccttatagtagttgtctgattttctcactgtgcaaagggatcttgacaaatttgttatatattgctcaagatagacattaattaagtcaattttgatataagctaact

SEQ ID NO: 89780 - DNA, 1409 bp, Homo sapiens
aggattaacagtcgagttaattaatgctctttaagaaaccaaatttccactttaaaaaaaaagccttaaaaatgtaggacagtaagcaatatcataggatggtttttgaatagaatacaagccaagagaagcttgattctcttggtatattacatacagagagggcaattaatttcttgtacatctgggaatatgatggtgttcttgaaaagaaatgattcttggtttataaaagctcttgaaaaaatttgaaagtagactgatagtttttttgtttgtttttaaccagtaaatggtatattgattggacagcagagctagatctttttaacttcctcatcttcactatcacatcctatttaaaataattttctgctctgcttttctctgtcaaaccctagcattctgccattactagtatcagtgctgatagtgattaatttttcagttttcaacattttcttgagcctggatttttggggtcctaatcagaaaggtccagagagagaggtggatggagtggccaggatgaactgacatacctctgaagaagttaatatgataggccagacgtacagtggtgttttgctggcatttgaaatatgtttgtgaagaaataagccactacaattagttagacattacctaaaatggaataattttgagcttcctcaagttaaagtttgcctttatagatgactgtaggttttttacctgataggccatgggtgagttacactttttgcccatctttatagttgtgcattatcagataaaattggtccttcatttagtatatgaaatcataagatgacatctatgaatgtaccatgttaatgtcttcttgttcctctaggtcagcctgccagtatactggggggcagccatagtgaaggactgttgcagatagcatcagggcctcagccaggacagcagcagaatggatttactggtcagccagctacttaccatcatagtatgtacatactttaaaaaatcttttaaatagttgagaaaaaagtaggcagcctttataaaagcaaattaacccatgtgggccttaatttttagacagcactaccacctggactggaagtaggactgcaccatacacacctaatttgcctcaccaccaaaacggccatcttcagcaccacccgcctatgccgccccatcccggacattactgtaagctcttgtttttgttgtaagggctattttttttttttttttggtagggctttgttttctgttttttaaaaatgtttttacatcttttattcatcctgtgattttgtttcattaaatagtgcttttcagtattttttgtaaacagtattatttttcatagttatcctacctttttattttagaggagtgatgtttgctaaatacatttatttctctgt

SEQ ID NO: 89781 - DNA, 1025 bp, Homo sapiens
tctaatattttgttattttccttccagtcatataaacaggtatatgtaaattgacaggggctcctactctatgtgtattgtatatatcttgcttcttttcagttatgttactattttttccatttcttaagagaatgtaatttttaatggctgcctaggccgtcatagtgttgaagggtgctgggtttggacctttaacaggctgtgtgaccattgacaagttatttcacctcattaagcctcaagagtaataatagtagtatctacctcaaggggtgttcgtaagaagtaaacgtaataatttatgtgaggtgtttagcacagtgttttaacacattaccagttttcaattatgttagctatgattccattaaataaacatccttaattaacataagcacttgtttttagaatagacctaacagtttattattatacattgcattataaattgtactgtattggacgttacatgaataattcatttatgatctgtattaaatgttggatataaaattatgtgtaaattgtgtaataatagcacttggcagatagcactgaaatgttagttattaaatatccacaaaagtattaatagtttaagactatttgcttattgtaaacttttaagttcttagacattgcataagcttgttttaaacaattcctaacctataatagttatatttaagtaagatttactgaaagttttagcattagacaacttttagtaaataaaaatggaatttttgttgtcttttctttagggcctgttcacaatgagcttgcattccagcctcccatttccaatcatcctggtaagtgtatttcaaaattgatttcctgtatttagattgatttagtggtgattgaaacgcacaaacacaggctttaatggaattatggggtcacttctcagatgagtacaatactcatcatgacatgagttaatcaacagtttgagtagtcaatatagtcacacatagactgtctatattttattcagtttaactgtccccaaaaga

SEQ ID NO: 89782 - DNA, 1037 bp, Homo sapiens
tgtgtttttaaaaaataaaagttgagactacatagagaatatgtgtagtcaaatgaaataccatggtaaaataatttattttagattctgattatttctgttctttaaattctcagttgacctggtcctttgaggtaagaaccaaattccagattttaaaaaatgacttttagaacttgaggataagtggtaattggaaattaaaaaaaaaaattagtgttttaagaacagtgctaagtactgagctagaaaatagaagacatggaaattcctaccttttaatgcattatgttattttaatccagttgttttgggtgcattacatttccatctcccctccctttaccctttcttttaggaaaaactgtgttgtggagtgcaagtgaaagccttatatctttctcatgggaggatgttctttcccatttatttcctatagctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggtattgattgtatagtcagatagttactttaaaaaattgagcatagtacattgtcttttattcaaggttatgttttcccatgtacattatatgtgttcttaaatataaataaaggaataaaggtcatgttgaaaactcagaatttgtaagcactccatcttaattgtcggtgtttttgttgtttaacatataatgataaaagatagccttttttatgttagtaggtttctatgtttcgaatagtaagtataccttttgaaattcagtttgaaaattttattttctgtgatcatacatttctacaaattactgaaaggaagtaatattaaatgagaacatgtttctgaaagttttacttataatgttaaaaaaattggtaataaaagggaaatggttaagtaaattatgataaat

SEQ ID NO: 89783 - DNA, 1041 bp, Homo sapiens
ggcggagtcaggcagatcacttgaggtcaggagttcgagaccagcctggccaacatggtgaaaccctgtctctaccaaaaattagccatatgtggtggtgtccacctgtaatcccagctactcaggaggctgagacaggagaattgcttgaacccaggaggtggaggttgcagtgagctgagatcgtgccactgcaccccagcctgggtgacagagtgagactccatttcaaaaaaaaaaaaaaaaaaagtttatataatgaaatggaaatgcttacagtgaaatattacaggaacattccattttagctactgtatgatctcggcttttaaggatgtgtgtgctaaagaacataatcttggctctatcacttgctgtcatgtgactttggcaaattacctaacctctaagccattctgcctaatagaattttctgtgatgaagaaaatgatttatatttgcactgtccagttcggtagccactagccacatgtaactattgagcacttaaattatagctcacttgattgactaatcggatttctaattagttttaatttaatttaaatagtcacatgtggctagtggctatcaatttggacagtatgccttagtttctttatctaaaaaaattagaataatagtacttgttgagttgtaagggtttaatgagaattcatactacatgctcctgacacatagtaagtgttgtaaatatgtgcatcattattagatatgaacaggaaaagaaaaaaggaaatatacaaaaatgttaatagctatcttttggttttatgtgatctttatttttaatttttcaatattaagcatgctatacaatctgaactaaaatttaatttaaaatacttatcaagataaaatgtaatttcttttttcttcctaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgct

SEQ ID NO: 89784 - DNA, 1259 bp, Homo sapiens
ttctcactagcagggtgtgagggttccaatttctctacattctcatcagtacttgttatctgtcttttttattttagccattgtagtaggtgtgaagtataatcttattgtggtagttttgatttgcaaacttcctgtgttaatattgagttgggtttgtttttgaacacatttattttagaggaaggggcagcagatgcttctaaaccactggtggactaggtcagagggtattatgaacctcatttaaatttattcccaattaacactcattgtgattccctaagtcaagtagaacttagaatgtccttagcacaatcttgtttatgttcaggtgcatttttcattctggattactgtttcctaatgttaatttaagattatatagtattgcatttaagccttgtcaaaggaaaatggcaaaatttgactcctggttgtaaaagacaatatcctaaagatgttgtcagtgatctttatgagacacacatctttgttaagtaacggttttgtaataaattcagaaaacatggttaaataaattaaagcagaaattagctcaggagtggtggtcagaaatattttttggatctgagccaaaaagaatatttaaagcctttgattactttgaattgcctttgtcaacaatttagtcaaattatgaaaggaagacagtagcatttcaataatagctttaatttttatcatccagtgtaacaaatggaatctgttatggtatccgttatcaatggattagttacagtgtgaagtcaggaggcaatgcaggttttagttattagtgaacctaactgaataattttaggtcttctggtttgagtgctataattacgtaaataatctgtggaagggaggtttgctgaggtgcccaatgaatcatttttactgcatctacagatgcaagtcataaagtttaatccgtgtgggtaacctgtaatatgtgctgctgatgttagcatagattcaggctgaaacaatcctaattgcgattatttacaacacattggagagagcctatgtgtgacatattacttggttatttttttaaatgactcgtgggggtgggggagtgttaatgttaaaggcatacttgaatcttggagattataattaagttttattccctactcccagataacattatatatatatatatatatatatatatacacacacacacacacacacacacacacacacacacacacacacaccatacttggttagtgatgattaaaaaa

SEQ ID NO: 89785 - DNA, 3669 bp, Homo sapiens
attggacacttttccaattttttttttaaagtatgctaaacatggagagaaaactaagtgagggtggtattttgataacttgtagacttttttttaattttagggtaaaattgaactgtgtgccaggtttcacactgatggggaattttttactgcagagttaaactcctgactatagacttttatgatggaaacacgtggcacccatcttccacgtctgaaggcataactagtgattcattcaacccctgttcttaacctcttcagtgtggtaagcaaatcacactggctaagaaaactgcagtggccctgcaggtttctctacagtacatgcaaattcctcccattagtttcattgtaatattgatgaatgcagatggactatatgactgtatgttctgactggaaaattagatgcagtctccattgtgacttatgttcaggagtttacaatttagaggtagattaggcatattcattgagagaatttgattttttaaaatttggggtgataccattaatttgctggtttcagtgttataaacatgcttttactgaagaatccagaactattattaagtttcatattctcatcagttgccaccactgagtaatagtgtattactctgttacactttgaaattgagagagagacttcatctcggtcatctaagaggtcttagtggaactaagaatattaactgcttcattattagttatgtcttattctgaactaggctgtttagacagtaaggtttttagaagcaacctgtggacacgcactacctcttaaaaacaagttgtttcttatcccttcacctccacttctaaagaaaaaaataggtgaggtgttggtggattgtggtaatttactttataattggttgtagctagaagacacatgtgaaatgtaaagttccttaaccaaaagtgtgcagcttgttgataaagtttagatctactgttacttcttggcactttagcagagaagttatatgctgaggagaatgaaatacagaaagctggtcacttgattaatttagaatgtagggaggatgggaagagatcaccctgtccctctgatgtcttccaaatcttttctgttaggtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacatacaaagttgaattctaggtttgatttttaagattttttttttcttttgcacttttgagtccaatctcagtgatgaggtaccttctactaaatgacaggcaacagccagttctattgggcagctttgtttttttccctcacactctaccgggacttccccatggacattgtgtatcatgtgtagagttggttttttttttttttaatttttattttactatagcagaaatagacctgattatctacaagatgataaatagattgtctacaggataaatagtatgaaataaaatcaaggattatctttcagatgtgtttacttttgcctggagaacttttagctatagaaacacttgtgtgatgatagtcctccttatatcacctggaatgaacacagcttctactgccttgctcagaaggtcttttaaatagaccatcctagaaaccactgagtttgcttatttctgtgatttaaacatagatcttgatccaagctacatgacttttgtctttaaataacttatctaccacctcatttgtactcttgattacttacaaattctttcagtaaacacctaattttcttctgtaaaagtttggtgatttaagttttattggcagttttataaaaagacatcttctctagaaattgctaactttaggtccattttactgtgaatgaggaataggagtgagttttagaataacagatttttaaaaatccagatgatttgattaaaaccttaatcatacattgacataattcattgcttcttttttttgagatatggagtcttgctgtgttgcccaggcaggagtgcagtggtatgatctcagctcactgcaacctctgcctcccgggttcaactgattctcctgcctcagcctccctggtagctaggattacaggtgcccgccaccatgcctggctaacttttgtagttttagtagagacggggttttgcctgttggccaggctggtcttgaactcctgacctcaagtgatccatccaccttggcctcccaaagtgctgggattacg

SEQ ID NO: 89786 - DNA, 1026 bp, Homo sapiens
tcttctctttctgattcttcatttctgactgcctaggcaaggaaaccagataaccaaacttactagaacgttctttaaaacacaagtacaaactctgggacaggacccaagacactttcctgtgaagtgctgaaaaagacctcattgtattggcatttgatatcagtttgatgtagcttagagtgcttcctgattcttgctgagtttcaggtagttgagatagagagaagtgagtcatattcatattttcccccttagaataatattttgaaaggtttcattgcttccacttgaatgctgctcttacaaaaactggggttacaagggttactaaattagcatcagtagccagaggcaataccgttgtctggaggacaccagcaaacaacacacaacaaagcaaaacaaaccttgggaaactaaggccatttgttttgttttggtgtcccctttgaagccctgccttctggccttactcctgtacagatatttttgacctataggtgcctttatgagaattgagggtctgacatcctgccccaaggagtagctaaagtaattgctagtgttttcagggattttaacatcagactggaatgaatgaatgaaactttttgtcctttttttttctgtttttttttttctaatgtagtaaggactaaggaaaacctttggtgaagacaatcatttctctctgttgatgtggatacttttcacaccgtttatttaaatgctttctcaataggtccagagccagtgttcttgttcaacctgaaagtaatggctctgggttgggccagacagttgcactctctagtttgccctctgccacaaatttgatgtgtgacctttgggcaagtcatttatcttctctgggccttagttgcctcatctgtaaaatgagggagttggagtagattaattattccagctctgaaattctaagtgaccttggctaccttgcagcagttttggatttcttccttatctttgttctgctgtttgagggggctttttacttatttc

SEQ ID NO: 89787 - DNA, 3148 bp, Homo sapiens
tcatagcaggcctagaatttaactggtgggagcagaagtgagatgacctactagccatgagcacggtgtttttgtcatcaattgagttttacagaggaaagagtaatgttaagttaaagtggtaagataattaggtggaagtcagtttaataacttctgtcagataattgtgaaaatcgaggttcttggactagcaaaaagaccacagattttaagtcaaactaggtttacttctggctctgccacttcctagctatgtgaaaaactctaaaacttaacccataaccagatatttagcttaaaaggtgcattctgtgatttgtctttatatatatcattgaagtagatgttgattcttatgaaatgttttctttctaacaggttgtaaaattaaagcactgagagccaagacaaacacgtatatcaagactcctgttcgtggtgaagagcccatttttgttgtcactggaaggaaagaagatgttgccatggccaaaagagagatcctctcagctgcagagcacttctccatgattcgtgcatctcgaaacaaaaatgggcctgccctgggaggattatcatgtagtcctaatctgcccggtcaaaccaccgtccaagtcagggtcccttatcgtgtggtaggattagtggttggacccaaaggagcaactattaaaagaattcagcagcagacccacacctacatagtaactccgagcagagataaggaacctgtctttgaagtgacagggatgcctgaaaatgttgaccgagcacgggaagaaatagaaatgcatattgccatgcgtacaggaaactatatagagctcaatgaagagaatgatttccattacaatggtaccgatgtaagctttgaaggtggcactcttggctctgcgtggctctcctccaatcctgttcctcctagccgcgcaagaatgatatccaattatcgaaatgatagttccagttctctaggaagtggctctacagattcctactttggaagcaataggctggctgactttagtccaacaagcccatttagcacaggaaacttctggtttggagatacactaccatctgtaggctcagaagacctagcagttgactctcctgcctttgactctttaccaacatctgctcaaactatctggactccatttgaaccagttaacccactctctggctttgggagtgatccttctggtaacatgaagactcagcgcagaggaagtcagccatctactcctcgtctgtctcctacatttcctgagagcatagaacatccacttgctcggagggttaggagcgacccacctagtacaggcaaccatgttggccttccaatatatatccctgctttttctaatggtaccaatagttactcctcttccaatggtggttccacctctagctcacctccagaatcaagacgaaagcacgactgtgtgatttgctttgagaatgaggttattgctgccctagttccatgtggccacaacctcttctgcatggaatgtgccaacaagatctgtgaaaagagaacgccatcatgtccagtttgccagacagctgttactcaggcaatccaaattcactcttaactatatatatatacataaatactatatctctatatggactcgtaaaggcatgggtataatggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagataatcataggttgtgtgagcctatgaaaaagtgtatacgtctaagatttcaaaacaatgggtcccaaagcctaaccactttaagagtttatggagggtacttggcattacagacgattcatacacttccagtgctgccttctttacactgccagttttgacaaaacaggtttgttttttattttacaacaacatatgcctaattctgcaggattgcaagtaactttttaatgcattgtgattacttattggtaatgatagggctgatggcagtttactagatcactggttataatttgggacaaaaactgctacatcaactttcatctcgcccagagtgctcaaggctggtatgatcagtggatcaggaatgcaattgtgaattcctgcccattgcctctcttggtgaatgtggaaatggccacctgggttttcccatatcaggaagggctttgggatggcacctatattggctgataattgaggatgcaaacattccattcattagtgtgatcgagctgttaatttttagactatagatcaaaatgtgaaacattttatgttcaatccatatttgtcttgcacattataaatatatttttattttttagtaatttaggggagggaggagggagaaagggataatgatgcccttggcataattcacaaaagcagctgtgacaacctccaatcagtttacttcatttcaaaactatttccaatcacaaggaaagatttatttaaaatatactcgtacatttcacctgtggatgtctataacttcatcctcagtatgttcccaaatctgtgctggcattgaaaggacaaaacattatactagtgggtttttctactaattattttttgaagcattattttcccaacacaaaagagcttttttctcggtataatgaaaattgaaatcctatgtgtattcaatagtaaatagacaaattttattttttatttccacttgaagagttacatttcgtataaaagtttacaaataacggtttttattttgattttttcagtataaaaaaagttgccttgatggcatattatgatgtaatgctaattgcttgtaggatagtaaatggtcagtattgaaacctaatctctagctgccgtcttgtagatatgaacgaatgttcaccaagcatgtattttgtattttgttgcattgtacactgcaactaataagccaaggaatcgacatatattaggtgcgtgtactgtttctaaaaaccacaa

SEQ ID NO: 89788 - DNA, 1098 bp, Homo sapiens
actcagcccttacttgatttttagatttatcccttcacctattccaatgcccgtgattcctcaaacctttcctgaccctaccttatgtctattcgctgccctggcctttgggttactattcctgaattgggatttaaaagctaggtacttggaagaaaaggaaaataattgaaggaaaggagaaaggtaatgtcataggcagagtaatcccacccacccaacaagtccatatccgaattccccaggaactctgaatatgtcacctcatttggcaaaagggatgttgcaggtgtttatgcagacgtgattgagggtatggaccttgctttggggagcttgagatcatctggatgatcatctgggtataatcacatgagaccctaaaagcagaaaacctttcccagttgggtctgagatctgaaaaagaagatgtgaagcatgagaaggactcagcctccattgctcgctctgaagatgagtcacaagccagggaatgtaggtggcctctagaagctgggaatgaccctcagctgacagccagcaaggacactcagtcctttcactgcaagcaatcaaattctgccaacaacctgcatgtgcaaggaactggatccctcaagcttcttgcaaggaacatagcccttgcaaacaccttgattttagccctgttgagacccatatcagatgtctgacccaccaaactgtaaaataacaaatatatgtaaaaacaataaatttttgtcattaaagccactgtggtaacttgttaaggcagcattaggaaactaaagcaggtaatagggaattaaaggacagaaatatttttggactttaattgaactattggcaattccatatttactgtaacaccttaatacagtattttatgttgaaaactgcttcttaatttttttttttcttttctttgggtcagggtctcactctgttgcccaggcttgaatgcagtggcacgatctcggatctctgcagccttgacatcctaggcttaggtgatcctcccaacctcagcctcccaagtagctaggaccacaggtgtgcaccaccacgcccagatagttttttatattttttgtagag

SEQ ID NO: 89789 - DNA, 2630 bp, Homo sapiens
gggcgtgggtggggagacgagagaaaggagcgtgggacggaaaaggcgaacccggcgaggcccccaagtccaccgcgaaggggtctgggaggagccgagggtcgaccagatgtgaagatgggtcaccttgcgaaaacccacgcttttccgcccgtcttgcctggtaaaaagtgtgaagtttctcgggcgacccagtccggtggtgttcacgttacttgggctgtattcgtggaacaccaggctggcgtggcaccagaaacctcagtgaggtggtaaaaggtcgggctcgaggagttgtgggttcgctgttgggtacggaaagcttcgagattgcaagtttgcgccgccgagtgtcttctaaaagcgttcagcctcccttacaagaacttgttcagatggagaaaagaacagaaatggaggcctgtagacagagctcactggggagggaaggggtgttcaaatggtcggtatcaccgccatcccctgcccctccgctgttgagaaacttagctttggaaaagcagcccaactcactgccgcctatcttaactgtatttctctcggtacgtttcaactctcggaaagacacactgacacactggctgtcttttaaaactgttcagtgtgcaggatgaagaaaaaatggacactaaggtaattaagaaacttcatcggtttatacagttttcagttaattctcctcttcacttgccagcacaccagtactgcagacagactcctcccacattgttcagacaaaggacctgtgtctcagattccaggagtagatttgtgaaggtgggggaaggggatgcctggggtacctctgtatccgacatttttagggaaggtcctaagttctttatggtagcatttcccctttatgaaaggggcagatgttacctgctgccaccgcatgacaatgtggtttagcctggttgttgcatgcctctttactgttaggttgagagcattgttggggtcaaataaagagagatgatggcgctgccgcttaaatgatctcatctttcccaggtggtctaaagtacacataaataagagctctgtcgaaatggtggtttcacatatcagacttggcttatttctttcctatctgtaggattttaataaaaactcatctgaaatctggataaaggagatagcttagttcagactgcctgatgattggcacttacagacactgttcaaagctggacctttcaattgaaaggtagcttatgcttgtcgttcttctggttaatgagtttcagattcctggattgtttggttttggcgatacttagagtaataatccaggagaaaacttttgtttacatgggataaaattacaacatctcaatttggatcagaatgagttgaccattcatgtaagaacactgaggaatcgctatgtaccaagcttgtattttgccaggttttgagtttgtggtattgagaatgtgaagttaattcagactttctgcccttaagaagataacagtctaataaacagtagaatggcactaactatagtgtatttagtatgacaaagtctcaggtaagagaacatctatggagagggccttggaaaatgggtaggaaggagtctaacaaatggagattgaaaaactgtggaggaacaatgtgaggaggggtgtggaggactagcctaggtataattgccaagtagtgttgttttgatacttgaggtctgtaaaggggagtggtggaaaagggggaaggcaggcgttcacaccagaatgtgaagaagcctgaatgccatatgaagatgccacttctcaggacaagttgcttccgtgtgcttatggtaacagtctagggtaacaaaggaagaaaacatttacgtgccagttttactgaaggacaagataacatattttatagatttagtttaatacaaactttagtccttcattatagtagacaccccttaaagcactgctaaatggcccttacttgtgtatgttgttaatctttatagaaatcagttttttaaaagtaaagtgaattccaagtttttattttgtaccagctattacgtgataggaaatgagataaagccttagtttttcttttgagggctgtgtttatttggttaataaggaaatgttgaatttaattatgtcttagatcatggagacaaattgctggctcttccatttaaaccttgtattttcccagagttgacaatactgttaaaagtatgtcatcatcctctatcttaaaagcagaaaatctggtccttttgctgttctgaaccatacaacttgtggatcattgacccctttgccacccccatgtcccagcagcatagtaataaacctgtaaagtgtttgctcactcgtatggagaacgaagtgacttctaatgttcacattcttttacagtattatatttccccacgggagagaatctgtcctaagtaagtaaaacagggcaaatcatttcattttcttgtttgctttgaaggagctaaactttcatccttaagattaaattatccatttctgccattttatgtattacctgaagccataattttctatttgacatctcttaattgattttggaaataattatgtcacagatggagacatttatgacttcag

SEQ ID NO: 89790 - DNA, 1060 bp, Homo sapiens
ctcacataataaatgaggtttcatgagttcctgtacacaaatatatacattcatgcattaatttatatttggtcaatgttgcgatttatgaataaggcaggagatattaaagctcacagaccttcccatttgggtctaaatttatcgtcttgtattaaatcttgtttatgaagcaactttgagatttgctttttctctaaatataatgactgggattctttcattttaatatatcaaacttcccagtcccttctatctccctcagtcacaccacgcactaatttgcacctgaagagggtttcccttttattcctatggtgttgtttatgacagagtttgacacatggagggtggtgaggaagaagagttgctttaaggatcataggacaaaaaacctacagcattggccctgccctttatcaaatcgcaggctggctgctgaactaaaaatctatccaattgtaatattaaggttggaataattgcagagtaaacaaagcttaacaagatgtttgtcctagtaagaaaattgagataattagacaataattttgacgcaatgctgtaaagactgccagaaaaaaaacatggtgaaagattctgctgagaccctcagacagaagccagaactaagcacatacttcctttataaagcaggacgagttttttagggtaggatgttcctcagaagtagtaatacccagctccacgatatttcttcctacccaggaccatgaacatgtcattctcttgccttgaatggctcactgccttgcaagaaaatcttctacatggaattccaggccttccacattttggtatcattctttcaggtgctcaaaactgtcacataagcatgctcagatctctcccatattaacagaaactcctccttgacagcacatccccctcttgtcaccaccctctttactttcaatcagcttctccaatcagctgtctgcactcactgcccatttctttaccaagcactgcaatgcagccatggctcttgctgcttcactgaaattattctcaccttgtcagtaaatccattgagcgc

SEQ ID NO: 89791 - DNA, 1424 bp, Homo sapiens
actacttgagaggctgaggcaggagaatcgcttgaacctgggaggcggaggttgcagtgagccgagatcgcgccactgcactacagcctgggtgatagagtgagactctgtctcaaaaaaaaaaaaaaatcatttcaatccagttcagtgctgttttagctcttttctcttcccttattgaagacatgaagatgctgtgttgatacttggattttgttttccaagctggcaaggatgtatttatgggctttgatgagtatacttaatatgctggaagtctttcagagggaagtctgaagtgtgtttctactgtccacggctgcagccacaccgtctctggagcacagagggatctggatctcacctgatccagattctgcactgttgcttcggaatggactctcagaaagcccttctcttctgtcagggctttttggtttttttctagacttttctcatgaaatcatttcagataatcaagggtcacctaattgaggttttactagacttctgtttcctttttttttattattatttttgagatggagtttcgctcttgtcatccaggctggagtacaggggtgcaatctcagctcactgcaacctctgcctcccgggttcaagcgattctcctgcctcagtctcccaagtagctggaattacaggtgcctgacaccatgcccagttaattttttgtattttttctagagacggttttcgccatgttgggcaggttggtcttgaactcttgaactcctgacctcaggtgatccacccgtctcagcctcccaaagtgctgggattacagcatgagccactggccgacttttgcttcctttacagattactttgcagattgacatccaggctatacccttgtttatgtgagcgaggctgtgttgtaggcactggcactatacttacacagaagttggcaacttctcattgccttgcacaaatgtggataatagtaataacaaactaatgttgaatgattagaattttaatcagttctttaaaagtagccattattttggcatgttaggtagggagagattcaaattatttatgttatcttcccaacttgagaatggcattattagatcaagccattagacttatagattgcggaagatttagatgtacttcttaattatgaaaattacatttaccttactcaaataaccccatatatacctaaaagttttaataaactaaagcatgaccacatgactcaatcagctgtccgtaataacctgtggtataggtaggacttagttgggcaaagggtgagatgtggccatcttcacgggctcataagagataaccaaggtcccttcaggtcggccagcctcatcatgcctcagctctttctaatcctgcttattagtaaggtggatgtttattcatttatttatttggtt

SEQ ID NO: 89792 - DNA, 1872 bp, Homo sapiens
ctttgtaacaaattctcacaaactttgcagcttaaaacaatacccatttattagcttaaagttctgtggggtcagaagtctgggcctggtatgactggcttctgtgtttgggtcttaaaagtgtcaccggactgtgttcccttctgaagcttggggttctctttcaagctcatatggtggttgcagaattcatgccttgtgttttagggctaaggcccctgttctcttcttggctatgggatggtggctgtcttagctcctggaagctgcctgtagttccttgtctcgtggctcctccgtgtgcccctttatgcttctgtcaggaagatcccagctccactaaggggtcctattaggtcaggcccactacaataatctctctcgattgactcaaaatcagttgattggtaacctaatcatggagagatatcccatcatattcacaagttctgctcacccttaagaggagagaattatataaagagtgcacgtaagggtggttttggggaagagggactgttggggaccatcttacaattctgcctacagcaatgggcaaatgattaaatttcagctctcacaaatgtggaaagtaatgctcaagagagaagaaaatcaatggcaaatgttagagtttaagataaaattctccatccaaattactgcatatggtgccatttgctccattttctccttcttcctaatgaggttactctaggacagctgtgaagattcttgtactcttattagtgagagactgccagtgaaaccaatatgtcatttgtcataaactttgagtcactgacccagaggtgagactaactgtataagaaataaacaaatgtgttctgcttgaccctgccccatgacatgaaaatctgtcaaattccagtttcttttaatatgacagaggctatagagctaagactgacccagtgacagcttccctctttttgaaaattcatttaataagtggaagtctataccttttaactctttgtggtgttttggagtttaataaagatatccaaagtttttgtgggaagcagtacatatatgttaccttgactaccttggacatagtcttatttggtcaaaggggtgtgatcttgagtagactgaatataacttggcagctggttgagcccctatggagtgaatactcagggacccttagggcaatcttctatagcattgctcctctacctctctgctgtcccagttttgggaattgctgcaatctgtcttcctcggttattggtagagaaaattactttttttttttcagtagaaccctttgtatattccttgttgcatcttcatctccctgtctgcatctttccttatctcctttcttctggtctcaagagctttgcccccttttctgttctgctgaccctccctcctctgccattgccttctgttcttgttcccactggaatcttttcctaccagtcttctctcttctcttgtctttcttcaacctttgcttctctacttggttctggatgtcaatttctatttaccgagctttgtttgctagacacgtattaggaatttatctcttaccatctgggggatctactttcttttcttttttttttttttttactttttaaaggtaagtgtatactgatagcctttcttcctgtgctctaatggttcagagcctttttaatgacttggagttattaaccctcacttttgaggttcctttgtaatcaccgagacacagagaaactcatggcatgttcttaagtaactcactttcttatttgaagagaggcttttcagtgtctgtcctcggtgtgcaggatcatgtagtcttggctccttcatgctgacctgttgcctgcagacctcagaatccag

SEQ ID NO: 89793 - DNA, 1120 bp, Homo sapiens
agtttttgtaatacaccttcatgtttgttctttgggacactaagtggggtaaagtacatgcaactatgcttccgttgatgtccttactaggagaactgtgtggagaaaatgtgtagagatgaactgcagtgactactaagatggtttctccaaagatgctctgcactgtcagttaaattttaggcacttttgtggctttaagtgacttttaattccatcccatgtttctccctcaatcagctggtttcctggataggacattgcccagaccattagtgttataaggtgataggcatgtggagctagccaatgttctaatatactggaaggtaacaaagagaacaagatattagatgtactcagagcgtctggttagtgaggattagagggaggtgtaataactgagggtgatagcacattttgggagtttctccaaatattaaatcactgttccttatacctattctatttattggttatttggcctcacaccaggcagcaagattaagctgagaaaaccactggatttggcaggggaaatcagattttcagtgagtagtttaggatttatgacagcagtagtgcttatgaagtgtagtgcaagagactaggtagccatcatagagggggagtccttacatatgttttgaatattttgaatattactcaccttttgaatattactgtctttggacttctaatggttgagaaagtaatagagtggggagacctccaagtgaacagaatcgccaaagaaaaacctactcacccaagtgagtacatcaggaaatgttaaacttaggcaaaggaagaccttttccttccctgctccctctgaagcactgaggcccatagtggccaaagataatgagaaaagatcatggaatttggtgagaggagctgactgactattggagtacgtttagtgcaagttggctagaaagggggtgggctaataaagttgcagtagacttgggaaagggcgatagtgcacattgggccattccttgaggaacaggcttggaaagaaaagaacatggtcattatataagctggataaagtctcagtgtattaaaaaccagaaagtacagtcctagcaccccaaagaagttgcttgtg

SEQ ID NO: 89794 - DNA, 1044 bp, Homo sapiens
acgcctgtaatcccagcactttgggaggccgaggcgggtggatcatgaggtcaggagatcgagaccatcctggctaacatggtgaaaccccgtctctactgaaaatacacaaaattagctggcttggtggcgggcgcctgtagtcccagctactcgggaggctgaggcggatggcgtaagcagacccgggaggcggagcttgtagtgagcctagatcgcgccactgcactccagcctgggcgacagagtgagactccgtctcaaaaaaaaaaaaaaaaaagtatacaaaaagtttttcatatattttgaggaaacttcatacatgtttcacttattaggtgcttaacatgtaccctagagtatttaaaatgctgcgatagactgagaagtttggaataatttgatttaaagtaatagatattgaattagtaggaagtcatctgattgtgtttatatataatattttaaataaaaatacatttatattcacagggtaaaccagacttgaatacaacattgccaattagacaaacagcatcaattttcaaacaaccggtaaccaaagtcacaaatcatcctagtaataaagtgaaatcagacccacaacgaatgaatgaacagccacgtcaggtaaggatctaattcgttctccaatcttatttttcagaaaaatgctggtatttttaccagaaataattcaaataaattctggttaaaatggagtatatttggaaagaaaattattttatgtcctaggctattacatgaatgctgaagtatgcaaaatttaggtaaaatatttttaagaaaaaatttaagaagttaataatgaatctaattcataatatggactaaatttttatgcttttcgtgtggtaatatacatcagacttggttctgctaatcttagttttttaaagattatctttccaaggataatatttcatagaagaatgaagcatgtagtttgtgttgcttagtttaaaaatattttgtattatttggaagctaaaactactttttattctgatttcttgttttgtg

SEQ ID NO: 89795 - DNA, 1021 bp, Homo sapiens
tttgtaacaaagaatttctgcttcactttttcttatattgaagatataagaagattgcatatacataaacagctttaatcttgtcccataaaaaagtgtctggcttttaactccgacggtgatggtagattggtcctttagattctaaactaaactgtagaaaaactcagacacacaactgggcataaattaatagtgactcaaggcagtcctcagggtagaggtaatagaattgactgtttctttgacagttcctgggaaaactagttagtccagctttacagattgctcagcttcatgtgatactgttttagaataataaattaaagacattctgtcgtcagagcttctaggccagttaaaaggagaaaaaatactaaaaaccaaaataagattgagtgaagaataatgcagcacattttgaataatgtctcattctgtgccagtagggaatgaactgtctcattagacaatggaagttagttgtatatcttaaatattttagccaggcttttcttttaatttttttttattgcacagaaacataagtgaatggaagaacgtccatcttaccagtgtagcatcaatagtttgacctgttccatgcttccttccagtcttcatggattcaggattcatagtttgaaacagtttagagtagttgcctccagtcatccttggtaacaatgagaatctcacaggtttgaatatgtttactcatgcagacggttgcaaatacttctgtgtgtctactgaagtagacacatgatgccacctttgttctaataccagcagagtatatcattctttattaagaacaaaggctgggtgcagtggctcatgtctgtaatcccagcactttgggaggccgaggcaggcagatcacaaggtcaagagatcgagaccatgctggccaacatggtgaaaccctgtctctactaaaaataaaaaaattagctgggtgtggtggtgcgtgcctgtagtcccagctactcaggaggctgaggcaggagaattgctt

SEQ ID NO: 89796 - DNA, 1022 bp, Homo sapiens
ttcagaagcaagcctcagttggcaaggtacctgggaaatactgttgatctcagcagttttgacttcagaactggaaagatgatgcctagtaaattacagaagaacaaacagagactgcgaaacgatcctctcaatcaaaataaggttggttaatttacttatcgcatgtatatgctacttcgaaagctcttcaaaaagtatctcacatcataattaagtgactggaattttggttgtccaaatgtcccgtgcatgtccccataccctgcccaccctgtcccagcaagagagagcataagtaaattgtgcacagtagaaaacagcatttcagtatctctctaggtcagtgaacatcatactttctgacccactggggctgtttacaaaaggtttctttggtgttaattgtctccttttttctttttcccctcaaaatagttcctgttgaccaaaaagtggcaaaattttaatgtgtcaggtatcttcaccccatagtttataattacgtattgattttcaggttcagattttgagaaagggcagtgtttttttgacctttgatgatgttgaggataatgactttttgaataatatcctaattctatgtttggatatttttccgttagcgcttagttttatcgagctgtttggttgatagtttattgtatagcaatttaagcaaatctcatttgaattatgatacagtttgaacattccaaatctgaaaaatatctgaaatctgaaactcttctggtcccaggcatttcagatgagagatacttaagcctgtactaatttaattatgttaaaggacccaatatctttacaaagaaagctgctttttccctggggacaactaaacatatgtgactattttttcttagtttttcttcctctaaacttcaaggatctgtgtgtatgggtattgccaccaccattgtcttcacactgacagtgaacatagtggagggagaagtaggggctctctttcttaagatgtgactgatgtaaccccataagtc

SEQ ID NO: 89797 - DNA, 1097 bp, Homo sapiens
ctgggattacaggcatgaaccactgcgcctggctattgcagcattttataagtgacataatggcagagtaatgttactaatttttcatattaatttaggtcattagtaatactttatttcttatgtggtaaaacacattaatcatgaaaatattttctagcttagttttaaaaattctttgccatataacttttaaataaacaataatatttatcccattgtgtctgcaaatgaaaactacatcctttagtattgaactgataacgttttttgctctcagaaagttaccttgttcagtgctagcctataatggtgtttgaagtttaagagtggcattgttgtttgactcagcaaggaaatatataggaaatattgtaatgaaaatagaatttcgagtggtagtagattatttctgacttgaattgaagaatcccagaagacttcctagttgaggtggaggatattttagctgggcttggaggatttaatagctttttgataggcaggatgttgctgtgctcctccttccatctggaaagacatgactggaagattcaaaggtatatggcatattttggtgatttagagtttggaatgtaggctaccaaagctggtgggaaaagagtctgggaaaaattatataacagatataaagctttcgatgacttattaaggaggtgaagcttttttgtcaacattgaggagcttgaacatttagaacttggtactggatgtgtggctgagacatgggggcgctgaaagattgtgatgtggccttctagcttggagaataaagcactaagtggacagcagcgccactgacacaggtgcggaatatagaagatcaggttttggggtggaactctggtgggcagagatggttcaagtttcggacaatattgcgagtgacttgctattttattttgtgataccgagtattctggaagtctaggttagagttggagttgagctttgcttgtgtagaatcctgtactctttcctctggttttttcttgtattgttcttgttgttactggttgttattttcatctgcctgctgaactctataccttgaattgtgtttcacgaatacttaa

SEQ ID NO: 89798 - DNA, 1098 bp, Homo sapiens
ataccttcctttttttttttttttttttttttggagatggagtctcactctgttgcccaggctggagtgcagtggcacaatctcagctcactgcaacctccgcctcccaggttcaagcaattctactgcctcagcctccccaagtagcagggattacgggcgcacgccgccacgctgggctaatttttttgtattttattagagatggggtttcaccgtgttgcccaggctggtctcaaactcctgagctcgggcaatccgccctccttggcctcccaaagtgctgggattacaggtgtgagccaccgtgcctggccccccatttcatttttaaaattaataaacaatagaaataatatgaagccgtgttaaactgctgatgaactgctaatctagatgataaacataagtgatcacatttcgtgagtatagccttttaattgagttcaaattatcttgatttgggggagagatctaaaatgaactggtctctaatgagttttgttctgtagaggaacattgtggtgaggctctattatgttttcagctgcagtggataactgacatttcaactttaagataaggaactacttattgcaggtttaatttgtgaagtttgtcaattgattccctcataaatagcttcctatttgtctctaagccataagctaagaacagtatgcttatctttttggtaagagttactgcctgagtatttcatcttctggaaaatgaatttgttgaaataaggtgtctactctagagctgttttttattgcacaaaagagatctatgtgagagacagctgattgagaattgtcattttattttattttattgagacagagttttgctcgttgcccaggctggagtgtagtggcgccatctcggcttgccgcaacgtctgtctcctgggttcaagcgattctcctgcctcagcctcccgagtagctggggttagaggcatgcgtcacaacgcctggctaattttgtatttttagtagagatgggttttctccatgttggtcaggctggtcgcaaactcccgaactcaggtgatctgcctgccttggcctcccaaagtgctgggattacagg

SEQ ID NO: 89799 - DNA, 1030 bp, Homo sapiens
tgatagtcttggtttgtatttcctcatcattaaatatttgatttaatggtaagaaagttattgtgagcactttcacaggtcctccctcaggctgtggggccaggatttggtagctggtgctgagagaaaacctttgttggcatccttgccctgggactgtgccagtggcagctgtcattcaatgggacaatttcttctgattaaaaaaaaaggttattgtggttaaaaaaagattagttttctcaagttcattagtttcatttagtgccgttcacaattgttcgttttctagtattctttcattaacagagcattctgttttctttctaagcaggctgtctgcataaccttctgtgaactatgtgctgatgtcttgtaggcaattatatttgacaagattattctgtatctgtgattgaactccttgaggaatagatgactaggctattctcagtagaacatcttaaactttgaattttactctgtggcagttctcctgggatatggtttgtttggttttgggatgatgtttttgttcagactgactttgggtattgcagagctttttgtttgttggttttccttgtagttggaaaagttatttcaagaagtcagattgttgtagtgctcatttggatttgtggccacttaacattttcttggatgttgtgtaaattttctgatgttaaatttattttattttttttgagatggagtctagctctgtcgcccaggctggagtgcagtggtgcgatctcggctcagtgcatcctccgcctctcgggttcaagtgattcttcagcctcccaagtagctgggactacaggtgcctgccaccatgcccggctaatttttgtatttttagtagagatggggtttcaccatattggccaggctggtgtcgaactcctgaccttgtgatccacctgcctcggccagtgctgggattacaggtgtgagccaccaggcctggccattaaatttttaaatacaaacttaataatttttttttttttttgagacggagtct

SEQ ID NO: 89800 - DNA, 1081 bp, Homo sapiens
tttttgtaaacctacagaaaagttgacagaatagtacaaaaaatacccattatgtcttttctttttttttttttttttttgagacagagtctcactctgtcgcccaggccggagtgcagtgatgtgatctcggctcactgcaacctccacctcctgggttcaagcaattctcctgcttcagcctcccgactagctgggactacaggcatgtgccactacacccggctaatttttttatttttagtagagacggggtttcaccatgttggccaggctggtcttgaactcctaatctcagatgatccgcttgccttggcctcccaaagtgctgggattataggcatgagccactactcctggcccattatgtcctttcttgtagataaaccagttgttatcgttttgccacatttgctttctcttgttctctctatggattgcttggttggttgatgagctatttggaagtaaattgcagacatcctgacatttcatctctaaatacttttagcgttagtctctttgaggttaggatggtttcatgtcattccaacactgttttacacctaaagcaaatttatttttatataattttcttacacttttcataaaagagctctaaaactgtgtacaggtcagagattgtttctagcagcatatactgctagtgcgtggttaagatttagatctttaaagtataatgttagctttcttgttatataataatacttctatgcctacttacgggtaaatatgagtaaaagttttgccaatgtcagtaggaatttttttatgagatcagttttcacaatgtgttaattattaagcactcccactacacagtcactatcacaggcccttggaatttgcttattgaatttgtttacagtattcctatgaagcatgaaagagattagtcaagtggataacagggtggcagtgatctcttagtccatttagtgttgctttaacagaatacctgagactgggtaatttataaagaaaaaaaggtttatttggttcatgattcttgtggctggaaaagtcaaggttaggcctctggtgagggcctcaggctgtt

SEQ ID NO: 89801 - DNA, 1103 bp, Homo sapiens
gctccttgtcattatacatgtatttctcaatattccatattccacagatgagtattatctgttttcgtcccatttctttgtttctcctcttcttgttagaaatttctcaaattgtggtttcagggctctaacagtttagagtaggtgtgcttctctaatgattctaggaggactaactgtatttagagaaaatggtttttggttggttctaagtctgagaaaactgaagaagtgaaatttcctccaactttgctgtcgtgtgcaatgtggcactcaaatgtcttgagcagagccatgcagctcattgttggctgcatgcagctggggctggctgtatgactggcctcccgtgatatgactcaggctgggcctgcgagtatgctagtgaaactgggtcatttgcttcagctaaatagaagactaccctgaaatgcctaacctttggagacagttcttcacatagaaaaaccacaagaagtataagttttacaggttctcttatttgaagagtcaacccagaagtgagaccaggtgctctaaacctgtgacatacaaaacctgtgaaattaaccatttgtctgtatctctgcttcccggctccttttctcccacaccacgggcccttatttcagtgactgaattataacaccatctaagtgacttgcaaaaaaaaaaattacaggagtgtgtgtgtgtgtgtgtgtgtgtgtgtgtgtgtatttgtgtataattagttttgttttctctagagtatgttatgattaatactataggtatgtaagaaatgtaaaaccgtattatttttaatccatcctctaggcactagtttaagattgcttacgatacagcctttttctaatgtgtcttaattagcatatcatactctttgaattgcataattaatataacacgtttaactggaagatatttaaactagtaaccatttaaggtattttatcctagttaagcagccatcgagaagttttgtcacaaagcagtaagagatagaaaaaattatttactacagaactatttaattttttatgtttttgcgatagggtcttgctctgtcacccaggctggatggcagtagtgcagttagg

SEQ ID NO: 89802 - DNA, 1668 bp, Homo sapiens
ccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagagcaggatcagatttccacattggacataaataagcatattcagcaaaaaggtctgaaaagcaagggaataccattattttcggattagcggtttattaagctcttctatattaaacactaatagatattcaataacggagtaaactgttccagataaagcaagaatagttgcaagaagtaaattctggcacaaagcgtaaaaatataacagaagaaataatgtaaaatactatcttttatgtctaaagccattttatattacttttcaataaaaagaatatcatggtcaacatagaatatttttcatgaattggtggggagatgtatatgtttatatataaaaaatagccaaatcgttgcaatgatatggtaaaggacacattttttttttttttttcctgtgaaatgtggaatatctcaaattcagcctcttaggctgaatagcaaatcctactgccaactaacctattaaaaatatagatagttttgactaaagtactacattacatttagtatgttgacttttaaaataccaaagcaatttatattcaattaatgcttcttcatacaccaagaatctaccacaatacacagcacacaaaggccgttcaataaacattgaatgaatgaatggtttggctagggccagggtggggagttaaagtgagaggagggtatatgttatagagaacagtggtagaaggaactctccgtgcaagtaaattaagggaaagatggacaccagaaaggcaaggtgatgggcctataagcatactggataatggaagaagtccatttctttctagctagtttgaagggcctaaaagcactgagatgtttttgtatcttccctacatttggagatgatattaggttgtcataacaaccacaaatatagaccattactaaattggtggatgtcctctttctcccattgttattgccttcctcttttgcctgctaaactaaaaattggatataagattgagaatgtattatataatttgcaagacatagaggatgtttatagaatatactaaagtatccctcagcaccaatatgggagtatcctggtctcaagtttataatttttgcacatataatctaaagaagagactttaaaaataaagtacacaaatatgaaccaaagagtagcttaaaaatactttcttctaggtctgaaattttcttttctttctttttttgttttggagacagagtctcactctgtcgcccagggtggagtacagtggcgcaatcccagctcactacaacctccgc

SEQ ID NO: 89803 - DNA, 1053 bp, Homo sapiens
cacaaaggcataagaatgatataatggactttgtggactccagggaaagggtgggaggaggaggatggataaaagactacacattgggtacagtgtacactgctcaggtgatgggtgcaccaaaatctcaagaaattaccaccacagaatttatccatgtagccaaaaaccacctgtttccccaaaacctattgaaataagtccaaacattttatcgtgatgtgcaggtaactatctgggccccacttacctctctgacctcatttctgaccacttctcttcattgtccctgtgtcacagccacaatggacttctgttgtttgaatgcactgaacttaaacccatctcagagccttcttagttgctctcctcttgcctggcaagctattcccccaaatgtttccaaggctaatgtcatttttatgttcaagatgtcagtttcattatctcctcttcagaatgaccttcctagccacgtggccaaagttcccaaatacacacactaaacctctatttactacattgttctgctattatcttcttcatagcacttcactatatgaaatttatcttctttgttttcttacgtattatatgtctctcatattagaatataaacttgatgaggatactaactttaataggcaccagactagaaataaatcactgcattcattgcagtatccctagcacaagaacagtgtctctcaccaagacacttaataaatattgaatgaatttatggacttcagttatattatattggctaccaaatgggaagttatatatcttataactgcagtacaaaaaaataaactcaagataatttttcaacacttatgccttttcttaataatttgctactcaaaaagggccttttgtggttagctttaagcatttgcctggaagagaagcagttctttggttggaatttcgttcctttctgctcttaagggatgaaatacagacctaccagcacataggtctacacatttctctcagtgttagaagcagtgaacagtaatgtcctactatatgtcaggcaccatgcta

SEQ ID NO: 89804 - DNA, 1031 bp, Homo sapiens
acaaaaggccctttttgagtagcaaattattaagaaaaggcataagtgttgaaaaattatcttgagtttatttttttgtactgcagttataagatatataacttcccatttggtagccaatataatataactgaagtccataaattcattcaatatttattaagtgtcttggtgagagacactgttcttgtgctagggatactgcaatgaatgcagtgatttatttctagtctggtgcctattaaagttagtatcctcatcaagtttatattctaatatgagagacatataatacgtaagaaaacaaagaagataaatttcatatagtgaagtgctatgaagaagataatagcagaacaatgtagtaaatagaggtttagtgtgtgtatttgggaactttggccacgtggctaggaaggtcattctgaagaggagataatgaaactgacatcttgaacataaaaatgacattagccttggaaacatttgggggaatagcttgccaggcaagaggagagcaactaagaaggctctgagatgggtttaagttcagtgcattcaaacaacagaagtccattgtggctgtgacacagggacaatgaagagaagtggtcagaaatgaggtcagagaggtaagtggggcccagatagttacctgcacatcacgataaaatgtttggacttatttcaataggttttggggaaacaggtggtttttggctacatggataaattctgtggtggtaatttcttgagattttggtgcacccatcacctgagcagtgtacactgtacccaatgtgtagtcttttatccatcctcctcctcccaccctttccctggagtccacaaagtccattatatcattcttatgcctttgtgttctcatagcttagctttcatttataggtgagaaaagatgatgtttggttttccattcctgagttacttcacttagaataatggtctccaactccattcaggttgctgtgaatgctattattttgttgctttttataactgagtagtgt

SEQ ID NO: 89805 - DNA, 1082 bp, Homo sapiens
ttgtttttaaaacttgcagatagatggacttcaaggcaattgcccaacaaactgcccaagaagttttaggttataatcgagatacatcaggctggaaagtggttaaaacttcagtaagaaaataagttaaattatgtttcaagactttgtttttaagtaagaaacaattcattgtaaagacttttttaaaaaaatattttctgttccaggtgcagtggtgtgcacctatagtcccagctactcaggaggctaacacaggaggactgcttgagcacaggagtttgaggctgtcatgcaccatgattgtgcctgtgaatagccagtacactacagactgggcaacatagtgagaccctgtctctgaaaaatatatatatatatttttttcttttacaaaccagaaaaaaaagtgtttttacttttgttagtttttcattttcatttttcctgcatttgacagctaattatttgtggatttttattcccctttgagaaaaagataactgtttccagtaaggcttctagaaaattccatggaaatctgtgagtacaatcttctatttacaattactgttttaaattcaatgccattgatgtatctggaatttcagtgctgcttcattagctataataaattattttatagtaataaatagaaattattaagtcactaggcagaaatgtgataataataaaatacagcaatcagataccatctaatcttctattttcaaatctgatgacaatcagataaaaaatctcttctaattactaattcactaaataggaaattttcacttcaagaaataattactataaaagcagattggtattttcttgctaacagtaatattttatggaattttaaacccttcatgtgtccattaaatgaaccactaacaagtaaagtgtatttcttcattttattttattttcttgagacagggtcttgctctgtcaccaggctggagtgcagtggcacaatctcagctcactgcaacctgtgccttctgggctcaagcagtccttccgcctcggcctcctgaataactgggactacaggtgcacaccaccacacctga

SEQ ID NO: 89806 - DNA, 1111 bp, Homo sapiens
ggtgtctcgcgttgggtaacaggcctgagctttcggcggagagctgtggaagtgtgcggtttttgtttttgttttcctttatttttattttggggccttaggggtgagttaggacggaaaggagggtgtcttttcgagggttgtcccatcctgtgacagccgagaaaaggcgaaaggagagtggcgaggaaagaggaggagacgtctcctgagggagggcgcttgtggagtctctgtggaaggaagaacactgtagggggagtgccccctgggcgagggagggtcgcgggacgcggcggagggggctcacacgggcgtctgcggacctgaggcggcgacaggaaggggcttgcgctctggggctgtcgcttcggaacacttctccttcagtccattgctgcgctcgccctggctgctgaataaatggtttcggagtgaaaagcatctcactgaagaacttgtctgtgtctgtgactgacgggcggtggaacaccaaagggagggtgtcgcctgattgggactggaaaaattggaattcagggcgcccggggtaggggaacgatgcgcactgctggagacgggcgaccttcgctggccggtcggtgggttcctggttttctgctgccgagtaaacaaacgttccctttcctaacttagcagtcacagagctatttccaagagttgttcttaatttcctgtgcgatattcccattggctatttaacactgaacattctgtttttgaatcaaagttagttaaaatttgttgtcaataagtttaacattctgttcttccgcgtgatggattttcttttggagattcgaactgaagcctgtacggaggaaatggtaagatatatgggatttgcatgagatatgtggggttcaaaataatcctgtggctgaagtggggagaagtgggtgggtccctacccactttagctacaattggggtctgttcagcgattgttggaagcaggatgatgagtacataggggtttattgaacgattctacttttgtatactcttttggggaaaagttggaaaacttttcataatgaaacttaaattgtgcattttctttttgtctgtcctgtgagttgaaataact

SEQ ID NO: 89807 - DNA, 2725 bp, Homo sapiens
ttgtatacatacttccagccacatagtaggtactcaaaaaatgttttctaaatcattgatgaaggaattcacaataataaatataacaaaaatctacaattcctaacaaggagtgtctgttatagataatggattttattatttaaagaaaattacaaaaggtttacatatttagtaattttgtttgtgtatggtcacttttaattggcatcttaacatttcgtttttgtattacagttgtttttaagggaaatgaatagaaacaatccactttgaagaagccatggcgaaatcaaagacaaaacatagactttgttctcaggaatcttcagtatctgccctgctggcaagctgcaccctgagtggtagtaattcctctaattctgatggctcgtttcactataaagataagctgtacagatctgcttctcaagctctacaggcttatattgatgattttgatctaggccaaatatatcctggtgcaagcactggaaaaattaacattgatgaggattttactaatatgtcacagttctgcaactatatttacaaaccaaacaatggtatgcttttattctttgttttctttgtgttcagatgttttgaagcatttgggagatgtactgtagtattgtaaagtttgacattatttttgttactttggagtaaaaataacataatattgagatctgggtgtttttgtaaaatgattatataattctctgtggaacagtaatattcacaagatgttaagagtttgtccataataaagcttccttgaagacaagtttggaaaatgcagttgttgataagtcaattactactttacttaacacttgcagaatgaccctagaatagaaaaagtttgtattcagttcttggagggatgtggtcaatatattccggaagcaaagaatgagaacagctgttctctatgtataatccatgccattgaagggtttgtaggtgagaaaacaagttatttttccacctagtttaatagcatatttttttctatgctgcaaccaatattgagtgaccaatgttactgtgattgtattagtgtatcagatatgtctagatgatgaaagttgaaggaacagtaaattagagaacacaggaaaattcaggaggttggagagaaacgtagaaattaacacagaacgaagaatcgtgagaaaaaaagcacatcctgttttatccacctacacctttttatgcttttaatcaaagctttagtgaggataaggggaaagcagcaaaatgcctcttaaattcttaattctcatttactgttggatattataaaatatttgtatgtaataaacaaaactgttcttcgtttttcagcttttgaaaaccttgatcacaaaaagcactcaaacttcatatcctgtagaagacacaccgttaatgacatagactccatgagcctaacaactgatgatctattaagactcccagcagatggatcattttcttatacttatgttggaccgagtcaccgaacgagcaagaaaaacaagaaatgccgtggaagactgggttcattggacattgagaagaatccacattttcaaggaccctacacttccatgggcaaggataactttgttactcctgttatacgctcaaatataaatggaaagcaatgtggtaggctgaaaaacccaaaacttatgaataggactaataattgcatttctgaatcatctttgtcttttcccaagaaatcgtctttcaaggacagttcagaacacagtcttgaaaagaattacccaagatggctcactagccagaaatctgaccttaatgtttcagggataactagtatacctgatttcaaatacccagtctggctgcacaatcaagacttgctacctgatgcaaatagtcaaagggtttatcagatatttaaagatgatcagtgttcccctagacatagtcatcaggcacaaggaacttctcggcttatcaataaattagattgttttgaatatgcttttgaaccctcaaacttttcaaattccttgagtgatgataaagaattagttaatgaatacaaatgtgattttgaacatagccagtgtcaatgtgagaatccacttctcccaggacaatccacaaagccattcagtggtaatactttgtttattgcttatagttatttatttttcttttttttaaaccaaaagaagtgctgtaaagttgatgtgatatctgggagcttttatgttttgttttcatgtaatacatctttttggaatgcttataatcttcacatacagcattttgtaactagaaaatgtcttttctcccatttttttctttgcttgaaatgtcacattttaacataatttgctgttatagatgaatgtacattccaaatgatcagaactcttgttgactttgtgagattttgctatgctttacattaatttttttcttcaaggattaatagtcatcttttacaattaggtgacaaaattgaattgcttatcttgaaggccaagagaaatctagagcagtgtactgaagaattaccaaagtccatgaaaaaggatgacagtccttgctcattagataaacttgaagcagacagatcatgggaaaatattcctgttactttgtaagtaagtggcaatggaaaaactgtttagttttccaaatgaaaaatgtcatgcgaatatctgatttatatttaaacgaacggtaattaata

SEQ ID NO: 89808 - DNA, 1103 bp, Homo sapiens
taggaagtactcaaggtagtattttaagtggtagagcaaaaccacaatcagatcattgcttttttaaagaaactttttattatggaaaagctcaaataaattacgaaagtagaatagcataatgaacctctgtgtactcttcaacaatctggtaaatgttttttaataacagatgggtggctctacaaagtgttagcaaagaataggggaaaggactacctgatagtatgaaagagcttgtgaattagaaatcaaatatgtcaataaagaagcatgcttattaagaaaaaacatcagcattctgtaaatgttaaaaaaagattcttagatatctgagttcttgagttacaaacatacctcatagtgttgtaagaataagagagaaataggttgaattcatttttgtgattaatagaatttgattctcggagcattcttatttttggtggggataccctttcttctactaccccgtgaatatcaggaaagaaatgggtatttattaaatgtactaggtacatagaaaattaattcagtttatgcaatatgtctgtgagatagatgggactacaaatgttgaaactgaaattcagataaattacttaaggtcatatagtgagtgggactgagattgcatgcaggaatgttaaatttcagaattctcttcccagaataatctgttctttatgttaataccagttataaaggggaagtctgttctgttgccttcaagtaggagaacatttaactgccattctagtaaaaacttttaagagtttatggggttgttgattattagatggtaacaatgtttaattggaaaaatgtactgtttatttcaaacaaggtgagcttttggagcacagtctgtagttcaggccttgtttagctgaatgttaatatcttcagtttcttcatagtgttttcttaaagcttgaagacagaagcagggagataagaaggggttggattctggtatcagtttagggagaagataagggaattaccatacaacattaatatgaatcatatccatgatgattatttcttggtgactacttgtatttaaatgagaattcttaaattatatactgtttactttt

SEQ ID NO: 89809 - DNA, 1012 bp, Homo sapiens
cttctggtagttatattcgaggaggcctagaaaactttttcaacattagattccttcacacacctttctcctttgaaatttaattttgttactgtgtgttcattggctgttatgaatacagttatatcaagttttattttagagccattttattttttcaatttgtgtatttcccgggaatttgaaaatctgtttctgttttaggctgccattctatatgatgaattttttcccacaaaagtatagtgtttaagaacatagagtttatattttcccaaatatgattgtgaattctgtcacttactagcaagtgcaatatttgtgcaaatcatttaacctctttagtttcagtttcctatttaaaaaattattgatttttaattgacaatatatatatattttgggtgtacaacatgatgttttgaaacatcatgaaatggctaagggagctaattacctcacatactttttgtggagaacatgtaaaacctgctccattagtaattttcaagtatacgatatgttgtttttaattttagtcaccatgttgtacaatagatctcttgaccttattcttctcgcctaactaaaatgttgtatcctttgaaaaacatctctgcaactcccgtccccacatccagattctacatataagtgagattattattcagtgtctgtctttctgtgctgggcttatttcatttatcaatttccttttctgtatagtgaggttgttgagaagacaaattgagacaaactatataaagtacttagtatagtgcttggtacatggtaagtgctcaataaatgatggctcattgttttattgttattcagtagatctgtgaaattgagttttcattacaagtgagtggatcagcttttgagaaccttcatagtctgctcatttgagttgtatttcttaatttctgtccttacattctaataatcataacattaatatgtagaatgtaatctatctttctttcccctctcattctaaacatcattg

SEQ ID NO: 89810 - DNA, 1212 bp, Homo sapiens
tgtgccaacatactagaatgtgaactgcaaggacccacaatatatcctgaagtcttactttcgccttctggccagcaaatgtctaatatttaaagatggatgacttctgttcttgaagcttacctggatttaaccttcttcagcatcctcaacattttattacctggttcaggatcattaagaaacttactggtttttatccaaaatcttttacgttaaatagacttttttaaagatatagttagcatcacttttaaacagcttaaaggaatatcaaaattgttattgtgtatctcatctataaggaagtctgttactttgaaattttcataaatttaatatttaagatacattgtatttgaaaattgcattaatagtggggtgatactgtgttaaaaggaatgttgtgttgtgacattcaagagaacctcctcatttaattagtactttgattctgtgtaagataatcttggtagtgcttgacagtttccaaacctttttttggagagatatttaagaatttaatattttgatattagattgtttcccagattttaattttggggttggctcaaactagtgaaaactatgactcaatggccaattgctttatcaaatttgataactaaaacttaaaatgaatatggaaaatcagaaagcaactctattttagagctattttgtaagagttgtgctttctttaacaccatctgtagtcttaagtttgtctctagctagaactgaacaaagctctataatttttaccaagcacttattattaatacttcttataagtagtaagcatctttactaacacaactgagaattaagtcataaaacataactaatacagcacattactgcctgacaaaattaaagagtactgtgtgtatgtataactactacaggttaacacttcacccaaatgatagcgtttttcctcagtagattattgtcaaataggaatttctaagcacattgagtcaaagcattttttccaagttaataaagtgttatttactatctttgttagaggtgacatgtcaaacactacagtgagctctgtggggttttttttttttttttttgcccgtgagttttttaccatgctgctctgaccagtttgagtggcaattaccaatagatttgttttctttattctatggagatgtttttaccactgacactgttttctgattatagtctgcttca

SEQ ID NO: 89811 - DNA, 1117 bp, Homo sapiens
aatggaatcttaaaaaatgggagtgttgggaagctagcaatttgatgttatttctcaaaataattatatcaccaactcaagtggcagagctagacagtcatttaatccagtcataattgtatacagttgaggaaactgacctaggacggttaaggaactagcctaaagtcatattgctatgtagagtagagctgaatgaatagaacattttcattttttttaacttcacaaggttaggggtccttcccagcattctctgatgcctgtattagaagcccacacccacccaatgcctgccgggttagggttctcctgagagcaagggtgtttcgggaataggtaatggcgggggtgggagcagcaggaatttgtattgagcctctcctgcaaaggaatttaaatgtatggcattgattttgaggtgataaaatatttaaagttcttatttaagtttttttttttctgactattacaaaagtttatttcacaaaaagtctaatatgaaaatgtacgtgacctaatttttacatcatagtaaaacaggctctatggagagaggacatgggtttctctgctgaacagccattatttatactcgttccaaggcttctaacatgatgatactatttcctcgtattaccaccattccaatattgttctattgaccactagtcgccatctccacacattcgtctatcacaaggttcataaaaggatcaaatccccgcaatattccttgcacatgtctgccaccatttaatttcaatgataacttcttgtccataaattttttcaactcgggagggtgagctttgctcatggtgtatactccgcgggctcacggatgccttggaacggaatgcatggcttccctcatgctcccgcggtaggcccggcgtctctatttaaattttatctatgggaccagtaatgtgattttcccatcttgttttcaggataccataaaacatgttttttttcctgttcaattttccttgtatatttgttagctggaatgaatcatacattgtaaaatctttgaggcaagggtccgtgtcttctaaatttactaactcttcccagtgtctgttatatactaccttctcatacatctctg

SEQ ID NO: 89812 - DNA, 1003 bp, Homo sapiens
tttgaaatcaaatgataaatctttccaaaaattcttgaagtgagtttatttaatccaaacatttatataacatctcagcgcatctgttttgagtgagtaaaattataatattttgggggctacttctaattttcagggaaatttagaatgtgtgagggaacaaaatcgaatgtagtggggaaagcatattaaggacatttataacagttttcagcagaaggagaaatccgcaagctatgtgccaagctttgctgacagccatcagtaaggagaaatcactcttaactgccacagcatcaaattattaatagataaatgggctcctttcttgaccaatgggttttctacactggaattgggtgctgaaggggtttacagagtctcgagattctggaatagtggatgaggatggagaaaaatggttttcagacctggctgctcttctgctgattcctactggaatacttaagcttccgcttgtccaagacctacctgcctgaagacactctgtttcagcttatccagagagtccctcgagttggtatttgtaaacttcacagggaatactgatgatccccagtgtgggacccactggattatatacacactccagttctgatccaggattgcttggcggtgcctggatcaccaacctgcgctgctgtttctcaatgattttcaattactcagtcctgatctgtgagcacatgtgcacagaagattggctgttggaactttgtcaaataacaaacatttctataaatcataaattactttatttgtgagaaattatttctgagaattattttttagtcaagattgttttggctattctgtgtccctttcatttccatagagtttttaagatcagctagtgatttttgcaaaaaggcaaccagattttgaggaggaataagttgaatgtgtagtgttgtggcattgttttaaagattaaatgtgttaatcattagtatttagtgcttagactaaatgataatagact

SEQ ID NO: 89813 - DNA, 1051 bp, Homo sapiens
caaaaattaatgaacaaaaaatttaaaactgaaaaacatctatccattaaattatattttttcctataaattagaaaaataagactacagttacattcaccccacccccagaggaaaacagcatctttattcaagttattcttacttttccttctgtatttttttttaaaaaagctttattggaggtataatttacataccataaaatacatccaagtgtataattcaatgatttttggtaaatttactgaatggtgcaaccattagcacaatccaattttagatcacttcatcattccccaaatatccctggggcctgtttgcaatcactcaccgttcttaccccagccccagcaacccctaatctattttgtctgtttagatctgccttttctggacatttcatacagatggaatcgtacaatatatagtctttagcatctggcttttttcagttagaatagctgttgaggtttattcaggttgtcacatgtagctgtagttggttcctttttattgcttaactaggatttattccatgccatggctatgccgcattttgttcaccatttggtagacctttctgcaaatacttttgcatggtaaaacagatacattggtgcagcttctatggtagcataatgtgagaataactgatatgagccaacctcttatttggtgctttgactctcttctatgataattttaaatatgaatgccaagagttaaacatccaggttcctattaagcagtggtgttttctgtgtgtaactctccaacaaaccaatgttaagaacttcttaccttggctgggcacagtggctcacacctataatcccagcattttgggaggctgagctgggcagatcacgaggtcaggaattcgagaccagcctgaccaacatggtgaaaccccatctctactaaaaatacaaaaatcacctgggcgtggtggcatgcgcctgtaattccagctactcgggaggctgaggcaggagaatcgcttgaaccagggaggcagaggttgcagtgagccaagattgcaccattg

SEQ ID NO: 89814 - DNA, 1028 bp, Homo sapiens
ttgtcaggacccaactctttgccgagcgctatgctaggtgcatggaggacaaggggctcactgttgtgtctttgaggaatttaaagttttgtggatgacattacaatcttccagggggcaaacaagggtgctgatggtgcatgacctcttagaaagtgaatcaagtgtcctctttttaaacacagccatttagtcacaaaagaaagcttagtttgaaaccagtccctctctgtcctttctctgctgggtaatctaatttgaatgcaaggaagtctggcagttgcaaatgctagctggcaatagaagcgcattttcattgacttcctgggattctttgcctccctcaaatattttggatacagagaacatggcacagattcttcagtcggtgctaatgatgagagaactgcataatggagactgtgcctcatccagacagagagaagtcgtgcggatgaacgcagcccgcccaaaatggaggccgcttccaagaacgccaggctagcgactacgagcggcaaagactgtggcaaccagtgtcgcagcgccaaagtcggtggagtctgccaattgaagacaattagcaagtgcgacttctcaattgtgttgacagatgagggagaaaaatcaaatagatgtgagagctgtgtttatcctgctgcagtgttttgcaatattatgtctattgatttgctttttgtccctgagttattgggtggatggtgcgctgctctgcctgtcaacccggcaagcttgccttcacagctgcttgtcaagtgagaatttctacacaaatcagcccaacccgtctcacaggggacattaggccaaagatactctgttatgatttaatggaaaggaaaaaaaaactgtagcatgtggctcaattttctttttataacaattggttatagcgtttggattctgtaatgtggcgcagcccgctgtaattggttttgcgagcattctgcaatccaggaagttaggctggggttgtgtgtggctgttatttgctgtcatgactgacc

SEQ ID NO: 89815 - DNA, 1001 bp, Homo sapiens
ctcattgcacaaagaaataattaaaaagaccttaatgaaattagtatatgtggtaggcagcctctgtgatgaccctcaaggaccccagactcctaatatacacacctctgtagagtcacattcctcgagtgtgggctggaaccagtgacatgtttttaacaagtggaaaatagcaaatgtgatagtatggcactttccagataaggttccaaagaaactttggtttctgtcttgcctgccttccccgcctcctttctctgagccttccctctaggggaagttcctctagggaacaacaactcatatgttgtgaacagccctgggaagagacccatgaggcaaggaactgccagtccaagggccccgaggtcagctgtgggaatgagctgggaagtagattcaccccagttgagtcctcacggccctggccaacacttcatggtagaccctgagccagagaactgaactacgccaccgagattcctgacccactctagctgtgagattgaaaacattagatgttttaagccaccaaattttcaggtaatttggtatgcaattagataactaatacagtatttaattatggttaaccattcagaaaacaggcaggatcatctgaatgcctctaatgatgtttataacattttccttttgtaagcttgaaaaacatagatggttcatttcagacagaataattgagttgatactaagtggttggtccacttgctccatgttctattgtccgtctttgatcacagtgagtctggctgatgattagcaatagatccagagctgggccaagatttcacagctagatagatgtctgataaactaaacagtgtgggacaagtcacttagcctgctgtaattctcaagatgatcagggaaaaactggtatcctcagtggcttagtctccaaagttcagcaaagttctagtaattactcaggaaagaactaagcttttgcttcactatttgagattgtaccttccctagtc

SEQ ID NO: 89816 - DNA, 1617 bp, Homo sapiens
atcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatact

SEQ ID NO: 89817 - DNA, 2746 bp, Homo sapiens
ggtgtcctcagagcctccccctctctccttggccggcccacaccctggaatgggagacgcatcgaatcacatgggacagatgtaaaagggcaagtttgttttcagccatttctgagatcgatcattcaaaactctcatcagtgtatcagccataaaagtgaatttcacccaaattgacagatattttctttcatggaaaaagaattttttttaaaaaaagcatactttttctgttacaaatatattaatgaattttttctctcttttttcctttctcaggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaa

SEQ ID NO: 89818 - DNA, 1007 bp, Homo sapiens
agaagccgggcatgcagcactcactgtgaagcaggaaatgaggcttgtccagaatgccttgctctggtggaaccaaactgagtttgagaggccattcctgtgtttcagagcactttcaaaactattttctaaataccctgttacagaatttcacccaagctattggtggtcaacatcatctttcaatagctactatcttgtttttctttaaattaggatatttgccttctctagtgttctgtcatctctcctaatctccacaactatcaagtatttcggagagcagattagcaacctcaaccgaaagttttgaactttatcaatatcatactttatttttttaaaactgaaaaaaaaaaggacagaaaggtaaaagaacttgaagaaattcttttagccatggatgagtgataacagctgagaatccttgagcttaccatttgatatttctatattaatttaaagaaaagtcaaaagattttgaaaacagcaatagaagtaagatcctttaagctctattcagcagcccctaagaaaagtgatgaggacactgtgcatgcccatatgtgaacatggttggccaccttaggtatttccccttctctccacatgaatacatattttactcaaattcagactctatgatgttgaaacagtctggcattggatgtttacctcaaaaccctgctctctctgcacctaggacaaacaaatcctagttctctggtgtttagcatcttggagccatgaattttaaataaatcaaagacaaaaaccttgtctttcccagttttaaaatataaaagatacacacacacacacacacacacacacacacgtgtatttaaaatagaccctataacctcatcatattcttacatccttacatggttttcttcttaaattgtggaggaaaaggcaggcagacacatttaatagcacagtgatcatcattttttaaatgaactgttacagggacataatcttaaactatccataatttggaa

SEQ ID NO: 89819 - DNA, 1092 bp, Homo sapiens
cttatgttgagctcttccaatctgcaacaagtcttccagcaagacaaggctgggcatattaccagaattcaccctgtatgttctccttcggaacttttgtatctctttgtcttgtccagccctatctgcttatctctgtacacctaatacccacccattctcaaagcactgactcaaatcattcttcttccaggaagccttcccttgctaccccactcatgctagccatttttttctctattcttacagccctatgaatcataccatttctagatatttatcttaaccagctccgcatagctgtgcatcttttatagatatgactctgccttaccaactgttgtaaattcctcgagtctcacatattatattttgtctctctccccccgacccctgtaaatagatcatccatagaaacgggagaaaagaaacgaggaaacttaacattctgtgagtgtgagttggcagcccctctgctaggcgctctgcatgtgttgtcttaggcagtcttcacaacagcccagtgaggatgataatagtggtcatttcaggtgtcggtaaagtgagccttagaagtttgagcagttagtctcaagtcctgcagcgggatttaaactcaagcacatcaactccaaattcaatgctcttttttactaccaggcatactctccagagattatctatgagaacaccttttcagaacttattttaaatgctaggagcttgtgattttcaaaacttgataagtgttggttggcaaaagaagtttccaggtattccatggctgggttcccagagcagctctcttcccaaatgtatagacagagaactttccctccaaagtggtggcatgcttggattaaaacccacattatctatgcacttattcttaaaccaacatgtttgcgctgagtgcctaagaggtgtgaactctccctaccagggtccttgaggtagcaaattttaagttatcaagttatttttcttactataaccacccacttttcttccaaaattaaagcagaaatctctgaatgtgggagaataaggaaatagccaggtcttcactaccctagttagaaactcttacca

SEQ ID NO: 89820 - DNA, 1052 bp, Homo sapiens
gaggatgaattgctgggtcattgttggtgtttgaaattattcattttggtgaccctggccaaagtgtacaatttgagttcatattataatatgacattgctagtaattcaaatattagtgttttttttttaattaaagaagccaaaatagtgtctgtcaattctgagtctgggagatagaaatatatggtatgtttatttgtataaatacattgcatgtgactgtgtaatttaatagagtagctttactactacctatttagaataagtctttatttgaattatatttaagcagatttgtccatattacaattgtgatttttttcctcattacttttgaaaggattttggagataattctttttgaggatgattatgaagattcagagactcttcttaatagaatattaagtgatgacaattaatgaggtgaccagagtggtggagaatgtaacttgaccagtgattctctgtagttctgatcctcacaagctctacctcgtctctaagcaccttagtgtcctattttgccccttacaggctcgctaaaagttgcttggatgaaggtatattttccattatcactgtagcatttctcgtttaagcatggtcccaaaaggaaatgcaaaatacatacaaattattatgaggttcttttaagttcttgctcagtagtattctcctgtccatctttcagtttctcttaataaaagtctaagattaagagtaccattctgaacggtgtagtattgaaatctgcaaccaatttgaaaccaaaaatactggtttataaatagaagcaacgaactcacatctaaaatgtggaaagatatttttgaatgccaaagagaaatctttttttctttcccttgacctctgccctaaaaattcatcattgaataaaaattgtttatatgttcatggcagttgcttagagtttacaaaagaaaagtctagattttaatttagcttggcctcaggtaatgtgttaaatacacttgggatgcatataatatgagattttcgtttgtacagctcttttttttctaacta

SEQ ID NO: 89821 - DNA, 1438 bp, Homo sapiens
cgaattctatgctatagttggggctttgaactcagttagatgcccccagtgaacagttgattcaagtgtttgtgattcttcagtcttaaaatcttatactactttagttgacagaatttatataatttttttctgtaaccattttgaggcccttacacgcataccaccacacacccactggttttgatgacaggaagccagaaacaccggtaaaaactcaacaagaaattatcatccatttgcttttccctgtctctgatttggtacttagcactgggtcatataccacagggaagaccaaagaaatataccttcaggaaaagaatttaattaagaaactataaataggtcatctttccagtggtaattgtttaaaactctttaacttaatacctgccagaaagttccttaaattcagtgaatgtttttctcttctaaaataaatttaaattgcctttcaaaaggcagtaccgtatatagcacatgtatgttataatgtcctggaataattattgaatttagtttgttcatgaaaaataacactataattttaacattaacacgttctaccagttttctggaaacaacactatttgtattattgttttaaggaaatacattttattggaaacatgtatttagaaacacagtgtgttttttgtcgactaaaattttacttgtataatttaggcaccccttttgaactaaatcaaattttacatcatttgttaaccaacagcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtaagtgatgaaatttatagactctatagttatcatatagagttagaatttcagatatagatactattgttgctgttttttaaaaaatcagctttattgagatataattcacttaacatacgatgagcccatttcaggtgtacaattcaagtgttttagtgtatttacaaggttgtgcaaccatcaccatagtctaggttttgaatatttttgccccctgcaaaaagaaaagaatccccgttgcccattaagcagtcattccccatccctccacttccagcccttggcaaccacttgtctacttcctatgtctatagatttacctattctggatattttgaatatatggaatcatacaacatgtggtggtcttttttgactggcatcttttacttagcatgactgttgcagtttttctacagtttgccacgtattagagctttattcatttttattgtcaaatagtatttcactgtatggacataccacattaca

SEQ ID NO: 89822 - DNA, 2579 bp, Homo sapiens
aatagctacctagggcatgtttgtaccctttggattgctactgaaggtttaagatagctatatacctatacaccaaaaaataaaaataaaatatcctaagaactatatatttgagattcatcttctctgcatgccgtaatataattataattccaactttaattctatttattgtatatgttaaaaatgaaattaaacattttcaatctgagattttttaaaattaatacttctttacatgcttttaaaacttgtcaactttgtaatttctcaagtacttttcaccccaaagtttaggaacaatttaactttttagttggttttcatagaaaaaacagttagaagacttctaagaaatgtttcctttagcagtaattaccttgcgacttgacataattcatggtagaaatatactctgttgttcttttacagttcaatttttaccaagaacactttaacttttttaagtgtttatatttgtttgacaatatagagccacttgggaagaaatgatgactgtcttctgatgtaatcagctaaccaacacaaagatgaataacacaacaggcagtcattttcaagtatatgaaaaaaccctattctataaggcaaggctgaatgcctcagaaagtcatggttgtctttgtcctttacagatggccatcacagcagtgacccttggagctcctccagtgggatgaatcagcctggctatgcaggaatgttgggcaactcttctcatattccacagtccagcagctactgtagcctgcatccacatgaacgtttggtaaggcagacatacacggtaacgggaatgtcacagctagttgattaaacctcgtcctctgtctttccatgcatatacacaaggactctgcaaataagtgcaaaaatggcacacacccattattcttaagttgtattgtttctgtgatcaaagacataacaggttcaaatcacctttgtaaattcttccagattctctctggcattgttcttttgtttattgtgttttgctctgtgccttctttatcacaatgtcagcttccttgggtacataaatagatacctatttaagttgtagaatcttaacatggtggttcctggtttttttttttttttttttttttctatctgtagtttcaaaagatgtactgcagagggcagagtgacagtcggtagattatatgcatcacccaggagcatttcatttcccattgactggcctatgtcagctttggcctgttgtgatgtatccaaaagaaggagtttgtattttctgtagacttccatcagtaagagaaaccatgaggtttctacatagatcagattcccatttttcagtattttaactttaattcccatcccagcctgccactcatactgtgttttgcgtcactccaggtgaaaactggtgggctctagaatgttaggtctttcattactaaacatttccactctgtccatcacctacattcatctatcatagtatgtctctttatcctggaggaaacaactcagctgactttcttctagccttaaatatcaccacagcccagaatccactgttgaacttaagtctgtcattaaagagaggaaagagcctagatcttgagtgagatttgggatgcagataagatgaaacttgaatcccttgtgcaagaacatagcttaaacaatatgtggacctcacatcctacaaatgcgaaagcatatgggaaatccagtgatcccaggtgatacttacatcactactattcatcttgcatttgcccctttttcttcttctcatatctacacttaggtttctttctctgttctgataaaggaaatcattctggattcatgtggtctttgctctcttttgctcaaccagtacagataagaaacaggatctgatctcctactccaataatcaaaaaaattccagaagttaagatttctgatatccttgaaaatccgtatttagttggtcctagtggtagagatgctaagtagtcaattagcctatacattcctgagaggcagacagtggaaatggtattggcctttttgtatcacctcccaagattgaatgtgtaaatcacaaactatctcacatttcagcacatttccagtaaatagcagatgacttattttcaaattttctcttttcccacctcctatttggagatattagagtgaaagcttagagaaatatcaactatatcaactattattatgctagaatccgttttggctaaaattttcatttctgcaccatcattttccacttctgtgggaactcatggtcaaaactgtatgtgtcctatgagcaaggaaagttttgattacaaataaaagttttaggcactataccgcatgttggaatttcagttcttttaagagttgcccatttgacattaatttttcttcccttctgtgtttctttctttcttctcctatcatgctcaagagttttgagttaggcgatttgattttatcctagtccagttcactgcatgggaagtagctttaaaatgtgcttccatgcacaaaaagtataatttcaaaatggaaaccaactatattccttt

SEQ ID NO: 89823 - DNA, 1076 bp, Homo sapiens
ggccaggctggtctcgaactcctgacttcgttatccacccacctcaacctcccaaagtgctgggattacacgcatgagccaccgttcctggccgatattttattttcttaaaaggtcattatcagatgccacaagagtatttctataaactatgacccaagtatagcctaatgttaatagcttaaaataggttttatttaccttttttgccctttaaaagcaaggaattattttttaatggaaagaacatagactttgatgatcagttcacatccttgctttaccccttgaaaaatgtgcaacctggaaagacagcttaacattcctgagtcacatttgtccaaataatacaaacaatggcaacaagacttcagcactaatgtctgatgttttttgtatgattaatctgtgccaggttccattctagtttctttacacacattataccatctaattctcacaacaactttgcatagcaggcattgtcatttccactttacaagcaggaatctgaggaccagagttaaaagtaactggtccaagattgcctagttaataaatggtggaatttgcagtcagacccaagctggtttgggccaatacacttgaccttcttatgatacgtcagccttgtgaaatagggcagatactattaataatatccaccttgtgtgatcattatgaaggttagatataatgtatgtggaactcttgccaccaaagtggttccacaagaggccctaaacaaatgagtaatcattattattttaaaatgtccgtaagtgaaaccgatatgccaagaccagtaaaaatgagagcttcttaaggaaaagagtaggaggcatacctttgtttcattttgtttgttggtttctgtgcttgctttttgttcttttctgttaggcacaggttttatttagaataaattaaatttttttttctttgatgagtgcagaaataatagttggaaacattgaatggaacagctaatgtaccatagtaatacttcttggattaccaaaaaaaaaaaaaattaaatctgtaaaatgaaaacatttttgtttactttggtcagt

SEQ ID NO: 89824 - DNA, 1052 bp, Homo sapiens
cttacaccatgacttgagttcctgctcatttttatccctgagctctgcagacttctaagcagtggaagttttcattctctttcccacattgcactcaagagagctaacatgagagattctaaatcctgggattcctctgcatctggctttaagtacaggagcagaacacagggaatttaaggaacaaaaatagccagagcttcaggcttcttccactgatggtaagtcattgacatgcacttggatgaaatcctgtatctgttctttggactagcactatcgcctgagattatcagtttcagagagttacagagaggcagtagatttcatctttcctatttcaggaggagttattttggttgtttaaaaaaaaaaaaaacactttaatgtacttttcctaactccttcactcagatggtggcaagaagtttgacagaataaagtaattcagctaatatttatcaaatgcctactatgagtgagctgttagaatataaccctgaacaagacaagcatgagataggcaaacagactattaaaacctagactgataatgcattgattggggtgtacaggctccttaaggtagatatacaaaggacaactagtccacatttggccttagaggaagtgaagtgcaaggatgaatgggaattaagctggcaaaatgcaagggttataactggaagcaggggtgagcatggcatatccggtgacccagaagtagttcagaatgccagaagcttatggtacaaaaggataacataaaagatgagactgaaaaggtaaacagtggcctgatcaaaaagcgacttgtgagccctattaaggagttgagattttatcatgaatgtgacgaggagcctttcaaatgggtatgcctgagaagtaattgaatttaaaagtcaagacggataggaggacctggaaaacttagagtcagagaagccaagggaggcagatctgaccagaaggaggaaattgtcaacagtgtcagatgttgctgaaagatagaagtgacatttggctgcagcatccaggaggtcttgagc

SEQ ID NO: 89825 - DNA, 1030 bp, Homo sapiens
ggatgccagcacaatgcctaatggagtgaaaaattgtgcttattttcacaggactctcttggagaggagctaactactttcctctctcttaatacccagaccctctccctcagccctgacagcacgttacagaatgcattcacttagtgtgtgaagagctagctcaccacctccctttaagatctattcttgttattcatacattgcaaatttgtacttttgtatccacaaggaagacattactaacttcaagaaaggcagtgtcaatgaggagcaggaaaatacagtatgatacaagcctgccaatgaaagaattatactcagactctatgcgctctgttaaacaaaatttgaacctttgaggaaaaaatattggggattctgatgagtgtttttactctttctttcctttttttttttttttctatttggaaatcatggcttcctgatcctaagggataaaaaaaaaaaaaaaaaaaaaaacctcaaagaaaagactcaacaggctttctggacatcaaatagttcctacaaaacaacattctgatgacttgcatgtaaagaaatcagaaacatatgaattaagcttctctcgaaatacatatgggttgaaaaatagagagaagtgctgagaaaatgtgttttgggttttgctgagcccatgacgtttgaaaaatagtatgagacattgaacaaacacaaagcatggcttggctcacccattcctaatattagccttctagttcaacggcaaatcagtttaccatgtgcctaaatgtgagccaccttggtgcactcccccacacttaattatatgcagtttaaattttttcaattaggagctcaaaaataacattgcatttcaaggaaatgcaaatcttagcattttcttacctggtttgttcacctcagaccattttagaaaacaccacagattatttcaccttaggagcagtcacactgatgtggccctctttgatgtggctggcatataacagaagaaacgtatcatttttaagaaactggctcc

SEQ ID NO: 89826 - DNA, 1093 bp, Homo sapiens
atgattgttaaaagcgtttacattttaaaggattcctgtaatagcagatcctcttggcccaactttacagtgtcacttttgctgataaaatcatttaggattcagtttccttaattaaccccaagaaagatgacttacatgaatcattatgatatcctaacctctagactagagaagctgctttacctttcagatatgacattgaaaaatgcaaaaccatacggaattgtttcttatgaaggaagttttggttttatggtgcttttcctccattatctttagatgacgaaaaaggaaaaacagatgagaaaggacaaatagatcatggctaagtagctttaggctagcacttgtttttggaatctttaatacatttttaatcttcatgttgaagatccatttaacctgttttaaagttagatggtgattcctgggttcagttggtctgtttaaatgtttaccttttcaggataatccgtattagaatcttgcatctctcaatagattacctatttaacaaagtaaccaatttaagaaaacctaaacacatttatacattaagatattttcctgtttcgagttagatgatgtagtatataaaatatatggctggcctgatgtggaattatgtatagacaacagtgtcttcacagatgcattgccaatagggagctatgtagattaaactctttggccagtcctaggctttttacctgtgtaactcaatcagaattgaaagcatgacaggttttatgatgatgaatgtatggctggattggagaaagtatggttgggtgggtagatagatggatagatttcataactagacagtaatagataatgccaattatttattactcaaacttgtttattcctcagaaatttttctgcagagtattattttgattattgcatgtagttcagaacatttagttgaaaatgataaaatatttgctgtcacataatcaagactgctatagagttggttctaaaagttccagagtgaacatacattacctgtgtcaaagttagaggctaagactatggagggccataagatcacaaagtcagactatcacatactaagtgatca

SEQ ID NO: 89827 - DNA, 1890 bp, Homo sapiens
gttagattttttttttttttgagaggatggtactcataaaatcaagatcgctctgtcacaggaaatgtatttataggaactgttttaaggcgtttattaaaaacaaatctggtgatgtgtatctctattgattcaaacactagaaagaggcaaattgtacacacattatagttagaaaaaaaatagccatttggaacaccagcagaaagcttttgaaactgcggatggctaccagttgtccatcttagctttatgaaacagacagcaaagtccagttgtgtgtgtcccaaggaaggggccaattctataccattttttaaaatgccctcatgcatacactgaggaagcagatttttgtttattctacagtgtgtattctgctggctctaattctgcattgagtggcttttgatttggtgccagacatgttgtggagattgtatataccatgcgttaattgttcaaaatgcctatcgaagagactttacatttcttgagttttacttatcgtttggaggttgaatatctatgcttttttgtgtgtatgtgcatgtctaaccaatgtgtgtttgaacctgaattgttgaagttaagtgtggtcagctatttgttgcacaagttttcctctgaagagaacacagcactgaattccttcttttttcccagtgacaagtcaattacttgtttaaattcagtttgaactccctgaactgagagaggccagaggaagcaggttttccctgtgaataaacaaaagaagaaaaatggaaaatcattccaaaacacagtgattttagcttgtgggaagaatataattaagcattacaagaattatggtttcttcttttatgaactggcaactatagggtttgtaaaatcagttgtcctctaactttctagcagaaatataatcaatgatattttaggacaaacgaaaaaaacgtgaatttttttactaccttaagttatgaagtgtttccatgtccatatcccacaaaaaaatttttccttgtttctgtgaacaactgtacctgtccagaagtgtggactctgaaaaaaatacttaacaaaaaatcgtaacacaagagctatcaaagaataaattttggatataaaccagaatgtatttttaaaaatcagtttctcctcaggtgagagtttcatgaacttgataaaataatttttgtgatttttttttcctctatgcattagaggtttaaatactaacggatccaaatctaagcttaaaaaaaattaaagcaccacttctgaactacgaaacagatttttttttgcagagaaaatcagtagcttattttgtgttggaaatacaagcttgtatcaaagtgtgccaatgtgtctgtccttattaaggctataagaagtattaggcattacctgctctccaataagtgtagttctagctctaaattttgatctttatggcttcttgcatgttcattgaagaagaattttaataagtgattatttggtcaaatttcacatatctaatattatagcatatccacgaagataaaattatggcaaataaaactgaaaacaaaagtggcgaaatgtcctcgtaatggtaattgaagatcacatcatcagctctcgccagcatgtgcatgtgttaaaccgtagagagaaacctgtaattattgtaattgctctttttgctttatactaacaagcttcaaaccatgtttcaaagtagttgttttgaaatagttatttgtcaaatcatcaaatctcggaaagtaaatggtaatgagctttttatgtttatattctgactgttggtcatattatgcagcttttcaagtccataaagttcagagatgaaactggatgttaattatttctgatatcaaggccaaagaataaaat

SEQ ID NO: 89828 - DNA, 1047 bp, Homo sapiens
tatgggaaaatgcaactgaaggaattgttgtgaaaaaagggacagcgagtttgaaataaaagttgttagagtggtactgaggagaaaaaagaatccgagaccatgtactgcgcatacacaatcccgggcatgggcggcaactctttgatgtactactataatgggaaagcggtaagcgaatgcgggctgcgagggggatttttgacaagttttattgtcgcagggatgagcatcctaggtggtgatcattgtttgcaaagttgtgcaggactgccgcaccttcctgggtgccatgaaatatttatcatttgccaatcctaagatcttcttcttgcctacttcttctccttcgtctttttttccccccactcctcccccagagtagaaaaatagatgctttcagagctttagagagtggatcctagagcgaaagtttgcagtcaggtaaagttgagaggtggtatgattttttttttttaaagagttttggaaaattcttattccttccaaatgactgttagaaaggaaaagcagatatgagaagcagaattgagaaagcccaagttaggctgagaggaaatttggggtaagtttctccctggattgaggttttgtgatatctaaagtcttactaagttggaagcttgagtgcagtggatagagtggagagaacctgaaaggttaaaatagagcaaacacataaaactgagagatcaaattaaggagtagattatataagcttagatatatatttaaagccaaaatggggaaggaaaaacaaacgggttcattcatgcatataacagtattgtcataagttatttgtgctgtgtggcttcttccctcaatttcccccccttccaacagaaacgctttatttaagaaaaaaatgtgtctggtattttgtgcataaccccagcagaaggtttatacttgccatctggaggtttattttttttttccttcgtctgggcccactgaaggaaaaggatttcaatattttcaaatcggtatgtggggctctcgggaagagttgttgggtgatag

SEQ ID NO: 89829 - DNA, 1033 bp, Homo sapiens
attgagttgtaaggaaataggtgctttgaattattaaagttgattcttgagaatagatgtatgctcgggtggcatttgcttcggcatatgcaaatgatttagtttcatttgggatcaattcccagaggccctcctttcctgtgatgctctgaatttggcaagctcaagtcagcccatctcctctccccacatccctccctttctttctttcctttttttgtacctccccccgcctttttgttgattggtataatatttttaaaagacaataaataaatatatcaacttgcttgtgagaaaccttgccatctataaggattctattgttcagttgtgatcaataaaggtgaacaaaggttttcacgttcttaaagtttagcaaaatcgaagtttagtaaaaatgtgcatgagatgtttgctaaaatatttatacagatactgggctgcggggatgctgcaaaactctgaaaatgtggtctcaggggtgcctttggggaaactgacagctgtaagatattcgtcggttcgaaggtaccaataaacttgctttagagcccagcaaatagcgtgaagttgcagtagattgtctaaagctacagtgaaagcacccaactccagagtggagaacgtgcgcccttggggcgcccagcgccagcgaggggagcagcgccccagcccctccgtaggctctgggcccatgcggctgtctgcggcggggcgaggtgaagttcatgggcggccgcgcttcccaccagctccggggaggccggggcccgcggagcccggggcgggccgcactgctactctgtttcattccgcaaccccgttttgtaggttgttgaccaagcagtcagaaaacactgccccctctctccttttgagcgaggtcagagacgtggtgtttttttttttttttttttttttttcttccctcccctttccctcccctttctccgagtcgagttctcaggcagctgcgtacaatgctgggagctagccagcagcagagacagatggcagagttattagatgt

SEQ ID NO: 89830 - DNA, 1142 bp, Homo sapiens
ttctcactcatcacccatacctgattcagctgggttaatgttaaaagccaaaatttatcaatatcaatttttttcccaaatcattcttattttagtactgtttatgctcaataaaagtttatgaatttctttcactgttatttaatgaaaacccagaattttttaaaattgcacattatctctttaaaaaaagtcttttagattactcgtgggatttactctaagttgttgtcttttaatagaagatgatgcaaaacttgtctcacctgttccttcctggtcgtgtctgtgtttatgtgtggggtgggtatataagtgcttttgattaacagaatgaagagagtgcttattttgaaaactcagtcgttaaaattcaagtttattttgagttaaagaacaccatatttagattaggaatggaccaatgacctgcttaagctttaggctatcgattggccttgagggaacttagatctgctaaacacgaacttgaaaaggcacttcagtgatggatgtacgttggatgctctcactgtatggtcattcacttgcattttaaaatttatgttttgtttttcctttatacctactcttttcattccgtttgtcagaggtggccatttaaagtatttgacaattgtttgttctctgcctagcaagttgtcctattgctccatgatgtgaaagaacaaaggtaatcaacagttagaaacctcaggaaattgctagaatcttcacccccaaagagggttaataaaccctagataattagttcatttagaatgaaaaccattttcattgtaataatcacatttcccctctgattatcgagcaatgcattgggaagcctgatatttattcacaaattttttaaaattgagaacatcctgtgctgagattccagtcagcttcatccatccattttttgttaaaagtttctcaactatcatccttcatccagacaaataaacataaccaggatttcccctctaactttttgggaattcatttacacgtgtaccattttgagggaaaaaaacaattgtcctcgaatttcatttgactcaggtgattgtggtaagctcgctaaccagcttcatctaggaagtgcagcaatctgagtcaacttcctccatctctgt

SEQ ID NO: 89831 - DNA, 1028 bp, Homo sapiens
gagttcattttgtaatgctttataagggtctggtaccactgattctccttgcagactaataaacacagagcttatatgactcttaaaaatacagtgatagcaagtgcatcctaaattatgtaatcatgtggtccatgataacagtgtaatatatgatatacagatggaatcagccacctggcttactgtaattgttgttgaggtcctttgttatgaacatatatttctgttaacaatgcaacaaaataattttttaagctgtttttttttttctgtactgcctcaaatctagataaacggaatgtgttggaaaggacaacaaataagaagttaaatatgtggaaatgacatggaaagcacctgtttcttccctttgttttcttctacgtcatcaggaaataatatttaaccatagaatatggtgtccctctaagaaaatgtttataattgaatgttcaaagtagaatatagattaaataagtaaagatgacttgccaaaaaaaattaaagaacatttgaaacaaacagaagtctgcatcacacataataagtggcataacagtatcacctctcaaaagtgacaatagatgtgtccatctttatgcctttagcatgttgttggcattattagttattgtattgagagagtagccacgctatacaagagaaaggaaggtaaattagatccctcacgcccccttcttctgtgaattgtatatgtttttgaatacactctctgccaggacagcaaataaaatttggttcatccctgatcctcagcagattataatctaggtaaaggacagaccaggttcatgaaatcaaaaataataattagaacatttggaaactaggggaacaggtcctcatattgtgtgcatgttttatcagtctaaagtagatatagctctattgaaaattgttggctagtaatatgctcattttcccatttcatgaagacttattctcaaatggaagttacagctggctatcgtgtttttccgacaaactctcttctctgtggacat

SEQ ID NO: 89832 - DNA, 1033 bp, Homo sapiens
ttgcatttttaatttagtaactaacatatgaataaatttgcatattaattagttgcagattaaatcatgcatacataattgcctccttactgtgtttaatgtttgtcaaaatctccagcctggtttgatggatgtcgtatgaaagattacaatttgatgtacccttggaagtatttacaccaataatgcaagattcttaatagcagaattttctagttatatacagttactaataaacatgtaagataggtacatgtccctttgactaaaatttttttctttgcaccaaatcatttactattcataatcattaatgcatctcctaattatacagcatatgtctgttaaccctttcattgctggccttcaaatggtagcttctttctttttcttgccccctaaagaaagcaaaattgtttgataatactctgaaattactcgattgccttttatttatttctctcctagtatatggacaaacctcatttgccatttattttaacatacaatagataattatatgatcattttgtattttctagttaaagatcataaaatgacccacgtgcacatggttagtagctgatgggcttttgcctttcttttaccaatgctgaaaaaaattgaaatatttcagatacttcatatagtagtaaaaaaaaatgtatacacagacatactctctatttaggagggtaattgtagaataagtaaaagtattaaaattatatttaaattcattttgaatattgaaatgcatttaatgtatcatgatcaaacataggatggaaatgtgattttttttattagaattgagatctctgaagtagaaactgacaagagaatagatgctcttgatttgacataattttaaaatgccaataaatgttttctcaaatttcttcaggtatttaattttttaagttttatcttactcatataaaaagtagaccaactggcttttttttttcctttttactattttgatgtctaagctgcttatcacactgtattaccctgcattaatgagtat

SEQ ID NO: 89833 - DNA, 1423 bp, Homo sapiens
agaggtcacttgctttttctgaaattatgtaatattgcttttttttttttttttttttgagatggggtcttgctctgtcacctaggttggagtacagtggtgcaatcatagttcactgcagtctcaaactcccaggctcaagcggtcctcccacctcaggctcctgagtagctgggtacacaggttcacaaccaccacacctggctaatttttttctttttttttggtagagacagggtctccctgtgtttcccaggctctgcaaacccatctctatcaaaccaagacacgtagtcagcccttttaatcattagacctagtggtctgcaaagtttgtgttggaaatactttatcttctctcttttgaactggtacatcggctgtgatgcccggagctgcttatactgtggttcccttggccaataatttgtttatgcctaaatcagccttgcctctaagtgataaggagatacgtgctttttcttttgttttgtgtcagtggtattctctaataggccgggaacgggtctgcccaagtgatgcacagccccttggtggggctggctatagatccccccgcaaaactgaaggttaggcctaagatattagctttgcctggcaagatgaagatgtgtggactaggtagacctgtgtggcagtctgtttcttttataaagtaaacagagttcagtttgtttaggactgcttaggtagatttcttacactgagcaggaatatttgtacagatgttttaaggtaaagtcaaagaatggctagattgtagcctttgacgcattataatgtatcttttctcagtgcccctgttgaattcacaaaagaaaaggtatttttgatcatcggctatgagaaacttaaaacacttttttttatatataaaggctgatttagttaactcttcttgcatttaaagaaaaaaacatctgctgaaagtagggaggggggaggtgtgagcggaagcgtggtctccacattccacaatgaatgtcttttcccagccaattttaatttgcagaaaaaccaggcactgagttagattcctcgggaaaagtccctgttggctgatgagccctgaacttcttccgtgtacaccctgaacagggactgatgcttcagttcacagagataatttttctctggaaagccgatagatccgatttagccacccctcatttgtagtcattgccaccttgtggattacaaaggatattggttttcatcaaacttccatttcgatttggctttttatggcaagtacacgttggcagtggattgccgtgttcctcaccaaaaggatcctggtttgttcagcaacacctcacttctccactcacagttcatttatgattctgatgagagtgttttttcaggaaacacacatttcactttttgacctaggagcatc

SEQ ID NO: 89834 - DNA, 1097 bp, Homo sapiens
agagagaattataacagggcttgcatgtattttgaaaataaaacctttttctatggcatccagcttaactgtgaatttatatttacgaaataatgtagataaatgccttgataatttgattgaataccattttttaacttttaaaatttaattgattgaaatagttttatttgctaacatagcaaaatgttctccttttttccagatcactgacaatttctgcattttctatgttttcttggttttgaataattctaaaggttttcattgaaagtaatgaatcaggaattggagggctaaataagattctcttagaagatgtggcagtaatcctaaaagaataaggagtctcttcaagaattgtcaaagttgtattttcttaaggcagaatccatacttgtcaggctgttgacagacacttgctttgtcttggcttttgtttgattttttacataactgcactggattattaaactgaacataaaattgcacctcaaagcaatagcacaggattttcagccttgatcaatttctactatccccggatgtgtgtgtgcacgcgtgtgtgtgtgcacccatgtgtatgagtgtgcttcttttaaaggaataggagcttttatacaatgtggtgcaaaacttatagttttaaatacttaattattttatctggaaacagcagcatgtgagtgattcttttttaagttgcagctgctgcataggtgtagagctatttgaggagtttgatgctttacttgagcatatactccctcttcagagaagttaaggtagtgcagaagtttctgcattttgtaaaatttcagggttgaaaataaagatgctttatgatttggtgagatggatagatttcacttctgaaagaatgtgcaagttgtattttgaaaggaacattttaagaattctacttaagtggtttagtgacacccactcttgtctcttgtctgactttgtcatctgaggaattaatcataaataagccactagggatgaaacttgatatataagtgcttacttccagagtaataagaagaggaactgtgtgtgtgttaaatttcactaaatttattttgattattccg

SEQ ID NO: 89835 - DNA, 1319 bp, Homo sapiens
aaatagtaataaatctgtcacaatctgttgtggcaactcactttaccccccattttgaagtgggccctctctttcccttataataaaaggaagaaaacttaaacggtgacactgcatcatcaggtattatttgtgacacgcctgtggtacagagactggacttctgccgccattaggctgggtcttcctcccaggcaatcaggagagagaggggattgcctagccctgttttgaaaacactgcagcatctgtgggagagagaaaacgtaggcctggccagacatcatgccatggatctggcaggatccacgaatgtgtgtttgtactgtgtgctgcacctagagacctcacgtcactgtggaagtatgacacgatggtgggataacagaagacccaccaggcagggtctacaggacaagcacagcgtgtcggggggaagcctgtccctctagtgcacatagaccagtacttgctaaggtgattttttttttaaaggaaagcctgtgtgaaagacagctatctaattgcccacgagagctctgcttattactgcagtacatttttatcttctcggttcgtattttagtatgttgctctttttagtcacgtcccaatttctcgtagccctcgttttttgcgaagaccttagtaataaagtgttgtcttttgttgatgtcagaatttattttgcatgtctaagctcttgaatctacatgagaacatcttgttttgctagatttctacattttggttttccatttcaaaccatatttcatcttaaactcaatattttgcaactttactgctcatttcaacaaatttgttttatataacctaataatcatacacattgaatcatgaattcatacacagaaaaatgtactatagtaaattaaagttggaaaaaaatgatttatgattcttaacagaaattaacatgaaagtactaaaatctagaaagtagcaaaaaattttatattgtgctgttttaagatactttcatcaaacacagaaacaaagcaaaggcattatcttttggaaactttattctgcccatcaacatgtaaacatgtaaaacttttatcttagaatttgaaatatttcaaaattatatacgttttatcagaaactgttaacaactacaaactttctacttcagactttggtggaatttgtctccacttgtaatccgatttgcatctttaatgatggtctcaccatgaccccagttggaatctcttgaacatcagatttttctggaaataggatattttatccttagaaatagtttatgacctctcatctccagtgatctttcc

SEQ ID NO: 89836 - DNA, 1035 bp, Homo sapiens
ttgtgagtgacatggtgattagaatttagattagggaaaacacattctgtactttatcaaggacagtaattagttcagtcagtaaaagttgattacaagtaacgataaagttagatttttagtacttaattttaaaatttctttattaaatagtaaatttgttcttaatataaatggtactatctactcttgttttattgcatatcagaataattaaaagaacaatgtgttcaatgcagagtataatcaagcgatttatatattatgggtaagtttctatgtagtttttagaaaatgtaatattatataatctttctgatgtcatcatttttagaagtttaataattgtcacactgtgataggttattgtggaagttttctagtgttcaggtaaatgtttaatctgtgggatgtgtcttagcttccgatagacctcaagagggcattctgaagtcctttgtggctgttagcttggaatatctgctatttctgtaattttgagagttagtgtgaggatttgaatttcctcttggttcagttggcattttctcttctgtgggtgctatgtcagttcgtggagaatcatgatatgcggtacagagaggcagggttctcagtcgagttcataggctacacttacccccagtgtatgcagccaggggaagttgtgtgcgttcacaaaatgaggttcttcttgttaaggaaggggatgaatagttcccagatatgagcctcagtctagagaaaggaaacattagtcttatataaatgccatttgttttgtgaaatgaaaacgtgagtcatcttaaaagacttaaaaaaatattgtttaaagggaatcatctactttcctcctaaaagtaaagaattaaaaattcacaaactttgtgatagcttcttagactgcctttcttttgggtttttgttttgttttaattgtctcagcttagcagatgctgtttgctttattgcattggtttaagtactaacaatcagttgggaggtggtgaaagtaaaaaattaaccttatatgtt

SEQ ID NO: 89837 - DNA, 1018 bp, Homo sapiens
ttaatgaagcttcttctccctactaaatcttatctagagtttaactatctattaatcattcatttttgcacatttttacagcttttgtggggtattttacattctttcttctgtttgaatatagagggtgccttgcaaacttcactcatttcactagaagaggcaactgtttaaatcctactcttctaatatatttcctggttcatgttttcctgcacattcataaatgaggaggacgttgatttgtcagttatcttcagtgcttagaatagttgctgaaatgtgacaagaatgtttatggaagaaattaccttataggttgtacatgtcctctaaagacatcataggcactcctacattgcattggtgaaggggccaccaaacagcagaatcctgcaacttggttgaactatgaaaatgttcttgatacattataatttcctcaacccctttagccagtattggccattcaggcaaaggaatagaatttccaagacttgtactgtatgtttgcagaaggagggaggatggcagataggtttgtgtgtgttgggatggagaaagtatgcaaataagctaattaatatcaattgtttttatatctatattacacatacacacactcgcatacacataagcacacataattaatcacacccatgagcacatgtacacagctggtctacaccagattgccctgacaattttagagctgtgtgctgaaaaattttagaggaatttggctttgaatgtgcaacacgtattacagagcaaagatcaccttgggtcctaagggagatgactttcatctctaccatgtgagtaaaacctgggtgattgaaccataaattattttgggtatatagaactttcttcaaataacacttaaaattaaatgtccaggtaagtgattttcaaatcagaacaaccaaaattgttaatagttatgatcatgcttatatacgtatggaaatgtatatgtatatggaaatatggaaatttgtgtataagcatgctc

SEQ ID NO: 89838 - DNA, 1051 bp, Homo sapiens
tgattatggatttaccaaccgctcagggtatttatattttaaaaaatatatctcaaagctgtatcataaatgattagaagttcaggaatattttatatttttggtggactataggtttcatcagtatgaaatatccaacttttttctttttttacatttttgccttagattggctttcaatgtatagtaatgttctctacatgctttatttttgtagattttatattacatattttttatatatttttatttttcatagtctctgtgttttatttttgatggtttgttatacacagcatttagctttacatttttctagcctaatgtgacagccactgtaacttagttgaggaatataatatccaaataaacatagtttaattttctttttttccttggcttgatcacatttcctttgttttatattttttgctgcttaaaaaaaggtctttttttttctaatggtgcaggaattatacatcttatttcttgtgaaagttattcttgcctttctaactcacatatttcaaattatatatctctattaaagtctaaatctgtttggtgtctgtatctttcctaaaaaagatgacggagagtgttagcacatttttaattactgagtttctccctttgttcctcccctttacctctcatgttgaggttgatatgtttcctttttgacgttttaaattgcatcaacagtcacatagagtctactagcgtttccttgccccatcttgctaatttttgtggaccatgttgttctgggtttttttgggttgatttgtcattatacagttatatatccttatgtaatttttttcagaagtgtgggggtataaattttcagagtctttgcattttctaaattgcctgtagttagctcacctttttgaaggcaagtttggctacatataaaatttgagttttaaagtcttgtatcccctttttctgtcacatttttgttctggcttgccttgcagctctaaatgtagcaccccaattaatcacccgattattgcatcacactccactccagctccatgta

SEQ ID NO: 89839 - DNA, 1101 bp, Homo sapiens
gtactgatgacactgggggtagggagaacaggagcagttgaagacgacacatgctgtcacctcatgtgctggtgtgagtggcgcagggaagggctgtgattttttataggcacactgattagccaagcacttgtcacctccactgccgctcattggcctactgagtgtgagcgtgccatctaattgacagctgtctgttgtcagagggccatcttttctccttttcagtttgagtgaacacaacagagacatctgcagagctctctgcagctctgacaaggttgccctgcctgccaaccctcagacttctaggcagcataattgaagagatcagaaaagaatattaacccgttgaccatcttgggctgaggtgtaatgaccaaaaagtcactttttaaggtgactgtgagtctttcttagtagaggaagacatgagattctctgtcagaagagtcaggccagtaggaagtgctatttcttggtagtgattgttcgtggggtttcagttcatctgagcacttggaagaggatgagaagttcattttcaaggtagacccagtgtttcatggtggggttacactgaagcctgaatgctgggtcacatcattcatgtctgatttggcttgtgtaatgacagtagtgctttggatgtgtgtagtttggatgagggttactctttttcttttaccgccaggcctgacactgcccttttagcgtaagattccagaatctcttatgcagtagcatggaatgtatggccaaccccgtagtaacgtggactgcctctttgggacatttcctgtaagccagagatatcaaggtggactttgtgatgggtagattgtttattatacagatatcagcttgggaatttgaatgtttaattatttgccttgtcgtagtgtcttcaaatgaagctctatttgagcatctactgggattggtacaatatgcagacaagctggctttgtgtgggtcgagtcacctgtgcttgcaggatgggggtgcttgctatatttggaagtgatttagtggtatcctaggtttatcaggaggaaaatacatctttgcatttatttgaacatttgatttagaaaggga

SEQ ID NO: 89840 - DNA, 1153 bp, Homo sapiens
tggagtctcgctctgtcacccaggctgaagtgcagtggtgtgatctcggctcactgcaatccctgcctcccgggttcatgccattcttctgcctcagtctcccgagtagctgggaccacaggcgcccaccaccatgcccggctaatttttttttgtatttttagtagagatggggtttcaccgtgttagccaggatggtctcaatctcctgacctcgtgatccacccgcctcggcctcccaaagtgctgagattacagctgtgagccactgtgcccagccgaggctgggattatttttaatccagttttattgataaagaaactgagatttagagagatttgttttcactctgaaggcagagatgggactggggaacaaactcctttggatccagatttggcattttctttgtcacttctttagcactggataaagttggtgtagctttgtgtcatagcaagtagcccacagagtcttttcatagatggttccagctctctattcattattaacttagggatcattcatggaggcacttacctagttaccaggctgagacctctgtctgccaatgagaaaaaatgtgcatttctaaagaggatatgaagaacctagcaatctgtatatcaggagcattgtctttacatagacaaaaaagaatattttgaatgtttcctgtaagtaagtaccagttgcaatagcgtggtgcgtaccgcccatgctatctattgcccatcagtggtacctctactctctggttgtggtgaaaaggaccatggtcctcctggaaatttctggccctgaagctcaggggagaagtgcaacaccagccacatctcatcccccaagtttcattctccttcactctccctggtacaacttggcagaggatggggagaactgggaagaagtggatgcattgagtagatcaagcttttcctcttcatgtttactttatatgattttaattttgtaaccttgttgtaggacataaaaaatgaatgacagtggacttagcttttatttataacattgaaatccttaaagatagaatgttagagtcagaaaggacctagacatcatctggcatccagtgccgctttgtagcaagtggaaaactaaagctcagagatgttgaggttggtcgtcatc

SEQ ID NO: 89841 - DNA, 1039 bp, Homo sapiens
tatttttcagtgaaccaaccattttaagttgcagatttaataagaatgcacccatagatttttcagtacatgtctcttaaaaataagacatttgcctaactaacatactgttattatccctaaagagattaacagtagtttcttaatctcagtccatattcagatttcttcagttgtcctcatgcaaatgtcttcagtagctttcttaaaaaaggcaactaaaatgccatttacgcgtgtcatttgatttctatgtctctttataatttcttttaaactagagctgttcctctatttgtattcttttttaaattgtgtaatttattttttagggatggggtatcgctatgttgccaaggctggactcaaacttctgggcttgggattttcccaagtaatttttttgttggtttgtttgaatgatagtgactttaaagagaccaggccaactgtcctataaaacattcccctttctagaattattagatttcgtttccttgtggtgctgtttaattttgttcatcacttgttttgcctacaaatttaaaattagttctaaaggtttatgcaggttcaggttaaacattttcggctggagtacttcattgggggtgctgtgtatatcaaattacattccaacagaatattgagctatgctgctgttggtaatgctaactttaatcacttggcaaaagtggtgaccactggattgttccattgtaaaggaatctttccccatctgcaattaacaaatagtctttgtattgatactttagcaatggacagatacccctttttcccaacaacctttgacctaatagttttagcacacattgatgacccttgcctgaatcagttatttcaactgaagacttcaaactggtgattcttttaaaattccatcattccttccacatttatagctagtattcttctataaaagggcagtttctttcatcattcattttaacactatcagtttcatgtttcatattttatataagtgtcataacaattactgtttctaatgtttccttac

SEQ ID NO: 89842 - DNA, 1280 bp, Homo sapiens
tttctcttggcaggtaaaacagaaaggggctcatactcatcttatgggagagaatcaaacttacagggttgccaccaggtaagtgagaatctctgttgcggaagggttgagaggattaacctggtaaatcagtttgttttctaaattagatgatgcattttaaactgtgacaccaaagatgcaccggcaagtcagatgatggctctctctttaagtaatgaaataacacagagcttagaactaataaacacctcatctttagatcgctgctgtatcagaactacattcatgggcttgtttttattttttaatccatcagccggtaccagtggcactgtttgcaaaccagcaatgtcggtgaaagtggttctattaaaagagtttatttgcaattaagaacttaagaatttcttacgcaggaaatacttcgcggagtcatgtgtcagaccctgggtttcgggtggctattgccctaaattatagttttcataggggctgtatgatgttgtgtgaaaacagggttgtattgagggataaaaatgtctgtgaaaatatgatttgttgtccctttttgtttctgaattgtttttggctggaagtcaaggccagcaggctaacagcaaagccgtctcaagggaagcatgcgtgagctagaaaaataagagtactttaattaaataataaaatgccagtgtaatacaaaggtatagcatgtgtgtgtttgtgtctctgggcactttgcatttgtatactttaaactctccagagagagcctatttctaaaaatactgtcaatagctaaaagtataagctttgtttcaagacaactgagtttttatagatgctttctttttcagttcagtatcagtattaatcatgtatttaaaatcttttttaaaaatttatacttcctttttataagtgcattggtttcttactttggaaaactcttgatggaatttaataatcctctttaatattcagagctctctactgtttttattattcacgcaaacaaaatgtactttttttttttcaaatgctggaaaggggatgcttactctcttgaactctctcaccctctgatgttcttgatgggggaaaaaaatctattttaattttattttaaacagcccatttaatatacccctgaaaaatgtaagcaaagttttgtttttgtaattaaatcgagcctatgaggaaagtttcctttacgtaccagacataggaaggtacgacttctggtgggttggtgtgtttgttttttccctgtatatatt

SEQ ID NO: 89843 - DNA, 1049 bp, Homo sapiens
ttccaagtgaattttaagcagaaaatcaacatcaagaccatagctaatttttaatggataatttacacaaaagatagtttcttttctagaaactgaggtgtccttttaaaatggctgcttttagtctttaaaaaaaatgataggaatcgcgattttatgtttgagaaggtgcgtgggctttatccacagtgcctgattattttgctcccaaacaggggttctggctctgagggcagatttatagttgaattggggaacaaaaagatgtaataaagttaaaagcttacactatcagaatgaaatgtgtttgttcatgatctctggaccgatctatttgatggtaaaagtggatgctacagatgaaatctttacaaggagcataatccttaaaaaaaaaaaaaaaaaaaaaaagtccacctcccagcctcctgctggctgtgctgcctctttggtacctcgcagacttcgacagagccctggacgggtgcccattgatgtcatggaaacactcaaattactgagaatgattcatgtctatgctggtctcttatcctcccccacacaaacaggagtagatttttaaccctgacaacttgtaatttgcagtgggtttatttttgtatctggataaatattttttaacaagcaaaattaagattaagcagtctgtatctgatatgatagtaaagaatgctgggttccatgtagccaagagtactttggggactctgcagcgtgaattcatattcttctcctcctcctctccctcctgcctctttcttttcctacctcttgctctttgcattccactcttcctctctttgtttttctcctacttattctctctctccttttaaaatcctgcccttttatctttaaaataatggaaggagtagcccaacttatatctataagtgaggcaaatcctggcagaaagattcctccctcctgttctgtgtgttggagtcaagttgggaaataatgctgagtggtgaaattctacaggggatagcttcaggaattccttctagagaaaaaaatagatgctt

SEQ ID NO: 89844 - DNA, 1121 bp, Homo sapiens
gtagaaatgcagttttctgccatgtttttgttaattagttgctttgtgttaatgtgcggagatggtggcagtttattgtaagatgtcacagaatccatgtgtatcatttgtgcagctataaagtacctagagaccttttaggaataaaacaccatgtaaatgtaaattatcattgcctataagacactttcattaatttcatatcaaattcatgagtgttttgagctctgggatttgagagtcttcagtgtcgggcctctagtttatttatacttttttttttttcccccagagtttaaacaccagcagcatagcatagtgctaagagcacagtctgggcaaacaaactgccagggtttgaatcctggctctgtcacttgtacctgtgtggctgtgggcaattttctagatctcagtttcctcatctgcaaaatggtgtttctattacctgccttatggggttgtgcagattgaatgaatcattttatgtagagctttgagcagtggttaatacatgataaggacacagctattcttatttggacagggaaggaaaaggcaggcatggaaacgatgaaggactgtaaataataacctcatgtatgtgttcagaactactaaaaagttcagttgttgtttaatgaactagtcctttctacatatatatagattcacagggtaatcagagatggatgggactggggatggggacagaaatttattctgagtcaaacatgtttatgatgagttccctagtctgatgccagggaacaaaaggctcattcttcagttcccagaatgaggattaacagtgaaacagccttgcttggtgttgtcctgcagcatcagataatttttcatcaaggcgtttcacgggatgatatattctcccatatagatgaatctatttcagcggtgggtgaaacacctaccatttatatataatttttaaagtggcattttacaaatgaaaggctacacaaccaaacatgaccctgttattatcctactggtcaaccacaagagggatcatctctgttagagcttatctctagaaatcattttattgataagttgctcgtctgtctctagctctttctaggtggtttagaactgtcatg

SEQ ID NO: 89845 - DNA, 1079 bp, Homo sapiens
ctcatcggctgactgtacccctcctcccccatacagatttggtgagacttagtactaaataagtttggggagtgcctggccatagccggctcttgttggggcatgtgcgccctctgctggctgctcacataggaactgactggtgtgtgaggttctttctttcttttacttttcaaggttgggttttttttgttttttgttttgtttcaatttatttttatacaactgatcagatatttaccatgattataaagttgtagcttaatactgagtatggccgttaatttgtttttatttggaaataaaggtgaggttttgttttgggtgtgtttttggtaaatagatagtcctgatagttcaaataacatgcaatgtgtgtaatactcttgagttttttaagtggttgattgtatatcacgattaaccatattttcattgctttcatattccccttgccttgattgtatttgagaagtattcttgttggactaagttgggaatagaacttaaaaggggatagataagtcattgaaattttgaaatatgattatttgtctgtaatggatgtggtaggtaatccctagtagaaaaattcctgttatggttggttgatagttttcacttgctttgccaaggaaaatgagtatatttacatcataatactttataaaagcatttttggtttccttgcaaaccaaattaagctgtgctcactggcagacattgagaatggtagtttgagtaaaatattttttgttttgttttgcttttgcagttgctgtttatagagtatgagatgttaaaggaacaaatcactgatggtctctttactcccaggacacaggactaaactatacaagggcagttacagaggaagagtgtcagcctctctaccattgcctgggtggagagcatccttgggtcctggtagtgaaggccagggctctgtgtaatgagtgtgtcttttaaaaatagcaacaatttttgttgacaaggctccatcaaagtctttataataatttagtttgtataagtgatttctgtgtatctctgaaattaaatgacttgatggagtcagt

SEQ ID NO: 89846 - DNA, 1054 bp, Homo sapiens
ctatatttgctatggatatatttatgcatttaaaaaatttgcatcattgtaacttttcattgacaaaatatatttaatatgctcggtttttacagttttgcttaattagtttttttcccacttatatttattttctgtaacttttctcttttttgttgtctgttttgctctattaagatgttatatatcttctcctccttctccagagtagacctctcatcagttcaccaaaatctctctccagtaagagtcaggaagcttaccgtgtgacaaccccttcaaggcaataaggctccaactaagggattaagattgttttttgacaccaaacattgtttatcctcttaattttgagctatgtagcctgaaatccatgctctgtgatgaaatggaggtggtttatctgagctttaatactcttaaaaatgaagataatgatagagcatagtaatgaaaattaaataagatgcatgcatctagcagagaagctaagaaataggagattcttaacaaatgtaacctcatttcttctttagtttctgtaaaaccccaggaatgttagaaaatatctaggtcgaaaggagaagatcatgagtttggtgttaattttgaggtacctttaaccagtcaagtgaagacatgaagtagacagttgaatttaagggtgtgcagatcagagatgtctgagtggagagtctgcagttgaagagctgtttgtagagatgccagttgatggtatgagattgcttatggagtcttgagtaacaggtgggccttgagcctagcagtagaaggattttcaagatttaaagacattcaattgagaacaaaagagcatgccagggactgggagagaagggaaatgtgatgttatagaagctatgctaagcatagttttttaagaaggaggggatgggtgtgtcttttttggtcatcaaggaagatgagtactcaacagtgtctcttggctttaaccactttagtggtcactgttgacattttcagagagttttcttggtggaatcatggaataggaactgactttccatccctc

SEQ ID NO: 89847 - DNA, 1102 bp, Homo sapiens
gtggaggccggccacggtggttcacaactgtaatcccagcacttttggaggctgaggtgggcggatcacctgaggtcaggagtccaagaccagcttggccaacgtggtgaaaccccgtctctactaaaaatacaaaaattagctgggcttggtggcaggtgcctgtaatcccagctactcgggaggctgaggcgagagaattgcttgaacccggaaggcggaggttgcagtgagccgagatcgccccattgcactctagcctggacaacaagagcaaaactccgtctgaaaaaacaaaaaacaagaaagaaggtggaatcaaagggatgtaggggttccacaaatttagatgagatgtcaggtttctcagatgtgttccttgatttgaggtaggtgatcttagaagagctgcaactaaactccaactggctcctttttcccccatgtcttagaagaaaatgtgcttcgtttttattctcttgacaaccctctgcatttgcatctttcagcttcttctaacttgtgtctcctgggacctttcttttcataactctattttctttcatcatctgtctttcccctgactccttttccctttgcttcaaaatgtgcaaatggatcctctcttctctggcagtgattatcaaagtgtggtttctcggcgaaatgtgatcacttacttcaaatctcctgggatgatgtgaaagttgggacccacttcaggcctatgtgtcaatacctcagtatgatatattccagcaactttcccaaaaaactacttagtttccaaggcagtttggcatctcctagagtggcacagcaaattccatgatttttttctagccctgttcgttttgtcttttaaaacctgtctccctcaacatccacaatgttaaaaacgtctaacttgccttctgtttcgctcactactctttttttttttcctgctttctgcttctgtcttcataagtgcaggcatgggaagagctgggaatttggagtcccagtagggtttgattccttaatgtcattgctcagtagctgcgtgatcttgggtcacccatgtatcttcagtagggcatctgctttggaggtttgtgtg

SEQ ID NO: 89848 - DNA, 1052 bp, Homo sapiens
atgcgtattcagacataaatccaataaacagacaccccaaagttatgctgtgtaagaatagacacacagtaagaaatttccagctatcaggctaacaggcctgtaatctcagctctttgggaggccgaggagggcagatcatttgaagccaggagttcgagaccaacctggccaacatggtgaaaccccgtgtctactaaaaatacaaaaaattagccaggcgtggtggcacgtgcctgtagtcccagctagtcgggaggctgaggcaggagaactgattgaacccaggaggcggcggttgcagtgagctgagatcatgccgttatactcttgcctcggtgacagagtgagactccgtctcaaaaaagaaaaaagaaaaatgatcgtttaagtggccttgaataaccaagacatctttcctgctaagttcttttcgagttacccattatgcccagcgttgaatgtttactgtgcttattaaggatgatttttgtgtcctaggtgatcactgagtccttgattgggccagtatttactggatggatgcttcttagtgccagggagtgcgctagatcctggactactgggatggaaaagctagatactttctgagggtttttgaagtcacttcttcctcactcatataagcaaccccacctctttccaggcattgatttcagtgtgttcatcatccctggtcttgcttttaaccagctacttgatgggcaaaggtctggagaggggcagcctcctttgttgctggctcagtgtgctgtgctgtcctcagcgtggtgcctgctttttgcccttatcctcagatgtggatccctctcttcccaagctctcctccatcccctgtgctgcaaacaaaactccttgtttgttgctccccaccagtggccacgaaggaatttgcaaacccctcaacctcctactgttttggaattcatgaagtttttgccctgagcaagaggctatactttcaaaagtactttttcctttcttcattttcccaccccctgcctttcaaccactgccccgccctggtgcac

SEQ ID NO: 89849 - DNA, 1028 bp, Homo sapiens
aaatcaaattgaagaccaacttgattctgcctgcagagcaaagctatctgcctttttagaaaatctggatggttaaattggaagcacattctgcacatggtttagcagttagtagcctggaaaatgacccaatagccaagatagtttttttgtttgtttgttttttgtttttttaatcttcattgtaagtgcttgtttaaagtgtaagcttgtaatggactattttgcacattgttcattgttaattcttttcaggctattatagttctgtaaatacattgcctgctaagttgtgtcagtggagaaacattagtgctataagaaaatccagtgaaatgtgcttaaaagcattaccaattagcgcatgggactggatcaccgcgatttcttagtgatcctagagaagtcagtttcagttgacttcccatttatttaaaatgggtatgacaacgttctttttggagaatagggcagcacacaaatgcacactatgctgtggcctgctgaagagtttccactgatttgtgactatattactcaatattgctttgtagcacccttagtctaatccacattgaaggagcaaaatccttctgtatcttacttattatacgattatgtaatacatatgttactttatatataatatgtagtagtacttattttactatttttattcattataatgaaaataacaaatttactgggtggtatctaccatctagctcaagctgttctattttgtattgtttaaatttgagaaaagctaatattggttaataattaaaggttacaaaaattgtagtgggaaaggagttaaattctgtctctcagatagtaaagactgccagaacatggacataatcatgggaaataatagggtggatagaatgtgatttatctgcgtatgttaaagaaagaaaaatagtgatcgtgaatgtactgaatatagcttaaactatttatcattatgtacaaatggaaacttacataaaacccctgttgattaagttttatctgaaacaaag

SEQ ID NO: 89850 - DNA, 1066 bp, Homo sapiens
gttgatttttaatgtggaggattaggtgcagccaaaagacatttagttttagacaacatgccaagactggatgaaatggtgagagctggatccaacttttgtccagaagtttcccaaccctattgaacagtctcatgtcatgaatcagacccattggaacagaggcagggggaaggaccatctatcattaaaggtaaccaggatgtgaaataaacagtgctgcttttatttagtagaaaaagtttttctctaggtttttacatttttatttattttcatgtttttatttacttactttctttttagacacagaatctcactctgtcacccaggctggagtacagtgacatgattatagctcactgcatcttcaaacacctaggctcaagtgatcctcccgctttagcctcccaaagttctgggattacaggtgtgagccactgtgcccagccaattctctaagtctttccttgggaagatggtttctctgaattttgcataagccctatacttaaaatgtgtctgtgacagtattaaccagtaccctacttctggactggatcttgggtggcggggttgcgattaaacactttgtgtttctcaaacctctcattactccatggcttcaggagaataacatcagtatagttagggaatcctgaacctcacatccttgaaacttctgtgtccaccttaagtgctgtattcatcctcaataaaaataagactgctttctttgttcacattatatattcttagaaccaaagaagcaaaggagctgttttgagcagtgcacatcttacagggtgtcatgggacagtggattctaggtcttcaggggtcacttcagcataattcttggcttttcacttcctagtgatgggtgatgggacattgggcaaatttcctcagagcccccgttttctggtttcccaggtgaggacagggatgccagcctggcccacccctcccaggctcactgagaaagatgtggtgatgtgatacactttgtaatcactgtgctctgctgtgtaactgttagggcattgcaaggctaaccactggt

SEQ ID NO: 89851 - DNA, 1392 bp, Homo sapiens
atgaataccttcaagtgactttgccagtgatgtgttttccaaatgtaattctttaaagcctaactaaaatagatattccttttatatctcagctgattccagatctatagctaaggaattggattggttggggataaataaaataataactcattaagttgagtcaccaggagaaaagttctgtgcatagatcagtatttagcatagaggttgtaggacctcaataaatgactgtcgagtgaatcagggaattagatagatagggtttaaacgttgaatgaaaagcccatacattaaagttaggcctataccttactgtaccaagaagaagaccctaaaccagagccagtcatatagaaattcacattttgttctataggactatatccttgactgggcaaaatattctgccaagataggaaacgggccatattacagtgtggcctgtttcagttttcagtacaccacagattattttatatataagcggaaataagtaaaatcaataatattttgggtcgggcatagtgcctcatgcctgtaatcctagcactttgggaggccaaggtggaaggattgctcgagcccaagtgtttgagaccagcctgggcaacatagcgagatcctgtttctacagataataaaaaaattagctgggtgtggttttatgcactagtggtcccagacattcaggaggctgaggtggaaggactactggaggctgggaggttgaggtcactacagtgagctgtgattgtgccactgcacttgcactccagcctgggtgacagagagagaccccattgctaataataataatacttattactatatttatatttttgtaattatataataataataattactattattattataaataatttgaaaggccattgaaaaaagttgcgtttctggtattgagctaagataactgatttccttttgtccagtcagaggacatttccattcttctctcattggtcttgtttcctttccggcctactctgtgatatagcacagctaatgctgtggtcctcaaacacttttagagtccaactaggtttactaatccaagtcgtataacatttagaagaatttctaaacagaaaaatgttacttgaaaactatggccaacagagatgtatagaccttctaaataccaggggaagatttctcacatagaaagttattgacccaaagagaagataaatcatttaagcttcacataaaagtaaaaagcaatttgtatcaggtaggaatgcttttgcttcgaagtaatggaaaatgtgactaatgatggcttaagaataatttttctcattctagaaatctggtggtaggtccctgctggaagtggtttgcagctcagtgatgtcagggctggtg

SEQ ID NO: 89852 - DNA, 1078 bp, Homo sapiens
tgattttaagctttggaagctataccagttacttcaggtccttgaatctcaggcattctttgaaaaatcaccatcaaatccatctaaatggatttcagatatttaacacaaaatagtcaaagcagataaatactagcaacttatttttaatgggtaacatcatatgttcgtgcctttgagtatcttaccaactttgagaaccacaaagttggttttggtcatagaatgttcttatttttgtgctatttttgccttcaaagtagtaaatttcatatttacgttttaacattgtaactcaagcaggaatcccagttctttatcagttgttgatagaaaggtgcattgtttcttgttctcaggatatgtagatacaggtgaccagatatatttatcaacttagattttaaaaggcagcttttgactcttcagtgtcaatagttatgattttatttctaacacccttgcttctctattcatctccacacaaccacttagaataaaagattcacttgaaaatgtagtcttgagaagtagcacctaaataatatactaacttccttggatcctaaaatgatcctccaatgagctacagtaagaaaaatagaataaataaatactcatagggagacgcttatgttatctatgtgaaaaaagttttaactctaaagaacaacttgataaattaatattacagaatacaccaagcagtacaaacagattaaatgattgttctgttcatgtttcctcatgggcaactgctttacaaatcaaattagtttttcaacccaaatagtatttaaaatataagtggcctgacagtctagagcggagagagctgattcttttcacttagttgttgtttaggctgcaaatccatgtcagctttgctcttttatcctgtctgccctccttcccattaaactcttaaatatggagaccaagacagtctcctgcattgtgataggaaatgctactatgtccacgaggcccccacccactgttcccagtgaaaggacttctctgttagataagctgtctggtttgaaacatggctctttattgtttacaaactgctaca

SEQ ID NO: 89853 - DNA, 1261 bp, Homo sapiens
aacaataagctgattgtaataatgaaatatttctgtcaaaatttgtctgccttacaactggttgttttttgtgacatgctttgtccaactccagaaatgctaatttatgctaatgttttgatgttcatatcctagttaaaccctaatattcttaactttcttatgtgttaattacttatgtgacaatctagttctcttacaaccacaataccacaatagtaactataataaaacattgaaacttcagtatcctaacaccaaatgttattgtttgaatggctctatcttggtctttgaaaagcaattcattgcatgctatgcctaattttcccttgtggcacaattttgctttaatgtggccttattaaaataataatttttaacataagcaatatactttgtatgtgtctggtgtcttacatacactattttatttaatcatgtcaacaactccatgcagttgataccattattattattcctaagatttctcagctattatgaggaaaatttggacttcgtagactctagagctttcttttagccactatacctgtgaaagtgcagattccttctagtgaagttccagggagggaatagtggactccaatttctttggaggggagaagttttggtagtggagctatgtttgtttatgtgctgtttattaatataaaataataacttacactgtcattttatttacagaactatggagatgggactccctatgaccacatgaccagcagggaccttgggtcacatgacaatctctctccaccttttgtcaattccagaatacaaagtaagacccattttaaattaacttacactttttgaatgctcaagttttactatagaaggtaaaaccatgtcctagacagaggttctgcttttagaaacttggatatttagtcagttcacttgtaataatcttaaattgcagagaggattggcagtctgtgtttggtaatagtgcattaaggattaagttttacaagcatatggaatgaaatgcttttagtgatactgaatctatgtggaaattttgttttccttagacctaaagcacggaccacagtttcaatgttgtatcagtagtttcctaagttaaggtagatgaagtcaaagtggtgaatatttagaataaaaatatcactgggcttgttggttggcagtgatatatagtcagtgttaactgtgatttctgctaaaggggttatgaaaataaatggtgttaatgggcttagtgtgcttaaat

SEQ ID NO: 89854 - DNA, 1075 bp, Homo sapiens
cctgcacagggtatttcttactgtggagagctgttttgtgcaattatgagatatttaatagcaactcttggcctctgtgtgatcaatgccactagcaacacccaaattgtgacaaccaaaactgtctcctgggtggctttgccaaatgtcctttgggatgcaaaagccccactgacctggcagtagcgtcctctttcctccaagtctctgcctacttttcatgtttaaaatcctcttttaaaattgaaaagataaaatgagtccaaacaatttgaaatcttatggtacttatagggattcaaatctgttcctccattactttttggccaaattcaagaggagaaatctctcaaatgaatccaagctggctgttataggtgaaaagaaagtcaagatgcgccagacttttaaaagcttgcagtggttgagagattttgttatttatacactttttattttggctgaaaatatttggtttttgtttaagaattaagagaaccgtgtaggctacaaaatttatttatgtgcgaatcccagagggttgtaagtagcttctttgtgtgcttcagttcaacatatacaggataggccagcatgttggattgttaaacagcagatctggggaaggttttacaccttttctctaggcttggtgcagtcccgagagctttcttgacatgccttgaagctcacagtgcactgatttaaactgtccataggggacatctgtttgcagtttgtgttatctgctgaagcaccaactaaaaggaagtgaaataatatttgtcattaaaaaaaaaaagagaagttaatttaatggtaataacttagttgttgttgcttttctatctcttaagatattctgaaacaccatgtactctactgtatcccaaaataaataaattaattatactatgattacttctgctgataataaaatagcagtaataataaaaggaatgacagtagagcattaagagaataaacagtatcactgaaatgtgaggaaacacaataaatgggattgtgtctcctgaaccttagtttcacacttcctcctccacttctgtcagag

SEQ ID NO: 89855 - DNA, 1009 bp, Homo sapiens
tgaaagtgaaagtaagggaagcagcatggtttagaggaaaccttggtccatttttccgtcatagacctgtcctgctagcaaagtcctgggcgtttcttaaactgatggcaactgcgtgtgccctggtggtgaaatggtgttgcagtatgcctgggcactgccctgtgaaaaaggacacacagaggggagactcacagttttgttttcattgctgacatggtttaaaaatgtacgttgctagctgtgaaaactcagtcattataacaccgtacacctttcttctttcagcaagtattccttgtgaacattagcaagtattctattctctgttagaattaaacaggtaatcgtaatagcatgaaagggtgaaagtatgtcttatgcaaaatagcctcttttatatagggcatctaccaattttcttgtgatttttgttttttcctcttttgaaaaatgattttagtctgctcgtgtttaggtaggtaacttctcttgatcccaattttatactttaaatgatcccagatattgcattttaaatgagatgagtatataaaaaataggaagcagaaagcataattaaaaattgtggttacattatcgtgagaccaaatgaccagtcagactcctctgaccaatttcatagaaaataaggaggtatcatttgaacaagttgtaacatatgggaactgttttaaacaccatcattgatatcaagaaactattaggaaatgcaagtttgtgtatcgtgtgtgtgtgtatgctgattttacacacacaggcacatgcacacacatgcacacacacatttataagcccaagtaagagaaacctttgccaatgtctgccaggcatttggctgaagtggaattgtgaggaacattttctcagcctttataaatcacagttgaaatatgtcagcactgttcagtttataaaatgacaagggctgtaggctgggcatggtggctcacgcctataatcccagcattttgggaggctgaggtgg

SEQ ID NO: 89856 - DNA, 1038 bp, Homo sapiens
tcacttcctgccatcagacagtatgtggggaggtcaaggggtgggcagaggagaggcttggtgaaattcagacttttgggccccatctagaagaatctgcttcagtatctcttggagctacccaggaatatgtattttcaacagtgctccagatctgagggacagttggaattaggaaaactgtggctctaactgatgccccagtacttctcaaagtgggtgcccccacatcctgatatgctggatgtgttttgtaactgcagattcctgggctccactgggagtggtggccctggaccagcctctgtcatgtgtccccaaccacactcttgggattcgtatttgtatgaactttagagaatgaactgccacagagattctaggtgacaggaaattgtggggtaaattggaggattacagatcatgcttctaatatcagcacaggtacacacaatcgtcaaaataggggacaggtgtgtttggaaagcttgttttgtaaagaaagtcttttctccctttgacttctcttctttacgtggaagctacacttctgaattacaaagagacagagaaaaaagagaacaataacaacaaaaggttcctgaggcatacctaagctgcaggagccaagggagtgtcccttgttttacttggtgatggctgtttgaacagccgtttgctttctccttcctgtcctctgatgtgaggatgcaggattggaatcattagaaaccctaggttagtagcatcaggctccctgccctgtgtagtctctgggaggacagagctgcagcttaagttgtgcttttgtcttggcaagcacctttcaatttttatcctagctcagttgctttgtttggcattttactggccaatactcctttttttttccctctcttctccatctcctaattctcaacctcttctggggccaaaaacttggaggaaagactttaaaaaaaccaatttcactcctgtttatgtaatcgtttctatattacagaaggctatggtatgttttaaaatgtatacatctct

SEQ ID NO: 89857 - DNA, 1039 bp, Homo sapiens
tactactggtaacatgtgaacagatatggaggtcctctacccgagtattttaataccaaataatagctatatcttctcagatattggtagctatgtcaatggagatgtgaaattggctctatcgatggcttttgtccattctccaagagaggcctgtctttgtgggtggaggtgttggtggatatgtgtatgtgtctccttctcttaccctcttaacagtttggtcacagtggtgaccagtgagtatagagcagagccttgacaatgcacctgactttgggctttagccagatagtatgaatgagtgaagcagatgttaaggagaggtgagtttagggcaactggggcattcgtgccccctcattcattcagttaacatttccaagaatcctgtgcagggcaaataagatctatctcaggaccagcaatatctcatccttggtatgaagataagaagtcaggagacttgagctgtaggtttggttgtctccttgcctggcaggcttgcctaatttacagcaagtagaaaataatctgtgtcttgttcaaatctaaataacaatgctttaaaggtagtgtagaatatttgttaaaaagaacatattaattatgtttttagaagcttctgtaaggaagaaagaagtttgaccccccaacttttctcttttctagaactgcaaattactgctattttaaatagactttgttgtttaactgtacatccaggaaaatctaggaaattaaagaagcatgcatataaatgattgtgtagcagaacatgaacattaaattcatacagtgaagaaattaaagttagaaatactctcaaacataagaaggttctagaatcaatcctttaagcacagtctgagacatggtatatctttgcacttacttggaccttggtttctattcctgtgatgattattggatttgatgccatctgatgtcctgttcctcagattctatgaagctgagtctgagattaacttaggtctgagattgacataaaggggaaccggtccctagatttcctcag

SEQ ID NO: 89858 - DNA, 1023 bp, Homo sapiens
tttcaatcacattgctgtgttttggtcagagaagtaaaaatctagctgtcaatgccaactggagtagttatttaagaatataatatttaagtaggggagtatatgcaaagtaatataaaaatgaggaaaacatttacaaaatcaaatgtgacctcaagtccaatatttttcaatcttctaagtctgttggtttcaccacctcacattatttcaatgtatgtgaaatatatcttgctgtttatatttgggttgatgggacaggtgcaggatctttgacctggggaaataaattggattaaggactagcttaactagtctacagaaactgtagactacaaaaactgaaggcaagaacctactgtcacatcttttgcagagagacaaaggcattttggtatttggatattttacttgggatatgtattttgtgtatttgtgtaattttgtattaatttacacaaacttaagtaaacaatatattaataagattcatcaagtaatttataaattaactttcccacatttttctgtgttcaagaattatcaaggagatgtgtaaatattgaagcctatactatattccattatttgcttttaatgtatttcatataattcagaaaacagtaatttatcatttacattacttcccttttcctattgagccttctgaaagaataatgtagaccagcattttaaaaaaaagcttgtttcaagacatgttaatagaaattttattttcagtccattctgcattaaatattgtaaaacacccctagagagtgatattatttgtaatgattcccaaattgctttgaccagagaactccttttttcatgaaatacctcccatgtggaacattctgcagaagagttttgtgaaatgctaactcagcccaaaaggttttttaaattaaggcctttcaagttggtaatggtatttagtttcttgttttttaaaatagactttgtttaggacagttttctagggtcactgtgccactcatgctgactgtcctgtcgtct

SEQ ID NO: 89859 - DNA, 1063 bp, Homo sapiens
tttttttttttcccaaataccttcttatattctccaccgactttttgggctggctaagtgtgacagaaatgggaactttagttctggcttttgattctctcatgttaatgtaggtttttgataagtcacttggtgcaaaacactgaaacaacttatctattggcttaaatgagtcaacagtctgaatcaaacaggttgtgaattggttaaaataataaaccagtaaccctgtggttgagctcttgatgattaaagaaccagacctaagaatgcatttatagtcttttaaaagagagtaaagactcccacttctttgagctgtgtttctttgtgtagatttctttttttttttttttaaagaaaggcttcattatctgtttcagatctttatagatgttgcaataaggtactcctttctattagtataggattgaaaggatcaaagttaataacttgaactgagatgctttaaaataacaaaatagtttattatctctttccttttcaagatttatgttcttacaagggtacaatgttcatgattgaatgtggtcctactggtaaggcttccatgtaatagaagagtaattcccttgtctagcattctctgggttgttttaatgttgcaggtgaatgtgttctgctgtgcaaataaatgtagttctcttattcacattcctgatgacttgcatccttaaacccttttggtcagggtattattgtcctttatcctgaaaaatgtctgtgattgtagtgccctaatactataaatcaatggggactgaattcagcgcctgctaagtagagtgaggcaaccctttaaatgcaaatgcatcagggctagttttaatgtaattttaataaggctgaaaccattttgaagtagacttaaatcataatactaatcttaaaagactctctatttagctgagaagtccctttattctcactggccatttttcctctgtgtgcatccaaaccacctttcatgtgattccacagtttttcatttctttttttttttttctcaaatagaatatatgtacagtttgtggttacttta

SEQ ID NO: 89860 - DNA, 1049 bp, Homo sapiens
tatctatcaccatttctctttctccacttcattgttagtgtttgtatgattagggtgggcgggggtcttctggatggggttgctcacactccacaaagccttttccctcttctgttgaaagaagacacagctgaaatcagtctctttgccttttcatgatatggggatgcggtggaatcaaagcaggcaggatgaaagcccaaaagcttcctgtttccagctgttttcttcagcgaaggttttttttttttctcccaaagatgatgcttcctttcaaggggtttttaatctgctaactgtttcctcagtttatttcactacagtaaaatgtgttccctttaggtcatatctgtctcttttaaaacccaacctgtccttttcagccgtgttagttgctactcaaaagaacaaacgtgatttataaaagtccttttaatgaggtacaaagaccaataaacctttgccactagagtttcatcttttcagttgctttattttcatttatgaaaaatttgagatgtcaaaaagccattgagaacactattgatttgaccatttaatatttgtaaacaaagccgttaaaaataaaatatattgttatggccttaaggttggttgtggtttttttttcccttccgaatgcagtataatcatatgtaatttgtttaatgtaaattctttaaaattaaggcactggaaactgcataaatgctaaaatgaatactaagagtggcttgatttattaagtgataatgtgcatgaaaatatggcttttttgcactgatgtttattgcttcactttttgcattgatgttgttttggaatttacatttctaaattctgcatcctctagggataaatgaaatataaaaatgaattcttttaatcactcattaaacattaactagacctttcacccatttcctagatcttccagggttctcagtaataatcatcatcattatacattgatttataaaggaatatcagagtgagtcagaatttttctgtttctttatcacttgtctttccccaaatatccatactga

SEQ ID NO: 89861 - DNA, 1084 bp, Homo sapiens
tgttctatgttactcttagttattgttgtcagtctctcactgtgcctgatttatgaactaactttatcataggtatatatgcataggaaaaatcatagcgtatatagaattttgtgctatctgaggtttcaggcatctgctggagatcttaaaacctatccctctcttagagtgagtactgtgattatgtttaaataaatgaatgcatgcttgcttgtggaaatatttttgtgtgtggggtatgtatatgtgtgtgtgtgtgtgttgcatgtggacattttaatgtgtgtgtattatcctagctgatggttttcctttggacatttgggttcattttgtagaaagaaaatgcagttttagaatcaggaagctgattggatgattccatctgaatatatgtgtgtgtataaataaaatatattatcaaaagcctgacttgacttgggaactgggaagtagcagcctcaggtcctcctaggtttattggagttacacttattagtaagtagcctaatcctctctgcaaagagaggaagtacagttttatgatagaatcacgtgggatgaggatcattgaaccagagagaaactgctgctgtttgatttccactgcaggtcatcagtatttcttgatctagaacaatgataaaaagtgttctggtctttaagcaaaactcagatttaggctttatccttagaatctgatctttaaaactggaagcacaagctttccagctttgaattcactccatttcagagatgaagaaaccatttctcaaagaggtgtctctgttgaggtttcacagtgaacaagtcaggtcagctgaatccaggtctagtgttatttcctgcaaatacattttatttttcatttttgcagtaatctttagattaaacccactcctatactgttggattagttaggcacatggactgggtgtatgtttcccagatttgaaggttggttctccatgtcatagttatttgttctggttgcttttttttttttttttttttgagacggagtctcgctctgtggcccaggctggagtgcagtggcgggatctcggctcactgcaagctc

SEQ ID NO: 89862 - DNA, 1036 bp, Homo sapiens
aacctggggcaacacagttatttaatttctctgtaaaatgaggataatacaagtccctgcttcattgggctatgggaattaaatgagtgaatgcatctaacattgagaacagtgttcagcccatagtaactgctcagtgagtatttttaagctattagcatgatcaaatttagagaggagaaatataatggagcagtttctcagttcttgttagaaataatcattacatttgaaaatccaacaaaatattaacattcaaaacccattttcagaagtggtggtggtagaattgctataacggaggaaaatttaggaatggcagcctggttaaaagaaagggcgggtagacctggagtaggttatagatcaatttaaagcagcaaagttttctaaaggtgcttctagttttactttaaatgagtttgcagttgcacatatcaaataataaggtgttatttgccagaggcattttgttggtggggggtgggagaaagttttggggtatattgtgtgtgttgggggtacatttccccggctgcctttttccactgctgctggtcctctggtcaggaagcctccctgtcccgcactggttctgttatttgttcttggatagcatcaacttgaggatgagactttataggcaacacattagcctcagtgtctcctcctggttgtagtcatttcccggttacatgggtcagtttctccaccttacttgagtgaatgcctagaaaggctatttcagcctagagaatttttaggggaatggagaagctgagggtaactcctcagcaccaacacttgaacccaatcaatacttgatagattactcccagcacacacaatacacccagaaatcttctccccaatccacacccaattaagtttcagccaaggttagaattcagtggttccctctgtgtgtgtccccttagctgttgctgttcaggtgcaaaggtgttcatttctttgtctacccatgtgtagttgcctgatatccaactaaactgcatcaaaatatggaacccctagg

SEQ ID NO: 89863 - DNA, 1115 bp, Homo sapiens
taaggggcagactgagcgctatatctggagttttactttatgaatgtgcacctttaaccttgagtcagaaaatgtggttactgtcagtcttactcagtaagtggtgctgcatagaacatcagggggagacttggccttggtttagtagaaacttgaaggagacaaacatgaaaagcagtgtcagaaaatggaagaccagtgttaaaaatctttggttttgctttcatttctcttggttatttcttaggattattgctttagatcattttcccaggcattttcatggatgaagaattccaaagaaagttattatttcaactcttgaaagctacgcttcagggtgaaggtagggcttgattatcaaaggaatttccctggctgcagtcctaacagtttaacttcctgtgatttccccccgcccctttccctttatttttggctcagaacttcagtaatgtctggattgatggaattcctctgggaggcagatttgagggtctaaaggtgcttctcaataaagattttgaggaatgatattaacttattagaggcaaccctctattgttttagtataaaggggatgagatttgggggaatcattttggatgtcacattaagccactagccattttactcttgatgaccttagttgcctttaaactgtatttttagtggggatcattctttcaacagtccattcttttttaaacgcaatttggtttataattctgggggctgcctctacatgctgtactgtcaagagagacatcaaatattttctgagtagttttcaacacagtgaattaaagctgaaaaaacaagtagcgatactaccagcatcttaactgagtatgtggtggtggtgtttgagtgtttgtgtgtgtgtgtgtgtgtgtctgtctgtgtgagtgttttatgttgctgtacctacttgcttttaggtagctacagttttaccagagaagagaataacttagattatatcaaagtttttttttatataatggtttaaaaacctgccctgtgtctagtactcctttacgaagtccgcaagacttggggataacagtggacaataatgttccttaaggacttacagaaataagacacacaca

SEQ ID NO: 89864 - DNA, 1039 bp, Homo sapiens
aaaaaatcctccaatgactttttaaaaacactgttatgttactgataaactgatttttgtctgtgtcccttcgtatatattcacacaattttcatatttctgggttattcatccttgcttcacatgtgttatctcacggttaaaaaaatttttgttggatgatcaaaagcaattaaaacattcttattcagtgcttacatacttttgtgttctttttctgtgtcattttttcatatacagaatatgttttccaatagtttacattctgaattttttaatgaccagtgttaaactgttagacttaccatcatttacttaagtctctcctacatatttggtgattttggttatttctgtatctttgcacacgttttttcatttttgtttctattttctaatatgcagtttttatagcttcttgatagagtctttgaaattttgtttctgtgaaattgtgtagtttcatagaactaaatttgctctacttaactgtacctgatgaattcatattagctataaatatttaaacattttatataacagacagcaaatcatcatattgctgggaatgtaaggaagataaactccatgcattctagaagtcattagagattttgcatataaagaccacagctagtttcaagatctaaatcttgaagcaggcattcaaggtgtttcaataagtacttaacggtaggccattaattcatgtaatcatttaggataaatgatgggcagaaaagttactgtgcaaaaagtattatttggagaataatggatatatgaaaacttacataaatgattatttattgtaatttttgttactttcaatttcttggtcatggcaaaaattgaaatgcaaggtcaaacagaagagagatggagaaagctctaaccagcaagggcctggactctcacacttccctgattggagctgctgtgtgtgtctgaggagtcaccattgctttactgcttatacctaaacagaagtatatgtagctttgcttgcactgaggatgtttataaatcctctgggttt

SEQ ID NO: 89865 - DNA, 2412 bp, Homo sapiens
atgagactttagaaagaggatgacaaatcctgaggactcgtgtcttaagcaaattttctgtctagatatttattataaacctaattgcatctgataagtgctgtgtatgtcatactctatcaaaggtaaaagggttattaaagtaacctgcactttttagagcaatggtggatggccttgcagaaggcacatggcctttatcagtcaactcactgtggggaagctggagaaataaagttcaggtgagagtaagccgacagttctggtgtgattttcttgggaggataacgtataatgtaggtagcaaacacatgggagaaagaaggttttgcattatgagatttgacttaatgtgtacagtttgcttttggtgttgtaaagcagtaaagaggcttattgacatctctattgaaggtcattgcagtgcatgaaatgtaaatcaaagtgttattctttattagaagctagaagataacatttacataacatgcttttaaggtaatgagttaagttcattattttttattactataactgtttgaagaaagttattttcatgctaaaaatactcctacttgaatccgatttgtcataatttttgcatgatgtataatctattgttaggaaacgataattccatttatttttgtttctgggggaaaattgttagacagctgtttcagtctttccaaataaactcgcttccagaattcctagtaagtagcaatgctggttgataggaatgtcaccatttttctgacccccctcagccttatcacaaagacatagtgcagaagccatataagaaatttgagaaaaggaaaagataccaaggcctaggtatttcacaaactggataattagactctgaattgcgacgaataggctgaaagaaaaaaatgtcacaagcctatagtggcttaaggaacactgatttcacagtgaaatctttctacataaattttatggttaactggtaataggaataaaactgtggagcaatgtcagacaattctgttatgattcctgcctaatgaatggcaggctttcccttggtattttctccttaacctgcccattgccctttctgtatgatcacattttctttaaccagttctttgctcataaataaagccgtgtgttccggttcaaaagttgcatcttcatttataaattcacagaatatgtttttcagggaaaaatgtaactcaatcagctttgcatggtttacataatgtgatagtctcatatttactatgtggttaacaagaaataactgttaccaacaaaaatcagagaatttaaaaacaacgaacattttgcttgggagcctatgtatatctctatataaatacatatagacatctataaacatcatcgatccttcccatgtgcacatgccatatatatgtggatgtgggatgatacttgtttttatatatacatatctatatttatatagctgaagaagtgaaacatattgctttttatttaagtgactcaatgcgtttatagacaagctttattttacagtactttatcaatgccgagatgataagatactgctttgatttggtcttctaaaggtcaaaatttgaaagaataaattgattcctagagacattcttatgctatcattggccttatattgaacagagaatttctaggaaaattattattcctcaatggaaataaaaattcattttaggtagcttaatcaatttgaattattcatttatggcattgctttcaattgttgatgagtgtatttgtgtactgggtgtggggaggtcttcaggggatgggaaggtggagggatgagaagattcttatagcactaaactgaattttcaattccctgctaaagtgtgaagaaagaagtgaagtgcttcattttcttctttttagaatcatttagcaaccacagttcgtactttatattttttatggagtactttcaacaacttgcttttgcagttgggaaatgacacttacctggattttcttgggttctttattcatgacatcaatgaagactactgctaatgaaccatagatgaagttacacatatgctaagcagggaaatgcaggaagaatgtgaaggtcctagagtatctcaattcagcatgtaagtgagttgtgtgcacagtagcacagttctgtcttatggctggtcaatgctccatattatgaatttacataggctttattttaggctctgaaataattatttttattatatttctcaaatttgccaaagtatctctgagagagattcagatcccatctgtttgacagctgaggaaatggggacagttggtacaatggtttctcaacattagaacacatctttttttttttttttctttttttgagacggggtctcactctgttgcccatgctgaagtgca

SEQ ID NO: 89866 - DNA, 1020 bp, Homo sapiens
tctgtttcaagaggacccttctctatagatctgtagtttttattagttataatttcttcacacttctgtcagaaatgtttgctgttaattttgaacactgtttttcatgtgaatatattttttaagtggatatctttttcattttgtttttttcctcctggcttttaaatatatatttaaaatatttttatccatatctaatttttgcaactttcaaaaaaactttctaagcagtcacctcctgaccctctttttcccccttagctgtttcccccccccttttcagggccacctcccctccttcagagcccccgcataatgctattcctttaccgtccagccatctgcctgttttagcctcttcttcactctctctgtttcttctatatagatttccccatatgtctgcttcttcctttatccacaagtccagacactcctccatagctttcttaccaccccatcctggtgtcccgtctgttcataaataactctttcatccgccttgaatcccaaccccctactctttctaaaaagagtgtgcaaataaacctaaagtgcacggagccaagatgcatagcatagttttgattcagaatagactttctccttccaatcacctgttttagtccccattttttgttgcttggcttctttgtacagatccacaattgccgttcaatttttgtatgaaagtggatgcaaagttatttaatgtcttcatgacaaagtttttgcctcttactggcaggttattttgccctaatcagttacacagtcttgtgcagcctagtggttgctattttggagtagtcaggtttgaaccttttgttcttcagaaattaacgtattatctcagaaacagcagtctctgcttgcgtgcttggcaacacaaaactgcgttaggtccttttctaagtctgagttctaggacatgtgccatgaaaggagtgttaactgaatcacctgcagaaatggccacaaggagggctttgtaatgttctagatatttaaaatgtt

SEQ ID NO: 89867 - DNA, 1756 bp, Homo sapiens
aaactcatagaatgccttgaactgataatttgtttaactctctacctactaattggaccaagaaataactttgtatctttatctcttttccatttcatgttttatttctgtttcaattagtgtgtgcctttggcaaaaaggagatgattttgctttctgttttaggatttgcctccaagaaaaaatatattttattgccacattttctcaattgatccagtagagttcacagacaatgaaaagagtaagaaaactaatttttaaagcttggtagtgttataattttcttccttataataatcagaaaaagaatttgtataacttttgtttctaatatagcagttctgaaaatctaggcttacacattttccttcccattactgctgtttatacttaagtaaaacaaaaatggtcgctgcaggtttttttctcattttagtgcagagtttgaattcttcaaagactgctaaggttttcccaccttaacaatttatgacagacccttatatcttcataggctgagtccgctgctaagagtttgctaactcatgactttaatacaccagtagagatcacactggagttaaaacaaagagagcacgaaccctgaaatgatttaagactgttcttagctgactactggaacacagtgtctcacgtggtgttattggtaaccttaatgcagattataattctgtagtttaaccaggatgtgttggctatggtaaagtgcctttataaggaattgtgaaagggcacaaggaatggaaacagaacctcagttttctcagtgtaaatgatgatgacaagaattccctgtgcacatttgttgttgtgagaaagggtgagatagaatagattggacacatagtaggtgctcactgttagtttttctcattcattcattactgtgtcattctattggcatgctcacagtcatgtagtggaatatgaagttacatcgtgatatttttcattcattcaccactgtgtcattctgttgacatgttcacaggcatgtagtggaatataaagttacatcatgatattttaaaagctaccgatgtggtagatttcacagtcttgaaaaggggttttttttaagctgaattttcagtttcacttgagaagagtcctgatttgcttgtacaaagagcagtagggttgcagagaaggaaagaaggcaactcttttaagtcccagccgctactctgctgtgtcttattctctaaaacagtgaagaagtctgggtggacattctagtggtcagaagcctaagctttgtcttttgatgagtgcagacaggggagggagcaactgacgagggagtagaggggcttggagccccttcccaagtctaccatccctcacttatgtgtctcttcctcagtaaagcacccccagtgcccttatttgctgtatttttcttcatggaacttactgtctatgggacctatttgtgcattcatttatggtgtgtctctgcattgctttccctttcactacccatgtaagttccatgaaggcccagtcttaagcattacaggttgagcgtccctaatctgaaatgctccaaattccaaaacctttgaacactgacatgagatagtgacacctttgctttttctgttgttccaaagtacgcaaactgttttatgcacaaaattatcaaaaatattttgtaaaattacctttagcccatgtgtgtaaggtatacatgaagctgcatatgaaacataaaatacatttcatgttg

SEQ ID NO: 89868 - DNA, 1260 bp, Homo sapiens
tgaatatttagggtaaggcactgatatgtcagtaggatgaccaacactaaaagtccagtatcctgggaaacctctgtctttggtagacctggattgtcaccttagtcttggattccttccggagactgaagaaatcctttaaaaactttcctgctgtggagtcttctggctcaggccccaactacagtgttacattcagacttctttgttagaacaaagttttacatatattcaaatagtaaggataaatattaatctgtttagaaagagagccttgaaaggatcctagtctttttgcataggaaaaatgtccccaatcaatgagaaagtctaggagcatgatcaagacttattttatatagtttgtcttttagggggtactggtggattatacttttagagttacattcagtattattgtggctggactaaaaacccctcaagaatacatttcacattgattttattatagacatctgtcaagcaaagcagaggcaaatgatagcatactcatttaccagtaatgcaaatcaaatgagctagtggcaacaaaatcactcctgacacctttgccctttttctcttgatttgaactaatgacgtgtgtgtgtgtgtgtgtgtgtgtgtgtgtgtgtgtgtgtgcgcgcgcgcagactagcaaaatccagactagcaaacaaaggccaatgacaggataactttcataccttcatgcctgggtcactcaccatgtacgataggagcagtgcattctcttgtgaattaaaaatctatttatccttcctgggtgcataagtcccatagaaggctgggaggggaagtggaactctttatataggaggggcttagacctcaatagcctgtccctttgaatgacaaaatgcccaccagccttgccacaaatagcttctgaaatatgagaaccttttttaattcttaagatccttgaccactgcaactaatgtaaagacacactccgcaacaaacttatacacacacacgtacacacacattttattctgttttataggaatggcagtctttagcagtgcataatttttttattattattttgtttgagactgggtctcactctcactcaggctggagtgcagtggcatgatcatggctcactgcagccttgaccccctcctgggctcaagtgatcctcccacttcagcgttttgagtagttgggatcacaggcacgtgccaccacgccttggtagtttttgtgttttttgtagagatggtgtttcgc

SEQ ID NO: 89869 - DNA, 1111 bp, Homo sapiens
gctgttctttattttttcttctgggaactatatattgggtgattcttttaaaaaatgtggttatatgccaacattatgggaaaggaaaaaaaaacttaccagacttttcttccatacataatccaaatttcaaatgtattaattttgccgaatgccatggcaacatacatatctgtttttcagttcatgaaaggtattttgggaattattggctcatgcatgcttgagcgttttcgtctttcagctatagaaatacactatgtatcctcttcattttgtgtttgtgcttctattcaagatgagaataaaagcagttagtttctgggttgtaatattcttcagtgaacggtggctttctaaaacagttacaccttgactgaaatgaaaactctgctgtatcataaaagatattctaattactgcatctagttaaaaggagaataaatcactgggagattattttaagtgccttaaatataataaaaaagaataatggacgttgaacagcttgacaggtttgatgaatgcagactatggctgatttctgctgctttctaatggaaaaggagagcattttactttctaggtgtattgtcaaagcaaatttttgttagggaagataaggagaagccttatctttgttgagcacttgccttgtaccaggcattagccaaggcagtgtattatctcatttaatttcatttaatcctccccaaccttgtagataatgttatccccattttgcatctaagaaaaatgaggctcagagaatttgaataacttgcctcagggtatatagctgcaaagtaggatccagactaggttctttctctttatttcattaccccagtagggttgtgatgatgatgtaaatataaatgtaaatataattgtctccactgttacaaagatactaatttcatcccatttaatttagaatggttgtgtccaaacaattttaacttctttgagcctctgtaaaatgggaacagtcaggtcactgtgatctaaaaggagaatatatgtgcaaacctctttgcttagtgcttgacagtaaatggggagtgcctgggagatttgttttccatatcatcaacagacaaatgggtgt

SEQ ID NO: 89870 - DNA, 1033 bp, Homo sapiens
acttgaggccaggagttggagaccagtctggataacatggcgaaaatgccatctctactaaaagtacaaaaattagccaggcttggtgctgggtgcctgtaatcccagctactcgggaggctgaggcaggagaattgcttgaacctgggagacggaggttgcagtgagccaagatcgcgccactgcactccagcctgggctacagagtgagacttcgtgtcatagaaaaaaaaaaagaataacatgaggatgtgtttggtgttggcattttggtcacattgaagcagggagggaatggacatttctttcagaaccatgcagccctaaacgttaaacagagaggtttttggggataagtgttaagattttgatgtggatattttagaaggttgggcgtaacagctgattcaacccttttttatcaccatcaatgaaaagggctacataaagatttaagaagaggaggacattcttttctccacagctggtcatgcgcccagtgtagttggcaggaaaacggattgtttggaatgtgtccctaaaatcctgtaatttaattttcattatttatataacgcagtccgtatatgtggcgctgtactacatgcacacaagaccaaatttctggccagtgtaattttaccaaagaagagactgtaactgaaatatttgtacctactaaattatctgcagcttggtaactcaccgttagggagtccatgtgatcccaatcagcaacagggattggaggaacgcattgttggcagtgaaataaggggtcaggaactagaataaatagtgctgggatggtaaacgggcccatgttatactaaatgtaatataaagtcactgactttgaggagtccagaaaaataagtttgtaaatattgacattaaagtagcaaccagtttgcatgctactatgtaaaaggaaactattaaaataattattatacgtagttttttgcttgcagcacttgtttcattctgttcacttttagaaacacaaattagaaaggagtgagtctcttga

SEQ ID NO: 89871 - DNA, 1057 bp, Homo sapiens
gatttcttttagtcattaaatctgttctgcaaatcttttttaaaaaaattatgagtgactttatgttttgttttagataattttatcactaccatctaactaatttttctttatgtattttcaaaaatttaataatgaatatgattgcaatatgctttgagaccaggatagatgcttgcttgtttttttcttttcctttagactatcatcttttacatacctttctctttctcttaaagtaagtggaaaaattggattcattgaattggtcttgatactatctagggttataacatcctaatattctgtgagtcttattttaggacttgcatatttaatacagtttttaagtctttgatctcctaaatatgcttatagcagccgctaccttcaccacacccaaatccttgaatgttatgatacatcatactactcatgctggatatttactgatctgctgtgttcaagacagactgctgagcttcgtaaactttaccacccaaactaaagacagagagtaaatacataaacacagggagttggggacttggctgaaaattgccacccaaagcttgaaatttatttgcatgctggaacaaagaatatccatgaacttgaaactcaggatgacgtatgtttgatgtttatcctgtatcattatgtattctagggcaccacttctgtatacccagatggaaatcccaattttaaagcaatgctcttgggtattgaggggtatatttgcgaagtcacagtcatcatttattccatgttcccttgccttcttttctgtcaagtactctgagagtcttgatgttgaggatttattggaagcaaacgttgttacctaaatgaagtctagtgaacaaaaccaccaaaagaggacatgaagtgactgctatgtatgtatatatgatatatttttcctcagaattatctaagtgctttggttggttgcaaatgtggaattttgctgtttgtctctaagtcactcttatagaaatgatctgtgtgtgtgataccataggatgtgcttccactgggctcctgagcagtg

SEQ ID NO: 89872 - DNA, 2056 bp, Homo sapiens
ttgggaatgggagaagtaagtgatggggacaagctaaattttaaattactcttaaagtactttgtttagattatattaacctgtcaatgtgactaaaatgtcaacagaattctcttaagttttacagatttgtagatgctaaatgctcatgaactgaactgaataacagtaatgaggtatgatgatttggtaattttattttaattagcaacatgagtaactttaacctttatttaagaaaataaaggtaatatacacatgtgtatttattatacaatgggaaaagttccctttgaaattctccatgtggtttggtgtattggcttatgcctgtaattccagtactttgggaggccaaggcaggtggatagcttgagcccaggagtttgagaccagcctgggtgacatggtgaaaccccatctctattttaaaaagaaagaaagaaagaaattctcagtgcaacagtctttaaatcatgaaactgttcagttggagaatttgcatttgcttattgatagctgcatatctactattgtgaatttaatatcttatttatttacatttatgaatataatactattgagaaattaggctctattctttttacagtggcatttttactgattgatctagtctcatcaaatataactgagatgtggaagccattatcatagttcttaaacactattgctcttgagcaggggatgtgagatacagagcattgtggaaaaaaatgctattctggaaaaccactcactcctttgaaagtcaaagagaataaacaatgtggaatttgaaaaaaaaatcacactgaaagataaaggtatataagctcacttaactattaatgatacaaattaatctgcaaagaattaaaagcagctttgttaatggcagaagacacatgcagttaataaggacattacttctcatttggggttagattggcttctcctttattaatatctgtttaaactacaaatagaaagaactccattcttaccagacttcttgtcacaagacccagtctctaaagagaaatatcattgataggaaaccagaaagactaaatagatgtatttggtctcacaggcagtccattaatttgctcaaattaaatattatctttaaatattgaaaggttaaatgtacaccgataatggatttagacagctattaagctgtaattgctttctaatgcagttactaaaagacatttgatataacatattgagaaggaaggattagagacttctctacctcagttttaactgagagttttatggctttaattctggcagttgtaggaattggataacaacagtttttatgagaacgcacacaatatgcataaaatattcagtgggcagattgttgagggaatgcattatgtacagtgtatttatgttcatagtttttgcaaatctgtaccagcagtactatcagatcaactattcaccctaaatatttttctattagatctaaaagtcgtatttctgaaaatgttaccattttatggtttcgacccctctaagctgaattaatgtgttttgtgccctggatatatggttacagtagtgaccaaattaatttgaaaacttctcagtctgttggagagtcacatctagttcaggtagtcaaactgatggctttccctgcctgggtaggcagctttctttttagtattcgcattgtttgaatttgtagtatgagattttcacatttttacaggttgcattttgtgagttgagtgtctagctgtgacaaattattgttaacctaagaacatatgctgattgatacagtcagccacttgcctccagagttcaatggaaggacaaaaaatttttggaaaagaaatatgaatgagagctaggctcttcaaaacatattttcctggtgaattatttaaacataatctaagtatgagtatgggtcaggaaaaaaaattacctgcagttaagatatcaagccaaagtattttttgaattgaataaagaaagggaaggaaaaagcctgctgttgatccctgtcactcatgtttttgtattaata

SEQ ID NO: 89873 - DNA, 1105 bp, Homo sapiens
agtacagtagtaggatcctagctcactgcagcctcgaactcctgggctcaagtgatcctcctaccgccgcctgctgagtatctgggaatacaggtgtatgccaccatgcccagctagtttttcatttttaaactttttgtagaaattgaatcaaactatgttgcccaggctggtctggaactcctggcctcaagtgatcctcccaccttggtctccccaagttctggcatttaaagaactcagcccagctcatgtaatttttaaatattcccactccatgtgattacttcagtctggacatgtcagactgaactgtcatttcagtttacatgtcaatttgtctttcatgtaaaaagggggaaaataggaatatatgcttatattttgttgtatctgcatttaaaaaaacacaagaaaccaaagtggttacctgagtaggggtggggaaggcagtaaagaatagtgtgatggggatgagacttccaaatagataactttttgtattattttgacccttgaaccatgtgaatgtattttctctaaatatatttagatttgtttttgaacaagaaaaaaattgatagcagctatgaacatttttttctttttttcattttcctccttgatataagttacattttaattgtcttttggattgttttcttcagaattttaatcataaaataaatgaaataaataaatgcaatcatcattccattcctatcagtaatttctattagtgtggctttttctgtgtttgtttttgtcatttagagatggcatctccctatattacccaggctggactccagctccagggctccagtgatcctcttgtgtcagcttcctgagtagctgagactacaggtgtacactactgctccctactttgtgtgtgtgtgtctgtgtctgtgtctgtgtgtctgtgtgtctgtgtgtttgcattagtttatgggcaactagaacacgttagatgcttttaagcatcgatttggataaagaagcagtattaaaaatccaactgatgccatacttcatggaagaaaatcattgcattaaacaggaattacacataccgatatgaattagttgatccaatggtcct

SEQ ID NO: 89874 - DNA, 1076 bp, Homo sapiens
tatggaaaatgtgattgggtgagttggttttattggactggtagggtgtgcccttggccaaaccaaaggccagagggtacaaggaagtcagggggacacactgctggggagatagagagggggctgcccagttgtgaggggaactaacttcttgtccagaacttccctagggccttccctggctcttgccttctttgctgtatattttggttactggcaggacactggttcaaatatacatttccgtggtttgattttataaagctaaaaaagcctcatgctaatattcagtctcttatgttatgaatgttaccattttacctcttagctatataggtatctataaaggacattttttaaaaatgaaaatcatccttcctcagtaaagaactagagaataaacatgtttctgaaagtagaatgatgtggactagagcaggggtcggcaaactttctctgagaggggccaaatggtaaatctttctggctttgtaaccacagactctctgttgcaaatactaaattctgctgttgtagcatgaagccagttatagacagcaaagaaaccaatgagcattactgtattttaataaaactttatttgcaaaacagacagtagttgtattttgcccaggggactgtagtttgtagacccctagatgaaagaaatgtatcttagggcctcccctcttagccctttccatcatcagcaatgtgatcttggacaatatactttaagtcttaatgaatttattcatttgaaaaactgacattttattttagatcaggcttttcattcactaattttttattgctctggacatcactttgaggtcctggaatttacagatgagaaaaattaaacaatgaatgaggacagttttcttgtatgagggatttttgttttcttcatatttttaatgtgtttaatatactggagtgagcatgtcttattcttgttaacagacaagctatctaaaaattaaaacacaaactaaaagtagaggaagattgttatgagaaacatgtcatgtatgtgaaatacattttataaggaatagattagattctttatg

SEQ ID NO: 89875 - DNA, 1146 bp, Homo sapiens
atgtagccaaattctggaaatctaggttcttttgcaatgtttgctggtaagtagctgtttcatattgaggaagtggtagaatcttaaaggctgcacctcaaaactaaacaaaatcgaaactcaccagtacaattcaagaggggttttcacattttttaaaaaggaatactgctgtatttaaaacattttaagattgcaaaaattcatcattataatttttattatcatcactggcatcaccatgaccagtgtcacattgtttggtcaaaagctggaatggaaatgtgatagttatctttgccatattatatattgagaaatgcgtttaaaacttttccggagataccgtgatcttagcaaaaactaatgtaatatttgtaaaaacattgtgaagtggccagatataccttttaatgaaactgaccagaagtacatcacaaatagaaaaatacacgtgtgtgtgtatgtgtataccatcccttcccccaaatattgttcagattaaagtgtctttctctctgtgacctgcaagtatcttaacttagcatgtgtgtccaatttccatagtgaagccaaaaattcaaatgatggttgatattggcttaggaagaatttattaatgaatgactgtgcttggtatagagtaaaaaaaaaaatttatgacaaagaggatattctagactcatgtaaaagatttcagttaagaacctatgaattcctcaacctttttcttcacttttcaaaaagtaaaggatttatattggaaatattttgcaaccctacaacctgaaactcaaagctttggtcagcaggtggtaataatatttccaggttgaatatccaatttcatacataacccaatttgtaagtttgaaaagaaatattaaacgatgtcagttttaatgcttgtttgaataattgttctttgttatgtgccctcttggacattattgtccactagtgccccaaaccattgaatgcttttctgttctcttatggccactgtgattcttcaatctagttacttctaactgcaagattaattttcttctgacatctaattttcccctgattttattaacatcttattattctttttctggctcattttgaacaatttctcttttatatggggtgtatatttgt

SEQ ID NO: 89876 - DNA, 1208 bp, Homo sapiens
ggaaactctctcaaaattccatcacttaatttaagagcaattttctaatacagttgtaatcaaacacatgaagataagaccagtgttaacatggggaataaattaatgttttctatttgaaaataaggggaaaaaatctctaacattcataaaatgggaaaatcccttgtaaataatatcatttattaggtactgtatacaattaacccttttaaagaaatgaacacttaattctgcaaatgaatgctatgtagtaaaccatagctgtaaatagcctcttgctaatcttagaggctaaatatgaattcatttatatttaaaataccctttttgatgctttagctgtttttttttccctaacgatttacttgtgcaatgaatttttactgtatttaaagttgcaaatctggaaggacttttacgttttataaatgaaagatctttgggtgatgcttaaaaaagatgctagcactattcacaaaggaatctgtgtgcacagtgattatctggaatctaaggaggggtttattacagggctattcgaatatctcttattaaaagtgcagagtgaaaatattcatttaaaatgtattttttttaatccaatgaatttcaaataagaaaaagttatacattgttgcctgctatcctttaagtccgtggcttaagtccatttatgcttgttaaacagctgcagtattttaggagttctggcaatggtatataacagtacattaggccaagtactattcttaagtcagactggtaaatgttgacatcttttaactgtgagatgccagtggaattgtctgtcaactatgaatataatttaacatcttttaatattcatttggtgctatagcaatgaaagaagtttgttcacttatgtgatttgtataattggtatatttttataaaactaatggctttaaaagttgctcatttccaaataagttccttctccttctattgcctgcctaagtttagggaatttgtgtctcgataacttgttttaaaaaatgtgagatgcttcttgtatttttattttagttttctggtgcacattgattaaaaggaccattgacagacaatatgtttgtgttttactatcctggacctggttatgttttccacttagggatttgggatagtttttatattagtattatatctttaaatttctgtatggtatcctctatgcaactttt

SEQ ID NO: 89877 - DNA, 1022 bp, Homo sapiens
gtgtgcgaggggggtggggtgcagggtggggggaaagttgagatcggatcgttctcagtagtttctcttttctctgtgatccattcatttctcgctctacctcctgttgcataaaatgatgcgctgaagagcggctttttttttttctttccctgatttggttttatagtggatgttaccagtttgatcgtctctttggaaatacaatatcgctttttttttttttttttttttttttttttttttttttgctattgctgcctattccatcttaaaaaaacaaaaccaaacccaacccaacaacaagtctcccatcccttcctcctttccaccttaatcccacccgcccccacgtccccacccccaaccccccagtctccaaaaatccgattgtgttttctccaaggattgggactggattttctgattgcggttatttccatgtttctaggtttgtgtgattttgctaaaatgcatcaccaacagcgaatggctgccttagggacggacaaagagctgagtgatttactggatttcagtgcggtaagaaagaacggtggaaactaacaacagctgtgaaaaaaacaaaacaaaaacccaaacacttcagctagaaaccagtaggaatctaaaggacagtaataatttttaattggctgaatccttggtaaatatgaaggtctttttgacaagtttttaactataattttgtggtgtgatggaagattcaggcttttttttttttttgagttttattactggccttcaattccctacccactgattaccccaaataatggaatctcaccccagtggaaagcaaaaatagacacccctaaaactaaaccacccctaaaacttggccatgtctgaacactgagactactaatactttgcacactactcttcgttttatttattgtttttggaaatggaaaatagaaaataggagacccagttgtctctttaaagttttaagctaatgatgctttggattggtaggacctgttccttacatctta

SEQ ID NO: 89878 - DNA, 1005 bp, Homo sapiens
tttaaaatacagtaggaataaaacaatacaatgtattaaaatcacagtggtcttagtcaaggcccattaacattgcaaatatagaaatctatacacatatctttattcggggtttgtctagtttttctctcctttaggcatttcggaaggcttggaatatggtgtatgactttgaaatgcactttctagctgtcgggaattaagtgatcagggacagtgtgtttttgcattatacaagagaaaaaagaatgcagtttgttgctgccttatatttttcttctttggtggaaatagaaagctgtgggaagaatcaagaccagttcacggcctaataatgagatcaggttgaagatactctctttggtggattcctcagagctctccttccccccattcccaagccccactgtagtgttgggtccaggaagaggtccaccctggaattccccaggttcctgatttgtcaactggctgtttcctgattgcaggacattttggcttgagaggaaaatacctaatgaaggtcagggagagaacactcaggccttgtactagtttgttttcatgctgctgataaagacatactcgagattgggtaatttatagaggagagaggtttaattaactcacagtttaccatggctggggaggcctcaggaaacttacaatcatggtggaaggggaagaaaacacatccttcttcacatgatggcagaaaggagaagtgccaagcaaaagggaaaaagccccttataaaacaatcagatctcgtgaaaactcactcactatcaggagaatagcatggaagtaaccgcccccatgattcaattacctcccactgggtccctcctgtgacacatgtggataatgggaactacaattcaagatgtgatttaggtggcaaaacagctaaaccatatcaggcctctagtggaaggtggcagggggaaaactgtgtaatgaagcatctgaaaacagaaactatagttccagtgtagccctgac

SEQ ID NO: 89879 - DNA, 1840 bp, Homo sapiens
tgtgtttcccaagtaatacaatgatcaataatgctctcagtgtttatcagcacaaaatttacttgtgatagagataatgccagttccccttctagtggctcttaaaacctgaatttcttactcttatccacattcttttatatgaaactgcctttttatcatcttgctaccttgtgagctttctaacatggtgtctttggaccaaaggggagttcttttaaggtactagaagtgagttttcttagggtgggaaaaacatttctaggattgtgtgattgggatttcagtggaaagctttcaggtctctcatgaatgatgttgacccagctatgttatattttagaccagacatgtactgatgacctttatgagttttgctggtatagatactgccatttagaatagaatcaatgtaaaatacgaaaattaaatatataaatgtacacagaaatctttctacacaaacatacattcagtattttgcaagtaggtttctttcaaggcatttttgccctaagaatacattatctaatgataaactgtaagttgtcagtacatttctcaattagaacatagttttcaaactctcctgcagagaatttgttttctagatttgttggtagagaacaaatttttattcttcacatttttatgctgccacatatatagcaaccagaatgttttttataatcctccagtagaggatttttctaatcattgacagaaacaaggtttattcatttcatttttaatagtactcttaaagtaaccaggatctttttcttaaaccagaaaaaattagtcacttttaatctgttttcattgcatgtcagtgtattgagggggaaagtctggaaatttgctatattgggcatgaaggacatgagtttaacatacgcttctaattccagattcttttgtgatcgacatttgatttctaactatctaaaaatagtatgtcaaatatgttttactcatatagcatcattttttaaattaacttctctaaactttcaaccttgtttttaaaaattgctatttaaaaaaaaaaaaaaaactgtgtgaaaccaaaaatagcctgcatgtgttttatttttaattccttgtggctgggattggaggggaggtcacagtttgcttcaacagtgaaaatacattgcatgccagaaaagatccaaggataaaaattaataccaaggttttaaactgattattagtatttttaataactcatatttaaaatcaataggatgtacatataaacttatttttgtttttctaggtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaatttttgtctttctaaatcagtattttctctttccatgtatttgaaaactggttaacttctgattttagtagagacttaagtgtctggtagtatattgattgaaagccagtttctttagaaaaggagaaactgttctagggaattaagaagtacatgtgtacacattcatggcaagttattttgataagtgaacctggaacagctaaccatgttaaattattactgcatttttattaaaggacatttgtatatctgagctatggaaattactcaaattataaattagaagaaataaacaggtttaatgagatttagctactctt

SEQ ID NO: 89880 - DNA, 1170 bp, Homo sapiens
ggaggctgaggtgggaagatcgcttgaaccctggagttcaaggctgcagcgagctaggatcacgccactacactccagcctgggtgacagagcaagaccccatatcaaaaagaaagaaaaataaaaaagattaacaccaactaataataaaatagagcaattacaacaatatactgtggttaaaagttgacatggatatggtctctcccatgcttgctctttctctcactgtctcaaaatatcttattgtactgcaccataggcagttgaaactgcagaaagtgaaagcatggataaggagggactactcttcagtcatgatctctgtctacagcagtttatattcttgtagataacatagggacaaacatagggaaagttaatcaaaattaatcaaagcttagttcaagggtttctttgtccacagagtattctcagacgttaccagctaggtgacttttccttttcccccaacgactgggaaagtctgagaatactttgtgaagaaagagggccttgaactaagttttgagagtagaatttggacagttcaacaggcagctatgggcacccttgatagaatggaaaagtagggacctggacatgaacttaggaaggtggaggattcaatcgttcaaggacaagtcacatgtggcatgtcttttcttttacttgtttgctcagtctgaattagtatatacatagtaattagaattgaaatttttttctttttttttgagacggagtcttgctctgttgtccaggctggagtgcagtggtgtgatctcggctcactgcaagctctgcctcccgagtttaccacattctcctgcctcagcctctgtagcagctgggactacaggtgcccgccgctacgcctggctaatttttttgtatatttagtagagacggggtttcaccgtgttagccaggatggtctcgatctcctgacctcgttgatccgcccgcctgggcctcccaaagtgctgggattacaggcgtgagccaccatgcctggcctagaattgaaaattttgaaatagatttggcatatattttataggcacagggaggaaaattttgatgacctctgtgtagtgaagggcgctatataaaatggcttaatgaataataaagtagatcaaatgtttagcattttcagtttatatt

SEQ ID NO: 89881 - DNA, 1034 bp, Homo sapiens
ccaggctggtctcgaactcctgacctcaggtgatctgcccacctcagcctcccaaagtgctgggattacagacgtgagccactgcacccagcctagattaatttttacaaagaatggagaatatttatgttattaatttaaggaaattgattaaacttaaagcatgtttgtgaagaaggattgtaattataaatgcaaacttttttttggtagatatttgttcagtcgaatcaaggtgaagaggaaacaacaagaatttcatattttacttttattggtactccagtccaggcaacaaatatgaatgacttcaaacgagtaagtttgcttaaatgatacttcgggatagtaaaaatataattttaatggaataatttcatgtatctcaactgtcacactttcttttaacaaaataattcaaaattatatcatgtcatgaaattttacaaggctaaactaggatagaaagttcccctaactatatttttagatatccaacaaagtaatctttaataaaaaatgatgtcttaactgataaaagagtcttttaatgaatgacatcaacataagggtaaaaataatggcttggttatagaaagtggttagtaataatggaaaaatgaaagtaaaatcatttgaaagcagttgtgagaattaaataacttagttgatagtaagattctggtgattatttctgatgaaattttaaattacttgaataattttatttaaaaaaaatggactgagttttaatatactgacatgttaactttccaaaccatgtttgtatgctgaaatagcacatttcatcaaataatgatgaacaggcaagttttctgaagtatttttgtatatctttatgtgtgtgcatataattttcttttgaaaagacacaattataaggttagtaaagaattaatagggtacatgggacctttgttaatccagattaattccttctgtacattactggaacgacttctaatgggcaacagttccctagcgtcactcttaaatatacagccagagattat

SEQ ID NO: 89882 - DNA, 1424 bp, Homo sapiens
ttggaagaaataaccaaggccttatttagaagatagcattttcttatttgttctgctaaattttcatgttaataatttttattaataaaattgtacttttactctgaaattacaaagtatttgtataagcaaatgctgtagaaatgagtcttacttttccttcttcagccacaaaatatgggtcttaaatcgtgccttgaagttaaagggattaaggcattctatacatgggactttaccacttatcacatcctaatctaatccctaaaatgaaatttggcaatttttattaattttcttttggctaaatgttgtcactgataatgctctcctcctaaataactgaatgtaccaactattggcaactataagatctagctcaaatgctatttcttttatgaaactttttgttaacctgcatatattgtcagaatctattgtcaccttccttgtacctcctctcctgtggtattttgtttatcgtagcatgtcttttgtagttggggggcagggactccctctgtgtgtgtgtgtctgtttaaatcttatattcctaatatttaccacagtgttagctcggccaagaaggaaccagtaaatgtgttttggaaaataaaggattggctacctgaatactcagacttttgtacaagttctaataatggagttatttgaagtatatgtgtattgatttgtgtgtgtctgtgtatagtgtgagtgtagtggtaaagggagtatagtatatttgaggtttttaaacattttattttattctaccattgtataggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactgtaagtagtatttcgttcatatgtatttaataggtttgtgagtaacaatactattttcagtatcctaggtaagtctaagtgattctttaaagtggtatttattcactcagtttgaaatgagtaaaatgtttaatgggataaattttcttctttttaatttatgtaccctaaagaggaaggacagattgatttttgaatatttgtggggttttgtcagttattttatatgtatatggtaagttttgctggaagtttattctacaactttatactaaaactgaagatatttgtgctttattctttatacctggtatagtagtgatgtgtttgtaaaatcttatttacttttcttgaatatggagtttttaagtgtggtggtcatgatcttagtaaaaatgactttttatttatttatttttttttgagatggagtctcgctgtgttgcccgggctgacttgaactc

SEQ ID NO: 89883 - DNA, 1026 bp, Homo sapiens
tatgtttccatcttctatctcttactggtttagaatacttttaaataagagctttcaaatttattagctgactattgagttttgtctgtatgtgtacgtttgtgtgtgtgttaagcctctatcataaatcatttttcctaaatttctcctaattttctttgccactttttaaaaatctgctttctgaactattttaatagccatttaaaaatacttgctttatacttttttttccagaaaatgtagaaatgtgcattagaaatttttttttcactttttgacagttatgtaaaatgacttacaggttttagttatggccattaactccttttactgtcactcacttcctatagttttatctttttaaatgtatgccctcttttctggcactgtatttaaaaaaaaaaaaaagtctaattactgattttgttttagaatcaaatttgactttgttatcacatgtattctaggttttaagagtaagttatttcaaataacaacataaagacttaagaatctaaaggatagtgtgtggaaactgcagagtataaatagttagaatgcagcatttttaatttgagagctattcaagaaggaagcaaaatttggaagtagcacttcatggtattagatttgcttatacaaataggtaaatcttgtatactaagagatatatatagtttttaatttctctggttacaaagttactgcactggcagatcaaagaatgaattttaaaaaaagttacctcaagttaaagttaatatcttttttttttttttttttgaggcggagtccctctgtcacccaggctggagtgcagtggcacgatctcagctcactgcaacctccacctccagggttcaagctattctcctgcctcagcctccccagtagctgggattacaggcacctgccaccatgcccagctaatttttgtatttttcgtagagacgaggtttcaccatgttggccaggctggtctcgaactcctgacctcaggtgatccacctgccttggcctccc

SEQ ID NO: 89884 - DNA, 1962 bp, Homo sapiens
gatggtgggggtgaagcccgtcgggagcgacccggatttccagccagagctgagcggcgcgggctccagactcgccgtggtcaagttcaccatgagagggtgaggccaggctcgagctctgtgggtccccgtctgtccttccttgctttcctttcactctttgttggccctggtttcctagccgtctgctgccccggagtgtccggcagtcgccgcagccccaggagctgccggaattaggcctcgtttctcgggtgtgaacccccatttatgcacaggggttcctagacgggctcgggggcctggctggccggcttctccagctcaggagatttctcacctgctccttttcaattctttgacaaactggttttgggggtggcccgcccctattccttccagcctgtgggagtctccgcagccacccttgcctgagcctgaccccttctttctgcagagccagctgtcatttgcatctccagagctccaaaagcttaatttaccgaacactttgtttctcttcaccacctacatctctctaaagcctttgaagattcagatggggcgatctaactaatatgcgtagctctgagtcctgaatttctgctaatgcatttcgaactaagttaacgttgggttagggtgctttttaaattatttgaacttttttcttcctcgttcggccactaacttgtagcttaggctcccctatgtatgcgattgcaactggtcacacacgacagtacatatataatatatttcaggtggacagttggccggatgtcttagtttgacccggctctgttttttcacttaagaggacagggatcttgaaaaatgttaactgtctttggtaaatatcaacaaaattataggtcgtagaaaaggtggaccttttatagtggatgtgtagtaaagttcctttgtaagaatgacatgttggaactcggcgttgagaaccaagatttcagcgtgtgtgtgtgtttcacagatctctccttgtgtatgtcgatagtatttagttagaagtatgagaggtttccgctttattttccttgaccccttggcgttatttatacatctaacttggagcagtctactgctggtatcactgtttatgtaacacactttcttgtccaaataactgtataaacacaaaattccattttgaatttcagagcaaaaaacaaagtttctactagatggttcactaaatgttgagtatataaatggtggcattaggattatatcgttttagggaatggatgcagatagatatgaaaacaagttaagacttatttttggaccagtctctcttacactgaattgaaaaaggatagtaccttgcatttcatatggtgggctagagtacccatatgatatacggaattttgcatttactaaatttaaaaggataagtgatgtcatatatataaaacacctaaaaggaatgttagaattctataaatgtgtcttctcatttttagcaattttgtgatgtctgtattcttaataataggggaatacctgtagtacattaagtatctaggccacagtagaaaagggaagataggatttcaataaggaacctcacctcacttttagttcacttattctaattctggcccgtcgaagcttttatatttttgtccctcaatgatatattgtttttctcccttaccatagcagtgggagagataataaaataataaataaatattgattgaagtgagaaaactggggaaacattgctgcgaaggaaggttttttctatcagtgtggtgtcacttaagcataagcataactgcagacattgattggtaaggaactgttacatttaaaaaggtattttagtggaattaaaattttttttctttgtaaaaaccgagggaaaattaatgtttggatttagagtaagttcaaaagcatatttatattacgtttacaaatctggtaagatta

SEQ ID NO: 89885 - DNA, 1979 bp, Homo sapiens
atggtttaaagcaatgaggcttgatgagatcattgagggagggagtgttgccagagaagagaagtctaaggactaagttgtgggaatgccaatatttaaaggttaaaaaaaaaaaaaaagaaagaaaagaaagaaaggagactaaagctagagaagaagaaggaaagtcaggaaaaagtgaagactttgaggccaggtaaagaagtatttatttcaaagacggaatatgaactatgtcaaattgctggtaggtcaagtaagataagggttagaacttgataatggatttaacagtggggaggtcattggtgaccttgtcaagggcagtttttgtgacaggcagagcaggaggagggtaatgttacaaatgagaagtttaacttgagacatcacatatttcctcagagtttaaaatggaaatggagagctgggttcctctctagttagtgtgactttcataccttcacagttgcccatcttattttagtgattccaagactaatgtgacaattcagcttcaaatttggggaagcatgtttgtttcttctttttctgtttaattcaatttatatacaacgagaaagttcagtgctcagtttagacttttgatggcaacctaagggaagaaattggaatgactggagatgcaaatgagattagaggtgggtggcaggagaaagtcgaagttggttcaaccaaatggaatttcctttaaaaagtaaggtcttggtgggcataatgggcttttagcttaatcagtaactcttgaaattgctgtaggttggtgatggatacagcataagcagaagagttcattcattataatatcacctgcagaaatttaaaacatgatttatatgcctcagcatctatgaatcacttttaaaatgtgatttatttttgaccagatagttctgcagttcttcaaaatctgtctctcatgcactcagggctgtttagcaataagaaataagtgtagtctcctgttgccatctgctcattccacatgttcctttgaaaccgaacactggggcttcctttaaccaagcagtcctaaagtgtcaggctcattgagagtacagtatatttcttaaccacccaaataagaaagtataatcttgtcagctgcttaagtgttcagaaggttgtgtcccttacagcccttaaattctggaaacactttgttataaggaagcagccgagtagtttctttagtgtgtttttatgacctagctgtttcatagtagtataataaacagagtctttattatctgcttcaggtttgttttccaagtcttcaattgattggtggtaaatgcacaagcacacacacacacacaaaatacatcatcttaatcatcatgtcctcatcacatcatactgtgatcttgacttgggtacactcttttgacaaatgacataggaatgttctctgagaatttgaataaacctttacaaacttctcattcttctttcactgcagctgtggcaaatacatttagctgtttagggtttagtacttgcttctcatattccccatcggtaggtgggtagctaaggcctgtgccaattcatgtatgcgcatcctcgtgagagaaaatttgagtttgtttttgtctgcaagtcacagggggcctgcctgggacacaagaagtacatagactgagaacatattgactatcctgtgaaaacaccctgttgctaggatagaaatacgtcctgcttttgcatttgagagctagacaaacagtgtggaggaattaacattgatctgatactagtttgtatataatcttaactgtttatagcttttagaaatcatgtgtgctaccaatattacatgggatagtgtgaaacaggatggtcttatcagaatatcgccccataggtcattgatagtttcaaaaggaaaaacaaaaacagtagcagtgaaagtaatctggtagtcaccatctgaatcaaatggtcgaaggtagcat

SEQ ID NO: 89886 - DNA, 1056 bp, Homo sapiens
cattgcattttattaattttttttgttaaatgtatttcttcaatagacaaggcatgttgacatttctaattttcaatgttatatctttcaatcttatatctagtttttttgtgtgcattcaataaaattacaatacatacagaatgaaaactggaatctggtattttatttgcaaaagtttgaaattcagttgactttaacttttgttttttgcagtttgaaattctctagctacctggatgacaaatataaaatctcagtagtttaaattagaagtttatttcttgtttttgtcacttgtccgtcatgtgtcacttgaggcctctactctgcttcactgttatccttactttgaggttcagagtgagggagcaacctctgtgtgaagcagccagtctctggaacagagctctggaaagccttgcattggttccggccagaactacttacaagacttcattaaccaaaacggaaccaggaaatgcagtcttattatgggcctacaaagaatgtggactatggtggggggtgggcagtttggaaggggtgttaggagggtcgagggaggactggaaattttgatgaacaacagtaataactgtatgctactttttctgaaatatattagttttaatggaagattaattttaaatcactgtgacaaagttgaatggtgctttaaaaagtcacactcaaagctgaccattattttgttttatagagagatgtgcctctgggatgtgagtgatggcagatgtattgaatttacaaaattagcttgcacacatactggcatacaggttagtttctatttctgtgactctaagtacaaactattataagtatataatttaaaatatttttaaaacattgagcctatatttttatatgaaaaatggtgggtggtagtaacaagacaagaaaactagaattgaagcggtaaaagtgttcctcgtaagatggtacagttgggaggggtaagaaaggagaggagactaatggggaaagatacagggcaagcaaattgctgctgcttctgctattctgggctacctt

SEQ ID NO: 89887 - DNA, 1155 bp, Homo sapiens
atgaatgtagttctaccagttctctgttgggaatcagcgagaaggaaggcttttatgccacggacattaccctgaaatccttgttgtggatgctaccagccttgaagtattatactccttagtatcaaagatatcaccagactggattagctccatgagtattattcgatcccaccgaacacaaggtcagtgtattatgcctgttaggagctttagcaccatgacttaatgtttagtttactagaacattctacaatttatcataaattaatactttgggatatattcttctatgtaagaaataactacaccaataatttatggtctgtttcttccttcataaagaaatctttgattgaatgaagacttaattgttggcttatctccattccatgatgtatagatcatcagcttttgacagagtatatgggtgattatctgaagtggaggaagaatagcttaacctttgggggtgtagttttacctttgggaagagctgtagttttacctgtatatttctggggcctggttctgtcacttgcttaagaggcatagggaatgtttccatttcaaatggggacagtgaaaaaggagagattatacacagttaaatttaatgaaagttcctggaaggggctgatatgtacttgatgctcaataaatattattatcttttcttcatttttgttgaaacctcttaataacaaccataaaagcaaaagtaaagttgtcaggaaaagagtaatagttaatgcagaacattgaatgtctacttttataagccttttaaggagcattcttttactttcaaatggcttcatagttatgtgcttcctatagaggccagtaaataaccaccaccactaccaccggtatcagcagcaccatcaccatgaggactttcatttactgtgtgtttacactaccaagcaccatgctaagcatttacatatgatcaattctcacaatacttagtggggtaggtactgttaatattcatcatatagatgaggagaatgatgagagttagtgtgatgccatctttgctaaaggaccccggagtagttactttaaccactgtgttacactgcttccctcccattagtgaattgccttcaactttataggagcttttgctttgtaacctcttagggt

SEQ ID NO: 89888 - DNA, 1047 bp, Homo sapiens
cccttacctgaagcttaggaacttagattttatatcatatctttctcttgatcacactctggggagggtgtaatgtgcaatgaagtatctggaaggtggcaaggtatgtgggaaagggggagaaatttgtgccttgaagaaatgaagtgcttgagctcatccatgataaagaattagaagttgtaaattttgaagtgtataagttcattgttaacatagtaatcaagaacatttgaaattattaaaaacttcttgattagaaataaaaaattcaattagctagaaataattttccttgaattttaagttgttggccatctttattaacttgtgtttcaaaacctggtttctgtttcatgaaatagagaattatgtttttctgctaattgtaaaacatgctattgtttaattttattcaagcaaaacatcttaatatttagaaaaagcgtattatgttcgtaacctgggctgcttttttgtcccttctcattttagaggacacagtggtagcactctcggtgactggcatcctgaaggtctggattgttacctcggaaataagtgacatgcaggtgagaaaaaggaaactggggtgatttctctgtttttattctctgtagctcaaaattttagtaatgatatgccccttccattttttttaagggggaaggaaaaagtgattattttttgataattttcttataggcatagtatggaagattctctagtatgctatgggagtgaattttttatttacttttaatggcaacatctgctctatcatggatataaaatagagaaacatattgcgcaggatatgtagaggagaaacgtaaaagaggtgaggttctcctcaactgcttctgtttaaattgactcaaaggaaaaaaaaataaagcaaatcaccacaaaaaatatacaaagccatttttagtcatctatttcagttctttgggcttgaattccttgttcttttttttatcaatgagaaagatgaagtctgacaattttgatgctactctcttcagctagggaatttttaggcat

SEQ ID NO: 89889 - DNA, 1010 bp, Homo sapiens
agagcacacatagttatgtaataatgctgagtaataatagttcctttgttgaacaaggcattgcaatacctccacaaaatcatgtagcattttaaatcattagaaactagaaataaagaataaaacattttttctctataaaaataaaagtttattgtgatttctgaaaacgtgcttaatatccacttaatgttgaagtacaacagcacttagtactgggttttcaactctatattgagcagtaagaaagaagctttggctttgaaagcagagttttttttgttttttttttttttaattgatgttctaggtttccatggctttatcattctgaacattacgtctcacgtttatgtggccgggtggctaggggaagggaattgttctttccatgaatattttgaatatatagaatttgtatatctatgtacaattaagatcatctttagcctgtctgttctttattcaaacttccacttactgctcttcaacctagatagtcatgtccaattaacctaaggaataatgacttgtataaaaaatatacataagcaaaaccaaaaaaaaaatcattttctttaaatatcagctccctaatacgttttaaattaaaaatgtgtattttgtggtgtgttgaaatgtagaatattggttattacagctgctgtagcaatttttccttgttaaatatatagtttatcaattaaaaattttagtctgggcgacatagtgagaccccatctctacaaaaaaaaaaattagcatggtgtggtggtacacgcctgtagtcccagctacttgggaggctgaagtgggaagatcctttgagctgggaggtggaggctgcagtgagctgtgatcgtgccactgcactccagcctgggcaacatggcgagaccctgtctcaaaagcaaaaaaaattcagtaagtaaagtcaaacgattggttatgcttaatatgtgtagtttccattggctaatgcttttagctgttaattactgtatttgatt

SEQ ID NO: 89890 - DNA, 1045 bp, Homo sapiens
aatccatactgcatatttttggatacatgtataggtagtaaaaatattaaaaccgaagggaaagctagtgccaaattcagaccctggtttacttttgagagtgagaggaaggagtagggaaacttattaaagtgtcatgttttatttacttttagtattatagctatttaatatttactatttattttcctcatttacattgacgattaaattctcagagctgtctttctgttgttagaattattcagaacagaagttttcgaaaatgccgaaaaataaactgtttagtaccagtgatatgtttctacatgtaagcatataggctaagttctttaatatattagttaaagaatgaatactttttgtttaatttatcatattaaacttttggtcacgtaatctccaaaaatacccagaagggggcagcatggatttgtgaaaacaggaatgtgcgtcatctaacctgaacactagtgtttgtgccttcaattgacagtattaaaaccagtattagattcccggctcctagaaacaggtatgctaatatgaatggaacacgtgactgtgtgtataccagtgtggctaatgttcacagccagtaagggcaattgacaaattagatattctttttaatatatcatactattattctgacaaagtactgaaagcttttgcctgaatttgctcttatctcccatttttgattctagatttttgttattaatttaatttgaatattgcatttaaaaagcaatgtctatacctatagcttaatatctgaagtcaagcagagcaaactttgtgaatacaaactaagcaaaaacaggaagcagaactaacattattttcttaaaatacaatgtacataatgttctgtgtcatcctttttcctttaacacttaattctctttgattttgagaacattttcatatatttttatgtatttggcaccatctttttgatattaattttatttttaaaaattaaataatacatagttatagaaaatagagatattttctaaagacatcatatttgtcacta

SEQ ID NO: 89891 - DNA, 1161 bp, Homo sapiens
cccatgcacatttgaccacactttcctccctttttttcacctaatacctatcaacgtgtcccatttgggaaagatattgagatattgatctttagtttaaaaacaacctgtttgcttaggagaacccccagcagggtgaggtttgacgtgttttttctttagatcccatacaagggaaagagtatatttatagtgcagtgggcctccccctcaataaatagccacaatatgtacaagaatgagtttctgatggctgtttttatgtggtttccctcagtatgacctgaaagcataaaccagtaagtcactgaaaagttaagttttcaattgtttataaattgttttatagaaatctagactttaatttttaattttttaggtcatgggttcagttctctcttaccagagaaaatctttgattatttatatcttgtcttgttctaaaaaggagttgaagggcaaaaactagaggtgagcagaaaatacacagcagaacatttaattggctattgtgtggctacttgaggtgatgcatctgctgacattatagatagaaaccatgaaggaaataggaatgcatatctacagataatgtgaatatctatgactcctaagaaatgatcgtggcagagggacggtgagggtattgtttttgatcaaaggtgcagggaagagcatgggtctaaatgaaagagtcacagacagaaagaagcactgcagaaagcagctcccacagcaaacaaaggaaagttcacactgtggaaagagcacacctaataacagatcaattttttctcagctttgcctgctccaatatagcaatcattgtagtgaggtcatctttaaatttgaacagcagtttttccagtgtaccttttgcaatctttaatctagaattaatttagtataaaaatattttgatgattgatctgggttttatgtataatataaaggaacatacttttcaacatgacctaatattgtggtggtttttcagtggcagcaaatgtataattaattttgccttaagttattgaaaacaggatccattttattctaaatttaatttaaacacaattaaggtttattcttcttttcaggcaagagtacagcactgcatctgctctgtagccagtgaccactcagtaggacttctaagtt

SEQ ID NO: 89892 - DNA, 1052 bp, Homo sapiens
ccttccctacccttgttttttaatctcactcttcctcaggacagtgaagccattaccaacccttagcccctccacccattttggcagagttagttcttacattctttttatgctcacattttttttgttcatacgtttcccaaaacacttttccctttgtatggggtattttttgttctttatatttgtcttccctactagattttaaacttcttcaggacagcagttcagtttttcatctttttatttccaatactcaatgtagtataactatattgcattgtagtataactacacatagagtatggtacatactagtgaaaaatgataattgctcaagcaatttagtaggaagttagtttgaggtgtcaattagaattgtgtcatagaagaacttgaatgcaaagctgaggatgtaatttaatgggtgctgacatgatgctgaatacttttaaaaggatacttttgattgcttaagaaatattttgtcatatctaacattttaatgtaagacacttacaaatattgatttgggaaatgaattgtgaggttactggaatgataaagtgagaggtcatggggactggaaataggattaggccctggaaatgtggaaaaggggatggttaggaagctgttgcataagttgaataaataggacttcactctggtcttgaagagtttgatgttcaagattatttcagaaaccaaaacccggctgaggggagaatggcagtgctattaacaagaatgtacaggccatggaataggctttgaggatgattgtaataggagacgtgcatcttattggtagtgttaggagttggggtgtgtgcaagtcagcaaaatacctttgagaaataagtgacatgatggtgagataaaatggagatggtattatttttttcctaaatagatgctggagtgtagagcctgacttagactgcagttcacatttttgggtgcctgctgtcatttgatttttttcagatatgctcttttcctgaattgtcactgcaaataggtgaggtagttcttattgtccccaatta

SEQ ID NO: 89893 - DNA, 1054 bp, Homo sapiens
gacatctatgttgtgatgtctgcaagacctttaagagagtgaaacttgaggcagggctgtggtgatgagacatccaaaagatggttcttaatactgtggaagtggaggagatcattcagagctagactctgggcttactaaccttaagggaggaggaaaaggaaacgatttagagaaggagtggtgtgaggcatgtgaggagagccaggagaatgggctaacctgtaaacagagggaatcaagagtttcaggcagagtagagagtaatcacttgtgtcaaatgcagtagatgttgggtattagaaggatcgaaatgtgtttgtcaatgaagtcattagtattctttttaagaactgtcttcccaggatgttggaaggagaaggttcactgtggagagttaaggagtgaaaggaaagtgtggaaatagaaatagtaacaaatgtataatacttttgaaatgtgtgtatgagaagagaaggaaagagagtagctagagggagatgcagttttgaagacagctgagagtatttgtgggctgaggatgatgatcaagtagtgagaggaacgttctcgatcaggatagggaggaattgataattgatgaagctaggtttccaggggatgagagagtgggcgatttcaaaggtaaagggaaggaaggcagttggccttgatgtggaggaggaaaaccttatttctgaaactgaagggaaagagcagaggctggggccgggcgcggtggctcacgcctgtaatcccagcactttgggaggccgaggcggacggatcacgaggtcaggagatcgagaccatggtgaaaccccgtctctactaaaaatacaaaaagttagctgggcgtagtggcgggcgcctgtagtcccagctactcgggaggctgaggcaggagaatggcgtgaacccgggaggcggagcttgcagtgagccgagatcgcgccactgcactccagcctgggtgacagagcgagactccgtctcaaaaaagaaaaaaaaaaaaaaaaaaaaaaaagaaagagcacaggctgggtgtctggat

SEQ ID NO: 89894 - DNA, 1056 bp, Homo sapiens
agataacagcatttgaaagcccacacttacgatgcacagaatatcaaggcatcccttatgtgacactgtccagtgttcatatgcagtaaaatatttgtaccattactctacggttcataatagtgtgacatctaattagaatgctgaaagtctccagaacagcacgccccaacctttttggcaccagggactggtttcgtggaagacggtttttccatggcctggggtagatggtttcgggatgaaactggcgttagagtctcataaggaacgcacactgtaaatcccttgcatacacagttcacaatagggttttcactcctatgagaagctaatgccactgctgatatgacaggaggtggagctcaggtggtaatgctcacttgcccgccgctcagctcctgctgtaggaccccgttcctaacaagccatgaacctgtggaccagtaccagttcttggcctgaaggttggggacccttgttctagaaaattagtcacatgctaatttaagtttataaatagcaaaatataaaaatagcacttgtagcataatgagcaaaagtaaccttagtaactcactttactaaatgaccctatgcttaacattgtgtcatttgccctcctactttgaatccttttacatcccataaagaagccccttgacctccaacaactgcagaccctaagttgaaaatcactgacctatatggatgttgaactttcctaggacaatggttggccagcaagtgtgtgagtcagggacaatgatttcaaggtttaaacatttttttccagtgtgaatcttgtaagatgatttatatgacatggtattgcaggccctaaaattaaccttgaatagaaatatatttgtcagttatctcagggagacagtttactgcattgtccaagtataggaagtataactggtacatagtggttgtgactgaaattctatatgatgctgtcagttgagtacaacaggtaaaatatccaaagatctgttaatgtcttccactgatctctctcttattttgtattaaaatacttatttttcc

SEQ ID NO: 89895 - DNA, 1050 bp, Homo sapiens
ggtaggcagtcttttctttatttggaagatagaaggattgatactagggaagctgagtcttgtaaaggtctgtacaatggaggaacactcctggtcttgttactttggtaacttggccctttgggaagagttgaaaatcaatctcttttgtgctgctgttgtggaagctcttaatatattgatcttctaacctcttaatatattaatactatttggatattattattcaggcattatccagtaagacatggtctacagaaatatctttgaaagatattttctttatcaaaggcatgacctaaacatctatacttaatggttacaacttactgtaattaagtgatttctattttatttatatcatattaaattataacgtaatatgaaaccttaaaacctcagtcaaatgtctctagtttatgcttattaacatacttgttaatgaaaacatatgaaaagtcaaataacatgaagtctgtgactgtattgtcattcacacctacccatgaagtcttatcctgtctaaaataaaatatttaagatgaataatagtatatattgtctaattccaacataaatggattctctgatgaaactcacttgtattatcctaactcttaatgttaagtaacagcaaaacaacagcagagggcaccaaatatccatttcagtctccacagtttcttgatattttctaatttttatgcctcccttttcactctctgcctttctccttcttccttccttccttccttttttctagtacttaaaatatttaatattgaaacattaatattgtgcatattttttagtagatgatgaggtttttcccttagctatttaaaaattacatcaagacatcaatttgtttttattcagtgaccgttttacatttaacatgcatcagaatttcagaaattcttttaaaaacttttattcaataaatatactaaatcaagagtaaaattataaaatatttaatttatttttcctgccaaaatattattaggcaataaaccgtttttcacatttaggaaatttaaaattatt

SEQ ID NO: 89896 - DNA, 1049 bp, Homo sapiens
taacagacccggacatacatgtgctattctttgatgtggaagcgttgattattcaactcctgactgaagaagcctctaggccgaatactgctcttatttccccagagaatttgcaaaaagcatctggcagttcagacaaagggggctcttttttaactggaaaacgagcagcagttctcttccaacaagtgaaagaaacgatcaaagagaacatcaaggaacacctccttgatgatgaagaggaggatgaggagataatgaggcagagaagggaagaaagtgatcctgaatatcggtccagcaaatcaaagccattgaccctattagaatataatttaactatggacactgcaaagctgtttatgtcctgccttcacgcctggggtttgaatgaagtactggatgaagtttgcctggatcgccttggaatgctgaaaccccactgcaccgtatcgtttggcctcttgtcaagaggaggccatatgtcactgatgctgccgggttataatcagcctgcttgtaaactgtcacatgggaaaacagaagtaggaaggaagctgccagcgtctgagggagtaggaaagggaacttacggagtgtcccgtgccgtcaccacacagcatctcctgtctatcatttctttggcaaatactttaatgagtatgaccaatgcaacttttattggtgatcatatgaagaagggtcctaccaggtgtgaccatgatagtttgattttattcttaagtttcaaaaaaagaaacctgttttattttttcattgttgattactcttttttggctctacacaattttattatttcagtgtcatctcagttgtttcccttttacattttaaaacaccagtttcaaaatgcccgattaaaacataataaaattaaacaattttatgtatgattggcatacttagatgttttttaaaaatttggaatgagggagttggtcatatagactagctcttgtaaatataattataaaattgtatacgtacttgaagtttgccctaatattcaattcaaaatatatatttga

SEQ ID NO: 89897 - DNA, 1030 bp, Homo sapiens
atattgtgcaaggacagattaaacaaggtaaaattaaatcttattaagtaattgacatgacatttcagctctagaaactgaggaggcatagctaatgtataatcataatatttgtttgtcttggattgttaaaagagagaaaagttgttatattccagatgtaaatatggataattaagatgtcagttaaggataaatcagatttatttagaaagtgataaatgagcatatttcagataattttattatactgtctttggactaatttttatgcattggggcaccttaacttgacaacagtagtgttttaattgtgtgtttcttgagtttaaaagttatacctattttaaactacatttataaatgcttaagttcatagttccatactacaactaatctgccattttcccatagttcatgtgttgtgattcataagtggaaatccttgttaagctattctttttatcttttctttttatttgagtcattatataccttaactttcacctatagctttgtttttcattaggagatggaggagaagaaaggttgagtttctcttcctctactaataatttctacatattcctgagtataattaattaatatacttagatgtatctgcatatatcttttatattcctattaagactgacaaatgagctaatcaagagagttggggagttatgtctacttagagaacttcactttggacaaagagttaatactgactcttcacagaatgtgatagagaaaagtaaagaagtaagcaacagatgggttgatgcagcttctgcttataaatggtggcatactggcatttttcttccctacttttttttaagtttgaaagagtcaaacagtagttttacaaggtttgttaaacagtagacccccaactttatatctgtagttttcctcttccacaagacaagtacttttatctctcttagctgattatttgagacttactttaacatccttaaatggtgtgcttgattttcagcgttaggcactgtcagatggttct

SEQ ID NO: 89898 - DNA, 1054 bp, Homo sapiens
tctttcttctcttccttcttctctcccctcacccaccctccccataacatcgtgattaccatgaaatactttaaaaggactcatcattaaataattgtattctttttttagtattaagctttgaaaaaaacttacttttttaaacattgcatttttttgtactttaaaaatttttttctctgaaaaatgtattgaaaagggctacttgtgtttatgtgctaggaagataatgagatttagaccaatatgtatggagcacccgaagtatgttaactttctgtcctataaatattttaatatcacaataggagtagtttagaatcaaatttaaatggagtttagaatcaaatttcaattaaaaactcaaatattcctgttgagaagcagaatctagggatgttataatattggatatgtatgtgctatgtaaggggaggccagggcagatgtgtgcatatacacgttgtcacacacgtttatttatcttcacctgtcttttcttatgagagtaagcagttgaagcggctcagataaaataatggaactgtgttaattttgtcactatgttgaagctgtgctacagctgttttcccaatccttaataagagaagcaaattgataggtgacatagcagcttttctgttaagaaatcaaatgcttgattatgttttatggtgtaaatctttcatattcagtgccccatgcaacttcagatttattatttattaaatcttgagctttttatcttggaagtaattttttctgctaattgctgatttttcttatgtagatagttgtgaaagctgtagcagagtttaatttcctgatgaattttgaaagtgctgtagattttgccatttcagttgtgaggtagtgtgaatgaagtattttttggtggtgatgcagagatttttaaagcatagtaaatctgattctttgatttctattacaatatttttcttgatttttagtgcccataaaatttattaaaggatgagtgtaaatgcctttttttctaaatgaaatgtcatttaaatatgacttcaaaaataca

SEQ ID NO: 89899 - DNA, 1126 bp, Homo sapiens
tttttcatgatggctctagttgttttagagctatgttttgcattagtcaatacattcatcagaatattagattttgactctaagatgaatttgaactatattgtgattactgttcaataaaatatatcatttttctgctgtaatctttaatgatcatgcctttctgatgaaaacatcgtttcagttctacattctctgttttgcctactttgtttttcattcttcactaatactaagctttttttcagaaactgctgtacttcaattctctcctctttacttcttctcttttcctctgcaagttgctgcacctgtcgtttccgctcggtctgatgctgatcactctggctctgaccctccttctgctcctgctttacatacctgtttcttagtaaatgaaggtatctctctcaacttctaacaactttctctcaatctgtgctttattctgacagacatgttctttttatctgagttacacattcatctgctttgttatgtatgagattctaaagttcccattttatgactttatttgctaatgtcaatgacaagaaccagttttaaaaatgtaatgttacctctggctggtataatccatgttttctataatctagactactgttaagtgcagagatgccaatctttgatgtaaagtcagtgataaaggtggattggtttttgtaatgatgtttgccatttgatctctggcattagagctaatgaatttattttatatgtatcattacttggtggcagacacactttgctgccttttcacaattgtgtatgccagttagagggagttgtgagggaatctcttaacattctcattggaaaagtcttcagattgattattggcaccagtgattatagactgataggaatttacctatttaccctctttactatttctgttttaagctcaggcaaaaattcattatttcagtatttaaggcgtagttgggctaccatgttatctctgtggagttacacaagtcgaaagtatttttggagccctgaaaatgggaatgggacctacaaacctttattccataagacctatctaggattatttgtactgcccagaagcttaatgaaacgtgagctctgagttacatccact

SEQ ID NO: 89900 - DNA, 1047 bp, Homo sapiens
aaatctgtattttcattatggctattagattctctagtgtaaagtccttgtgtttccctaccttcatttttattttctttgcctagaataactatcattcaaaaaagttaaatgaataaatttttcctcctgccttcgccatgctcagagaacagccctaccattctgtgttttaactgaaaactactcttgattttctctccattaagtactgtctttaaaaaaatatatagatcagtgattttcagacttttagaaaagcggtatcctttcttcaaatgaaaacttctgtaaaacatgtggacatgtgtgtgcatgcatgcatacacacaaccacatagaggtaaggatggggagggtagaggtctcccttctggcacttctaaggaagtactagggctcccagtagcacggttttacatcattggcctcattgctaccttcattcaccgagtccctccaagtcattctttacattgctacaggagagccctttctaaacacaaataaaattaagatattttctgtgcttaaatttatttaatgactccctcagtttacatataaactttttggaagctaagggtatgtctttgtacttttgtgtctctaatctctggtatagggcttgttgcataatagcctggaggctccttgagtgtttagtataatgagggaacattgcactgtttcctataccattgcacagttattatacctattgcacggttatgtttaccattttaatggcttgctttacttatattggcaatgccagcctctctgttactcagatctatcccacccttcatgcccaatacacatcttaacatcccctttttaaagccatcaacttcagcagccttcatcagtttccctttgatttccaaagcagcttgctgttataaataacaacaggtgtaaggtactgaatgtagtgagtgcactgtttttgtcaccacttgatgatgtaacctctgcctaggtgatcctagccaaaaaaaaaaaaaaaaaaaattcatgaaggatttcaaaggtaccttctta

SEQ ID NO: 89901 - DNA, 1034 bp, Homo sapiens
atgaaataatgatttttgattttgtatttgagcagtatctatttaggaatgtgatgtttaccttctcatctcctctctgtgattattttactgatagctatctttaataaagtaatattatttttctagtacatccccttctttatgttaaaattgatcatataaatctaacaaagtgcttctgtaagttaaacattgagtacagatggacacaaagaagggaacaacagacaccggggtgtacttgagggtggagagtggtaggatggtaaggactgaaaaactacttcttgggtactatgcttattacctgcgtaatgaaataatttgtacactaaacccccacgacgtgcaatttacctatatagcaaacctgcacatgtacccctgaacctaaaataaaagttaaaaattaaaaaaaaaaatgcttctgcaaagtggtgagtttgtcattttttattcatcagggatcattctttagcattattattattattatttaaagcaactctgaataagtagtggtaccaaaatggtgcgttttagtccacaagtttaaatccttagagcttggaactgcctactggtaggtccatttctggatctgttacggtggtttgtgactaaggttcttcctcttttggtgcctttggttaaccggaggtagcaaggctgaatttcacataaatgtttaagttaataccccttgttagaaaagaagtccttgaactaaagaagtgtttggtctttaaaatatttaaatggattctatgtaggcagttattgatatccttttaagatgatttggttagaaagtttaactcctagagtagcttctaatggggaaatttttatattatcatgattgagaaataccttttgataaccatgtgaaaaatatcgatgcaccctagtatctgttgtgaaattgagaaataatgtgacagatgcaagatgacaacaaatatgtatcatcaaagatgaaatgatagatatgtaaggaaaagacatttgtgtgagctggcaaattctca

SEQ ID NO: 89902 - DNA, 1023 bp, Homo sapiens
gccaaatcagcggtgttaagtatgtacacattgttgttcagccatcaccaccaatcgttctccgaaactttttcatcttctcaaagtgaaaccttatacccattgaatgctaacttcccattctttcctgcctccatcctctgtcaaccactgttctgctttctgtctctatgaatttggctaatgtaggtagttcatataagtggaatcaaataagtgtctggcttatttcacttagcatagtggctttaaggtttatccatgttagagcttgtgtcaggagcttacaattgtgttgatccattcaacagagtggatctgtcattctacagacacttgggtttcttctatcttttggcgactgtgaataatgctgctatgaatattgatatagaactatctgttcaagtccctgctttcagttattttaggtacacaggattggatttgttgtaatacatggtcattctatctttaatattttgaggaactgtcatactgttttctacagtggctgtaccattttacattcctactagcggtgcattatagtctcagtttctccacatcctcatcaacactcgatattttcttttttctttcttttttttttttttttgttttttgagatggagtctcgctgtgttgcccaggttggagtgcagtggtacaatcttggttcactgcaacgtctgcctcccaggttcaagcaattgtcctgcctcagcctcctgagtagctgggattataggcatacaccaccacgcctggctaatttttgtatttttagtagagatggggcttcaccatgttggtcaggctggtctcgaaatcttgaccttgtgatctgcctgcctcgtcctcccaaagtgctaggattacaggcatgagccaccacactcaatctatttttttttttttaaataatagcaatcctaatgagcgtgaagtgtgaagttatataggtatctcattgtgattttgatttgaatttccctaatgattagtgatgctgaggcaaaa

SEQ ID NO: 89903 - DNA, 1037 bp, Homo sapiens
tctgtttactaataatgtagtttacggggagtagaaatacagcgtttttcatggaatcctaacattccatcactgttacatttagcagatatattaaaattatggtttaaattatttagttggtaatttccaatttaaaatggacaaaactcattttcttgtgaatcctatctacattccattgctgttgtatttagcagctctattaaaatcatgattcaaattattagctggtaatctccaatttaaaatggattagcttcattttcatgtgtcttcatgtatttataattcagtattagatataagtttctttctaaaaaactgcatatatgtactttaaaacaagaatcgacaaagaaacaattgttttattattagtcctactaaaattgaaatttgcttgaaaaaatgttattatgctatgtttttaaaagttggtaacctgaaataattaaataagattatgtatttaatagcctgccctcaacacttacgcatttttagtgaacattgctttttataaaaatataaaatgttctcttcccacgttctttattgagagactagtttgtgccaggtactgtggagcatacaaatagacatgaaatcattgatatattgtgacaaggcagaatattgactaacaaaaatacttttattttctaaagagattatgtgataaggtttggatatttgtctcctccaaatctcatgttgaaatgtgaccctccattgttggaggtgggcctactgggaggtgtttgggtcatggggatggatcccttattaatggtggtatggtttggctgtgtccccactcaaatctcaacttgaattgtatctcccagaattcccacataatgtgggaaggacccagggggaggtaattggatcaggggtgccagtctttccctactatcctcatggtagtgaataagtctcacgagatcccatgggtttatcaggggttcccacttttgctttttccttatttttcacttgctgccaccatgtaaaaagtccctttcacttcc

SEQ ID NO: 89904 - DNA, 1149 bp, Homo sapiens
aagggatttaattttttgtccttttctaagcttccttgtgtccaaccacttgtgattactgattgctactaaatctttagcccagttctggggtcatcaattcccattgtctctttctgctttcaaaataatcacctaattctacattttccacttttcttcaactccaggattaccatcctagttgacatcactttgatttgtagtctctgatgttcttgtggctgctcttgtcttcctatagaccatttgctacacagagtgattctttaaaaacgtaaatcagatcattcaaatcatgtcactttctgcttaaaactttccaatagcttttttaaaacaaaacaaaacaaaacaaaacaaaaaacaagatgaagtctcactgtgttgcctaggctgacctcaaactcctgggcctgagtagctgggactacaggtgcatgccattatgcctggccctgtaactttttatcccacctgagactaagacttggacttgctactattgacgacatggtcttatgtatgatctgctcctgtgtgcctccatcccttcacattcaccatgacacagacacatttgccttttttttgtttcatgaatgtggccttcatgaatgtggccaagtctgttccagttttaggagcttgacactgtttcctctttcccagaacttcacaaggctggctgatgattgagtctgagctcaggtgccagttctttcacatagccttcccagattgcccaatctaaagtaccccttccccttctagtcactttctctggtacataattcagttttattttccttataaaatgtgtaacagtctaaaattattttttttatttatttgtttacttctttatgttctggatgtaaatgctgtaaagcaggaccaggtttcattgttgatcatggctgtgtaaccccattccatatagcagcacctgaaaactggtaggtgttcaataaatattggttagatgattgaataaattgatattccagttgcctatttgccatgtatacgtagattattctaaaatgcagtgttttgaaaactgaactgaccttcattatttatttatgtttctatatttatttatttatagagatagaatctccctcttttacccaggctagagta

SEQ ID NO: 89905 - DNA, 1036 bp, Homo sapiens
aattatgtatatagaaaaaggtctatgaaaaaaatttgccaaataacaactaggtaccacaaaggtgtgggcattaatttccaagatactatgttgcccctaactatgctcctttatttctacttaacatctcacttacagtaaagaaagcagaagaaaaaataacgtaaaataaggtgatcatttttcaaagctagagatcctttagaggttctaatttactccaaacgaacctttaaaaaatggtcacttttagtcacatgtcattgttttattattgcgatataatttaaaaaaatgaatactacagatactccttataaatgaacagatgtacttgttaatggctcagaagtagagcaaggcctttttcatctcagttttatatcactgagttggtaatgacccaggtgaaaatatgttttaagtgaatccagtaaatgatttgtcattttataaataaaaatgaccttaggtttatttatttcttactatgctgaaatgcacagatataaaatcttcataggaggtattctaccagtccaccaaatgttgtctcatgttttctatttgatcttttacagaaacgtaccatgtctaccccgctatttttataagtaaatctcattgccagagtttctttttctaagtagtaactgtatgagaaaatatctgagaatgatatgctgtgttttcagatttgtataattttacaagtcactacccactgtgtttctgaaatattccttttctcatggaaatgcgaataatggtctcagtgttacaatttgtagtttcttaaatttgccatgtgtatcagattcacctttgaaaggtcaattgaagcaaaaaagttagacgtttttggagatagtttttacctataagacttctgattacttagctgccttagatacttgggattactaaaatctcaatttcctttcaaactgagaatgtttgccctaatagtaaaggcaaagaaaaaaattaacttgttattcaggtagagaataaagggaaatataagatgatg

SEQ ID NO: 89906 - DNA, 1053 bp, Homo sapiens
aaagttaaaactttcataaacaatgttgcatttgctaagtataactataaattatatatatacataatttaataattatatagcatataattattatagcatgaaggggtatttttagagccaaagtgtagtaacgttatgtttatttttctttcaaagctgttttaagcttggttctcaaaatgcttatagattgaggtacatcttgttaaaaaaggtttaatctccatgcggtcgttagaaatagtatttaaatctgttgaagataattgtttttgtagaaaacagaacaaccagttattcatagttatataacatttttctttttaagacaagttcaatgatattctatttttgctcatttttatgaatacattgtagtagaaagcttcattttagactacagctttcctgagagcaatggcattacctgctatgcaaatgtatttcagcacgtgattgtactctatgagccttcgcatatctttttctgtatttacaatagaccttgtatcctatctctttattttgcagtttctgattcatgcatcccaaaatttaaaaacataaacacaaattttaaaaaaattatactgtagcatacctgtttacagatgcatattttcttgtgatggggtttggcaaattagaatacagccgtgttttaacattatgccgtgtgtttggtttatggtcttcttcttaagaattgtatatattaaatcttatgcacaattaattgattttaagaatacaggtagttgttatttttccagttgactattttcaatgggaatgtctaagcgaaaatgtacttttgcctgtcacttcctggaggtgatgaggaagcagttttattagggcttattttactgaattttaacagtgctccttatagcaccagccactggcatgtaaagaagcttcctggagttaacatgaaagtgctcaatgtttaaaggatctgtttttcccctctgctggaagcctacctcctccacaagccatatactcaatccctaaaaccaccttagtctgctgcatatgcacttt

SEQ ID NO: 89907 - DNA, 1027 bp, Homo sapiens
ataatcattaattgtaatacaaacccagtatttcctttatctgatgatgtatgtgtgtttagttctccatggatgtttccatctgtctaggagttccttttatgtaaattcactgggcattgccatttagcattgttctttccaaaccaggtgacatatcagaatcatgtaggaaatttcaaaatagactcctccttcctcagacgtcctgaggtctttaattcagaatctttaatgcagggacacaggtatctacgtttctatagcatgcccgcatgtaattctaaggcaggctggatttggaaactctgagtttacggaataaaataacatactgtatgaggaacaaataatgtgtgaattaatatttcagtccccaaggcctataaaatcaaataatttaaaaataaggaaaaatcatttgcttgagatctagaatcacataggctgaaatggaactttaagatgagtggaatttgatttttttattattattgaaaaggcaatgtagcaacagccttgaagaaaggtttacagggggaaaacctatgatattgccgcaaacaatgatttttgcctatatatgggttattaatatgtataagtatagatatttgcagtctatatactcctatatttgctttgaaatattacctaaaatcataacattttagttaatagggttttagttattcctttctacccataaatttctctcactgtcctgagcttagttagggctaggatccctagatttctgtgttatatttgagaattttcctgtgacattatgctaaaccacccagccagaattttaagtccctactgttgaagacacatacagcctccttttctctcaaccagtgccctttttgatgtcttttcagttcttcaaattacaacaggagggagcctctatctgataaaatcgctaatagaaaatgtgcttaaggaagtcaccaatatcttgttaaccctttgtagctttgctccgaacagggacattttctccaattactcagatcaa

SEQ ID NO: 89908 - DNA, 1049 bp, Homo sapiens
tccttttcatattagcaaaggtatcagaattgactcccacaattgttagaggctttttcttcatttttggtgaggggtgtagattcagttttggaattttcatcaaggaaaattttcgtcaaggaaatacaagaaggctcatgagcttgagctattttcacatggtttaggcatctcactgaaagaagagcttcttttctaatttttcacctttttccatgaagcagatagagagctgtttactacagcctttgtctgggtttggcattgattttaaatcacctggattgatcatgtggttatgggacttaaaaaaatcccaccaaataccaaagcctctaaacacaattagaattgaggggtttttaatctgctagcattatgtccataggagtacattctaaattattcttaacttctgctcatgttaggtgaaaataaagcaccatgataatgtgtagtgtctgaggttcagcagatgctctctaaacatgtagaaatgttcctagttttcaaaatgaggaagcatctaaaatctatgtctgtcttggagtatttcactgccttggcagtttcctcagccaataagagaaaaataggcaaatcaaccagctgtcatgtcacacactcctcagctgcaggacaacagcaggatttaggcaagctgatctcaaccagatttgacaaagaggtggaaggtctaaaattaaataggtcaacacaaattatctaataataggtaggtgtgaagggacaacaaggggtcccagaggagaattgctttttaaagactgtgtatactcttgcttttcatttcggacttgtcattgttagcagcatctgagtctgaaccgtcttatttgataatgaaaaggttcctattttttactaaatacctttagattgttagtaaaagtggcgttttcatgaagtaaatatttacaaagcttcaaactactttaagaagccacctttcctattttcaaggcagtaatttttctgtggcttgctatagtactcagttttgttgtcatggtgactagataata

SEQ ID NO: 89909 - DNA, 1064 bp, Homo sapiens
aacaaagctattatcaatttaagactaatgctatgtttgaaatagaaattatactaaaaaaatacaaaaaaggacattttgcttttagatctgcctcaattcaaaggaaatgttgttactttttgaacaacatttaaaaagcactctttttaaagtcctttaaaaagtcctttaaaaagcactctctaattactcagagagagtgatctagttattcaccattttgttactcaaaactcaaacacactttctaaatatagaatgaacaaaaccatgttgttactcaggtttttgatctccataaatagcaaaatgttcagggattaatctagtattaaatagctgtcttttcaaagttaaattagatgcaaaatgtaatgatttggatcacacgaatctttcagtaaatattttttaaaatattatgattgttggatttaataatccttacgttaaatatgtgttcacagtgcatattcacagaaaatcacggggccctttatggtctgtcttcagactaatttgccaactatgcttatctgactccacttcattccttgcactgtaaatattgatcattctggagggctttttgtttgtttgtttttccccaacaagctatactctccttcctttaggcttttgaatatagtattccctccgcatggagggtgtgtgttatacccttcacattatatgtatgttatatcataccctccgcattatattataccctccacatgtgtgtatgtgtgtgtgcgcgcacacacacaccctagcctttgtaatcattcatacccagaaaatctccaaggtttctcacctggcctacacagtaatcccataatttaacttctacctgaggttatgggtgtaggaggaggtaaatgaatgtctccctgattttagcttagagctttggatgaatctaatatctaggagctccagataggtaatctcatacttccctctgacatcccacacataccaccctggcctagtaccacacatatattcctcctgtatatccagagatgttagaagttatatgtctctggtgtcta

SEQ ID NO: 89910 - DNA, 1036 bp, Homo sapiens
ctacagagagttttgtgcttgtaattgtccttttaatgaactaagctcacaattgtgtgaccattgaggtgatcatccctctttaatcaaaacttacatttttgtagcagcagaacgatgaatattgaatgctcaaaaagcattcagacttcctgcttctgtacaccttttggctacagattgttttgttttgttttgttttgtttttttgagtggttacattgttttgtgctaacatctcagaatttggttttgcaattcatgttgattctgccataatggcattgtaaatcctggatcctccttcacattcagttcaatcctttgcatgagaaaagagttcttgtacctagaacttaattttttttctagtttcccaagtccctttaagcaaattacttatgaagatattctaattaatgtctctctgagtgagaggtttatgcacctctaggaagatggtaaacaattcattcttaccagcaagattagagccattcattctgtagacaaatacctccatcaagtggatatagattctttgctttcctactgataagaaaactaagaagccagtggtgcccatacctgccagacaagctcagaaggacaaaggagtcttaagtatctaaagtacatcatcaggcctgctgtaaacatgtgctaattaaagagtattaaaaatatagtgaaaatatagcttctatttatatacctgcttactcattaataaatcccgttctattctgaggtgatagatcaggctggaaatttttattttgttttgtttcaaaaagagaacgcagccagccaaacctcctcaatattctgagatttcccagagaaggccaggagtctagcactgctcgaattgtaggggtatgaagtaaatatgtgctgcatttgtgaaatccattgtattgcacctgtcaaatgctcagaagagtggcacacaggaagcactcaatagatgtaagctaatatttttaggagacaggagtcctaattgagcatggataaacaagatgacctgtgt

SEQ ID NO: 89911 - DNA, 1106 bp, Homo sapiens
aaatgaaatgagggagctgtagtcaaggaggggaggaagccgaggacggcaaggcctctcaatcatcgcttaccagggacagagggatggctgccattatcccttctcaccacgacaaatgaaagacgatgatacctaagaaactgccgcagccacacagagcggcaggaggcgagggtttgcctggtgaaagccaaacggcagccctgctcttttgcagcctcctatgggacatcatggcgagcagtgacggatggagaaaatgcagcatccctgccgggcaggacagcagcctcaggccagggctctggaggatggacaggcagaccccacggcccaggatccaggaaggccctctgccaggctgtggctccaggaaggccctctgccaggctgtggctgagagtggcctggcctggggcatggctgcagatgccgccccacccgccagccgcagggctgggggccggcacagattacattttaaggtgatagtcatctttgacctttgggacctccagggccactggtcatccatcttagagccgctgaccagcaacctctgggctatttttatggccggcaaacattgcccattgattgaattgattgaaatctgcatctggttcttggggaaaggacactggcctcacagccgcaatatgcagcttcgttttctgttgttgtctttgactctttcctttccatttgtcttcccacccccagcatgaaatgagtttggagacagggcgcacacaccaagacacacacggcctgaatacacacacacactaaacacacacgtcccgcattcttttccagcagatttcttactgtggcgctcatttttctgtcagaatttcaagggttcctcaaaggaattccgctgagaaaagcagaggtatgttcaatccaaggggagtccacacacacacacacacacacacacacacacacacacacacacctgtttaaaaatacacaagagcctgaactataaaaccaaaccacaaccatatatggaattttaaaatctggtgattttgcaatttgtcaacttctaagctgaatagcagtttctataattccctttccggcttcgtgca

SEQ ID NO: 89912 - DNA, 1049 bp, Homo sapiens
ggctgttgtgttcattattaattgcatataaccaagtgtccaataccgttatgtggcccaagagaaatagattttgaagatgcagaaacaggttccactttatttccaaacctgaagttaacctgcaagaaaagtatctagaactagatcacaacagggtaaaatatctatttgtttcagttcctcaaatcaattcaaaccccgttaatacttaatttaattcactggcttttttaacaaagaacattaacagatatgttattaagctgtggggtcattcataattggtcatctctctgtgaattaaattttaaaaaggaaaagtaaaatcaaagaataatcagatttcctatttatgcagggcaactaagttaaattatatttactttctaaaaatagattattttcttaagaaacaaacatttattttgatctcaagtgatctcaatatatcttatatagagttaacaaatacattccaggtaatagtattatagacttaatagatttagcatgcatttaatgatgtttgagtgtagagcactgagctgagacctgaaggaaaacaaagatagattgaacaccgcctcttccctaaaaaggagcctggaaacaatagaagggtgtaagcctcgagggatgggctgagctaagctgacgatggaacttatgcttcaagatatcaagtactgaggcattttgaagtcttggtctagtggcatgtctaatggtggagaggcctcttgggtctgcagagaaagcaggatgtgggataaaaggccactttaaaaccacactttccttattaattgccagcagtgatgggaacctcgagtgtgcccctatcgccagctgccataaacaatactgtggtgagcatgtgatgactctcaatccaatgactagtgttcttataaagagagaagaggacacagaggtgtgaagacagaggcaggtgatgaattgctaggagccgccaaaagctggaagacgcagggaagatttcttcctaacatgtaaacagcaccaaagggatggtgctaaaccat

SEQ ID NO: 89913 - DNA, 1034 bp, Homo sapiens
gctaactcaccctgtggggccctatcaccccctcttatcacccaggctttttccctaaccaacctctgtgcctttgggggaaaggctttttgatttcccagtctcattcaaggcaatggctgaaaaatgtgcataggtttttctaggggcaggtggggaaaaggtagggacgtggattgtgtgacccagcccatctaatgcctgacatggtgcagatgggcaagacttggaggcaggctgtgggctgtgcagatagagatagcctcacttcgggagcaggattcctagaagctgtggacgtttattatgaaaaactgtcccacacaaattgtcccaaagggcagggaggctctgcattccacctcggcacctctttcaccatttgaggacccattactcttctgtagaaagcagactttgtttgggttggaagcacacctccaatgtaatttaatcagcattggactttggctcttgtaatcaaatatacatatactttctcctgcaagaagaaaaataatttctctgtaactggtattgacttgaagtcatgtaatctctggaaagcatcacatttttaaagggaaaggtaaaattaaggggaaaagaacccgcagtgttagtggtttgctttgtcatactaagaagagccagttaccacttaagaaagggcagaagaagcattcctagagcataaatacttgtgctgctccaattgtagatatttcatttacagttttctctgtgcaatcagccttggagatggttaaggataggaaactaggttgactggctcaccaaattctagaatgtgggctttattacttatgttgcattgacatccttgaaggaacctgtttgacggctcatttttctgccgtatttggagaggccacaggcagcagcagctccttgagttccagcaggatctgggtgggtagcaagcctttccttttaagggtgattggcagccattggcagcttgcttcccactccaccccagtgcccttgagcatgaagctgtgccctactgc

SEQ ID NO: 89914 - DNA, 1059 bp, Homo sapiens
caacgggatgttttagatttaggatttcctttcaagtgttactgtctgcctgcccccacgccccaccccccaggtatacacaaacggatgcttttgtttccccagatgcatgctcctgatttttgaaagcatgacttttattatattaaacaatattctcacattatagcagcagtaatgtcacaaggagaaccaactgtggagcatcaccaccttcgataaatctagaaactggatttgatttcttgagagtctagtgatgaggctctttttaatgaaaaccttgccactgcttctgtccctgaccccctacgaagggccagagatgttgagtgacttcctccaggccacacagtggagtcatatggcactggccagggtgagaactgacagtaggcactgacccctgactctggcctttttcaatcagttgctttgctttatttctggttttattccagagaaaagagataggagagtccttttggtcaatgattgagcacaactcacatctctttgggtttcgagtaaaatggtccttgacttcccaaagctaattaaaatgtaaaactcttgctttatttcaaataactttagttcagacctaatttattgctaaggtggttctcagggaggtagagcattggaatagacaagtgtgtctcctttaaaagtcaagggtatgataaatgagaattttttttcccctgtgacaatttatcttcaagttccaggtggccctttgtgtaaaaggagggaaaatccatcccaaaacaaaacaaacctggtagagcattcaaatttgatgttgaaaaaaattgtttctgtgtgtctaaatgcccaaaattttgttctaaaaatgagcaggaacatatctgaatcagatataaaaatgggtgttaaatgtattttgtaagctttgactaaagaagtttcttccagctgtgtagtcttcgaatctgtggacgtgcctttctcaggagttgttgggttccactgtcaaaaccttttccagtaaaacatggatttggcaacagtaagtgtagcctttttggccta

SEQ ID NO: 89915 - DNA, 1035 bp, Homo sapiens
ccttggaggttttggagttaggttgattggaagtaaccagctaataccttttctagtggagaaaaagacattgctaccagcttgttcatcccatagaagtcttccactctgctccatttttagcagcaagcatttcatgtagcataaaccttggcagataagtgtgcctaaggtttatacagtctgtccgcttggatgtatacaaatttagatacatattttaacatgtgttctcatagatgactttataacaacacacattacctataggtgtctagactgtgtacatacaagtgtgtacagacaagcttcatacgtatatactgtaatccgttacaacaaataaattttaaatcatcgtttaacatgtatgtggtacttctacagtgtacattgttttcattatttattgtaacattgaaaaccacagtgcagggaaaacaaaagtatcccagcatcttcatcctgtacacttggaattaatttcatttgggcatatccaagataaactcaactttcaagaaatcttgtatattatttaatcatctgtgttaggatgacacctatgattgatgacttcggttgaatagctttattctggatttttcataactaaagctaaatccaaagacctgaaaaaggacaaaaagaaaaaaaaaaaaagaaaaaacaaagaaaaagaagaaaaaataataaagtcaagcgcaaactgatggggagacagtgggctctggtttccaggattgagacaatggtactgcggtcttggggagactgcgttagctagtggggagtggtgatttttttcatgcttgtcacatctaaatggtctttaacatgagaaagttttagaggttataatttcctgctttgtttttatttagactatcaaatgaagttatacatgttgtcagtcaaaaaatgaagacaccctctgccccaccccacagaatgctttttatcttgtctctttgggttatgacccaacaagctaagtaccattaatgtaattaacttatttaaattagttcctag

SEQ ID NO: 89916 - DNA, 1021 bp, Homo sapiens
ttgagggacaatctgtgtcataggggaggtgacatctgttctacagaatgtggccttctttgtggggccagccttttacctgtatggcaagtcctcatcttccttatctggctgcctgccctatggactttctgcctgtctctgaggatggttctggtggccagggaggaagctcttggccttcagttgctctcccatgtctgtccatggtagacttagcacagggcaaacctttggaaaggaaaatgctggatttccctgtggtgctgtggtattgaccagcgtgtgtgtgagtgtgtgtttgtgtgtagactgggtgggaggaggggaggaaacaaatgtataaatcacattttgcaaatccttccattcttagccagctgtaaactcatgtctttgcttttctcaagctttgatttatgtattgggatcatggggtttgtgtcccttcttctggctgtaagtttggatttagcagggtgctccataaaaatgttatgtgatttgcatgctctgggctgattgagttgcattctttataggatcattttttagatggatggtctctgtgggcctccattcttttgttttctggggttcaaaggtcacatcaaaaacctcccggcctgctgcctgatgtgacctttgaactccaaagggcacaagatcatgaggccataaaataaggcacaaacactaaaggtgtcattctgattgtcctcaaaggacaggagtttaaggcttggccacatgattcagggtagaggaaatactgagagagcaaaatgcagggagcatcaaacaatgaaatctcaaaccatagccaggaaggatgtaaaatcgcctctggggctggacactgggctaattgctaacaatgtcagccacatgtttctacagcgatttctggtaagacagccccagaaagctcaaacatgctgactgccaggttattttttttcattgcatcaccatcagtgggtccctgtttctgtacactgcctgccctggcccgcgtaag

SEQ ID NO: 89917 - DNA, 1020 bp, Homo sapiens
tctcctttgactccatgtctcacctccaggtcacgctgatgcaagaggtgggctaatctttctagtaaattccatatttaattcaagaaaccataacttaaggcatgtaaaagagatcctttgctcaatgtgatgccattgtgcttatccaaagtatattattattacccacaaagggtgagagattaggctgcagccataccccaagtggagtgagcagcaagacctgccccctgctcagagtgtagatgactgggggcacctgcattcctaggggctctgccgtatgagctcctgtcgatgcggcaaaggaccaccttgcccaacgacagcgggaaggcagaatttaaagctggcagctgtaagcgaacgtctatgtgtgcgcacgggggcacgtgaaggcacaggtgcatcagccaagaacctccaattcacctcttaaccttctcacctcacctgaaaccccttctgccagaatcctgaaggtggcccaggaacagggctcctaacgttaggtggaaatgggaaattcattgagatgtcacaagctggaataagaaaattctgagctcacccggaaactaatgccctaaattaagattattcagcttctcaatttttaatagcaaaatggagacctgagtgtggataacttttagtatctgtgggggatcctggaaccaattccctgccaatatagaaggacaactgtctacagtacttgaagtattattaactacattcgccatgctgtatgttagatccccagaacatatttatcctgcatatctaaaattttgatcattttacaaactttctattttttttgtcaattttctccagctagacacttgtgcaatacggctattatctgatctttgccttaaatgttgtgcttcttttccatatgcacgtattttgcaaaatataaagtgtgtagagctatatagcactcagccaagtggtgggtacctgcaggtgcttcagagaagtaaattgatgctgctaatatttgttgaa

SEQ ID NO: 89918 - DNA, 1958 bp, Homo sapiens
agaaactcttgcagaatattggtttttctcacatattagaacatttggagttccaattaattacaaaaataaaatcgaattccttatctgctcagtcttttttccttcagatagccccaattttctgatttctacccacctataactatgtctgatttaaaacctgctttccagagaaaaggcctagtgggtagggtaagaggttttcatctcctgaaatctctgttttaactttctgtaagctgaggattctcaggaaaggaagatgctgtagaatttggttcaaagggctcaccactcggatgaaaagaaaccccaagccagagcgctgacctgggcagctggaggagggggcatggcagacgagcagaccctgtgcttctcatgcgtctttgcctcttgtctatcttccaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggattaaaagatccccggtggttccatgaagaatttgtaaagatcactttctctttcctccaagccctgaaactttgttcttcaaaagagcgtttctttttttttttttttttagccagtttataaagtggaagtattaggagattcataaatcttctatattgagaattggctatgttaataaatattacaacatcattaaggttttagctaagtttgattcatgctgtctgtt

SEQ ID NO: 89919 - DNA, 1747 bp, Homo sapiens
ccagttccactcttgcccctgcaaacagctatctatcccttggccaccattcaggtcaagacttgatccactgatggcacaacctccctcaggaggatggatctgaaaaaatgcctgcacagaccctgggagtgggtgtggagcttgggggacagggaatcctggggcgctgggagcctggtctggcacgtgggatgtggactcctggggtggcatgtctccttggtggtagagactgcataccccgtggggtggggtgcagtgggaggagggccagaacaggccctgggaagcagaggccccttgtcaaggttcaagggcagtactgggttctcagcacgagtgctttccgaagaaggcttggaggcagaaaggagaactgcagctatttggaaactggcccactcgccactcccgaaatcggcggcttttcacttttctgcagccccttctccttccacaggagcagcacgctactgtcagtcatgttggtctcgtgcaggggttcttgtgagggattgtatcaaaatctgcagccgaggtggggagaggaggtgtgtgtagtttctaaaatgcttctctgcaggctctcatcggccatcctaggggagcgatcctccaccccatccccttggagagggcttaagttcctttacctgcctgcagagaaatgctaggaaaatcatttctgccatgggatctctttaaattttaaagtcaggaattatgctctgaggacctcttcagaagaaattactttctagctagatttcatgcgagcactttaattttgtcacagtggcatccagcagctggagggtctgtcagccatggaggtggaagtcaggtgcagctgcagcggccgtcaccacagaaacagcccagcatgcccagggtgcaaaacctcaagttcaaccgcagaagaggtatgagtctaacatcaggtacaaataagaatttctctttatcgatgcagacaccaatagacacaagctgcctgggaggaaaggtgctgggaaaagccagtgtggaaggagctattttcttggcttcctttcaatagctgttaaaccatagattttacaccctccttccccactggatccttccctgcaacagggctattgttaaaagacacagagttgagtacaaacagtctgcaaattgtgttaagaatttggttctggaatatgtcacataacacaaattatatatgctggaaatgtatttacgaacctaacataattatgcctatgaaatgtatgttctgtacaggataacgaataactggtctaccaagaatttctataggaagctagagtattgtttttcatcccttaacacagtgaacgtaattataaaagaagtaacaggatttatcatctattaaagaagtgaagtacacgtttcatacctcacctcttctgttgctggtggctggcagcaggcatggcattgttgcaagggtcctctttagtaacaggagtcacaaccgctcccaagtcttcctctgtacagaggcaacagaagactctataaagggaagttatcgagatgagtacatagaaacagcaccctttaacatcaggcagagtgagagaaagtagctgggacctatttaactccatgacctttctgctagatcacacattgtttgatgaaaattatacaggtatgaatatatacacacacacacacacacacacacatatatacacacacacatatatatatatatctttttttt

SEQ ID NO: 89920 - DNA, 1054 bp, Homo sapiens
tccttcctttttttaggtttgaaggaggaaatgtcattttattacaggttgagtaccccttatcctgaatgcttgggaccagaggtgttttggacagattttttttaggttttggaatatacttacttacagattgagcattccaaatctgaaaatctaaaattcaaaatgctccaatgagcattttctttgagtgtcatgtcagtgctcaaaaagtttcaggttttggagcattttggattttggattttcacatttgggatgctaaacttgtaccagcagtcaaactgtggaatgccaaggtttcattctcatgccccatggaatccgatacaatctcactcataaggaattagggccattgcagcatgattaggaacctggttaaatcccacgatgaagttcagaattaaacttagtaaaaaaggagatgtgagttggtttgagccttggaattgaatttttttttttttaaaacaccaactcaaaccagatggaattgaacttctttatggaatctttgcacttccactttgagttggtaaagattattcagcataagctgacatgattggctgtgctaggaatgtgtacaatctgggtggttggaaatctaatggcctggagatataattctcttatattttacagacatgctaggtgataaaatcagagcaggtatagttcccgtcctctagaaactgacaattgaaactaacaccagtactaatcacatggtggacactgcagaacgcttcactcctctgctctactcctttcaagaatccctgtagcaaggtgtcattttacaggtggggaaactcaggctcaggaagacctggccccaggtcacattgctagtaagtggcagagctgaattcagagtcagagctgcttaacccacagcctgaattcctcctcagggcacctttgcctcttaggaggaggagggcagaaggagactgatcgcaagctggtttctaaccggctggtttgagaatggggaagaggtcatgtgcatagcaccaggcaccacagtaaccaccgtctcaca

SEQ ID NO: 89921 - DNA, 1032 bp, Homo sapiens
cagcctccaaagtgctaggattacaggtgtgagccactgggcctggccttctccataccatttgctcccctgccatcttcacttccattgccactctgctccacacctcaatcctcacctgtggccactctgtccagcttggtctccttgcctggcccctattacgtcctatgacccacaccctgtttgctcagtattctctgccacagcagctgctcacctccctgactgtcatggctcttgatgcctctgctggcctatgaagggccaagccctcagtgcattcgggctgggaccccagccttttctcctagtcctcgccataccctgtgctatggccaagtgaaggtcttgctcctggttctcatgtgctcttccaccttcttgctgtctctgcacattcagcctatctcagtcctcttattgtaagttcagacacctcctcgatggaaagcattccttcatcttcttagcctgaaaccctctctcacttttatcagggaaacttctgctcacctcttgttaccgcattataaacagatttactagatacatctatttgccctcaaaatcctaggtgagaaaggaacatctctgggtatcagaattggaggggaggggctagagagaatctcaaagtcagagctgttaggttaggaatgggggctccagggagaattgagcccagccagtgcccagccagataaaggcaccaaggggccccttaaaaaaaaaagtttcattaaagtataacatttatacagaaaaaggcatacatcataagcatgcaactccatgagttttcacagtgaacacatcatgtgcccagctcctagaatgcccatgcagccataggaaggtggagctagaaccagacccctccatgaagcagggccgcagaggcccggcacttctgtgaaaagtaatccagaaaattggctctctagcccagagaagcacaaggaagcctgccatcttcccagggctctggggaatgcctactccctggctgtgaatttatacaactgcagg

SEQ ID NO: 89922 - DNA, 1038 bp, Homo sapiens
tggtacctgcgactgccagtcctgagccccctagtgtaatctggatggtttttgtttaatacggatggccagcttaggattcagttttctcaggtctgctaaaacattaagtatttattcatctgctgccactttaaaaattccatggtggttccctttttcttttttcccattcttttaggtttgtgcttaaaaacaaaaaataccaccgtcatgaacaaaacctctaccatcatttcagtgtggtttttgggagagagtgaaactataccctagtgttcaagccccatctttacccagaggtcattactctgtatttgaagaccaatcaaaagggagtgggcataaacaaaagggaagaaatgatccgttattagctattaggaaggaaaaaatagcaaggagaatgatgaattctctgtaaatgggaaaaaagcagtatgtaactctgaaaggttataagtgaaatttaactgggttatgggaatgggtagatacctattattctctggctatgtctgttaaaaaagaatttccttcgtgcattcaggttcacgcacaaatttgaattcataattcagtgcctctaacaaatccgtgacattggtgacaggaacacctgggtgagtggtgagaactccataggcgctctctgacccctgcttgccttcttttttttgtttgagacagagtcttgctttgttgcccaggctggagtgcagtggtgtgatctcggctcactacaacctctgcctcctgggttcaagtgattctcctgcctcagcctccctagtagctgggattataggcatacaccaccacaccaggctaatttttgtatttttagtagaaatggggttttgccacattggccaggctagtcttggactcctgacctcaagcctgcctcggcctctcaaaggctgggattacaggtgtgtgcctcggcctctcaaagtgctgggattacaggtgtgagccaccatgcctggcctgacccctgctttctgtcacctttttctcttgtgagatgcaccc

SEQ ID NO: 89923 - DNA, 3913 bp, Homo sapiens
actaccggagctaaatgcctaggcaggacaatggcagggggagcctgtcagcatttactatacattgctactgttccacacacatgaggacactagagtggatacatgaccctcaggctttggggggtatgaaataagacctgttttcccctaactaaatcttatgcagaaccccgctgtgtaaagcagatgcaagctgagagactagagctctcccactcatctcctgttacctctcggcgtctccgaggacgcaagggctccagagcctggagcttgaaaacaggtgtgctaggtgattgctacctccatttcacttcttcattaaacaaatctatgagtcttctccagttctctcaatccatttttactgggacgagagttgtcagttttaacttctgtgttaactttaatttatgtgtggtatagaaggatgttttgagagagaaactgatgcgcttaagtcatcatctaacattgtttgggtaactattccaggtgtgcttacacttaccagtttgacattggttatttgtcttatgattgtgtctgtcatcgaaggcataactgattgattacaacaggaaagaagggtagataacaggagagtttaaagataagtgtcattagtaatatactctgtgtgtagatcaatgatgttctggagcattcatgattaccgtatgccttacgggactaagtggacctcatttgcttcagagctagacaaaacgggccactgagaaaaatactgagctgtgtctagtcacagcttggggctggcttttgtttttgtttttttttttattttccttcatcaaacagcatggtgcttgagatatgctgtaaagggagacagatcttttatgcttcattaaataactgagttttaagaatatgtttatttctttttgaaagaaattattctttacacaaatgtgtatgggttaagggtaggtgtgtatcctctactctgttgaattgataggaggaaggactggtacagggtgaaggagctgcttctgtcttgttgcgatccaagttgtaaatgttaatgaagtcttgtttgacctcaggatatcccagaagctcctgagagactgatgacagacaccattaatgaaccaatcttgctgtgtcgatttcctgtggagatcaagtccttctacatgcagcgatgtcctgaggattcccgtcttactgaatctgtcagtttctgtttcaaagagtattaataattttgctttttaagggggtggggactgtcatctggaatcaggtacagctcatgccaaatatttcattctctatctagaataacaatatttaaagacgttgggttttttcaccctcccctgattgaagttgacatgctttgttaaattagagaaatgtaaacatttgaatattacatgatcatagtggctcctttagcccttggagcttaattgtaattttcatttaaactctagggcagtgctgtgtctgatcgcttgatagtaattgtgtatcttctttcacttatatttaaaggtcgacgtgttgatgcccaatgttggtgagattgtgggaggctcaatgcgtatctttgatagtgaagaaatactggcaggttataaaagggaagggattgaccccactccctattactggtatacggatcaggtaaaaccaattttttaagtactcaacatttttttccactgtaatcgttctgtatatattgaaatttttaaaaggggagaattcagggtagtactttggtatttgaatgagctatattcagtttgcaggttataatgtggtgtgtgaatattgccagctttgttttggccaagttatatgttaatttcatttgaaaacctgtttaacggccggcttgttgattgcaactgagttttaaaaaattgatcctaccagtatctagtacccttcttcattttcctcttataaatagacattgacttattttaaaagtttttaaaaatctcttctttccagggtagtacttattccctggttgattttttcataccaaattatttctttatgcatggttcatgaaggcatagagattaagtgctgggattacaggcacgagccactgaatctggccatagttgaattcttaaccacagtgagctaactcctttcatggtggaaaattttaactgtcttagatgaaagttttaacttaagtatttactcctctttctttctttctttttttaaacagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtaccttgaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactctttgctggcttaattttcttaaagctaaacatctctttgtcacattcgttcatgcttttgcaattattttatcttttttatgatgtatatatgtgaaattaagtactactaaatttagtagatattgctaacgttatatggtaatgagaacgaatgattttttaacgttagatatgtgggtcatggttaaatcttttttgtaatcttttttgtgttactgttggacacattagattttatcctgttttgcaattaagtgaaatgacaggtcaaaatgaggcatttaggctgggtgcagtggctcacacctgtaatccctccactttgggagaccaaggcgggcagatcatctgaagtcaggagttcaagaccagcctgagcaacatggtaaaaccccatctctacaaaaataaaaaagttagccaggcatgatggcaggtgcctgtaatcccagctacccaggaggctgaggcaagagaattgcttgaaccccggaggcagaggttgcagtgagccaagattgcaccattgcactccagcctgggctat

SEQ ID NO: 89924 - DNA, 2966 bp, Homo sapiens
ccagcactttgggaggccgaggcgggcggatcacgaggtcaggagatcgagaccagttttgccaacatggtgaaaccccgtctctactaaatatacaaaaattagccagacgtggtggtgggcgcctgtaatcccagctgctcgggaggctgaggtaggagaatcgcttgaacccaggaggcggaggttgctgtgagccaagattgcgtcactgcactccagcctgggcgacagagtgagactccgtctcaaaaaaaaaaaaaaaagatatttgtgtgtatgtgagtgtgtatttatccagaaagaacattggtaaaaatatcaatataaaactaaactaaagctgagaattaggaggttcttaaaaatctcagcttaccaaaactttgacataaattaaaatcctcaatactgttaattttttatttccttttccctctttctctggaccccacttttaaaaaatgcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagtaagtatgcattcgtcagcttttgcaaagaatatgttttttgccgttttgaaacttgaatagtggtgctcacgatagcattgatttattccttctttgcatttgaacaggttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtatgaagttgtctttttgttttatttctttctaggtaatatctttagagaagaaatcttagtgtaggtaaattatgtttatgttttaaaaaaaaccaactgatatattaagtggttaatggaagaacatataacaaagttttgccaccttagatcgtagctaagttctcttttttcactttgacttgatcttttatatataaaggagcaaacaagaaattgctactcagtggagaagaggggagtccacagctaatttgcaaagttgggaattggtagcattgttggcattttatggacagcttcccaatgttaaaagccttgctggataaaaaaccagtgcaggagaaaagcagtgctgagctattgtctcgttcttcaggtacactcacgtggaagctgagtgtcctttcctgacttttgacgacctcctgaaccggttggaggacttggtttgtgatgtggtagatcgaatattgaagtcacctgcagggagcatagtgcatgagctcaacccggtaggtgcagtgtttatggaaagaaaaagtcacagtccttttttggaagacaatgaagtcttcaccctcagtttttgtagatttgatggcttggtgagctgaaataagtgactaattattttgaagactagaatttgatgttagtcactgtcaataattttataatgttttcagttatataacaggctcatgttttccattttaggaatgtctacatagttttctagtctgaagttatatatatatatatatatatatatattttttttttgagacagagtctcactctgtcgccaggctgaagtacagtggcgcgatctctgctcactgcaacctctgcctcccagcttcaagcgattctgcctcagcctcctgagtagctgggactacaggagcccaccaccacccccagctaattgttgtatttttagtagagatggggttttaccgtgttggccaggctggtcccaaactcctgacctcaagtgatctgcccacctcagcctcccaaaatgctgggattacaggcatgagccaccacacctcactgaagtaatactttataatagttttttaatggaaattttagtgttaatgtttatatttatgtatatatacacattatatttttcctttcttctgtagaactttcagccccccaaacggcctttcaaacggatgaactattcagatgctatcgtttggctaaaagaacatgatgtaaagaaagaagatggaactttctatgaatttggagaagtatgtatccctttctctcattgtttccaaggtgggattgggctccaattctcttcttctggttaatgaactagtaacatgggtggcatctgcctgtcctcaaataaatggtaacagcaggacctgcttcttgggttgcctgcagattcgctgagttaacagagtcagccttaggacagtgcctgttctgtaccacccagtaagcgtaagtgagtttctttttttttcttttttttttttttttttgagacggagtctcgctctgtcgcctacggagtgcagtggcatgatctcagatctcggctcactgcaacctccgcctcctggattcaagcgattctcctgcctcagcctcccgagtagctgggactacaggcgcacaccaccatgcccagctaatttttttatttttagtagagacagggtttcaccatgttggccaggatggtctcgatctcttgacctcgtgatctgcccacctcagcctcccaaagtgctgggattataggcgtgagccaccgcttctggccaagtgtgagtttctaagctgccttcatgtctcatgctttgcctcttccctcttccttcattgttcttccttggccacagcttataagctctctttatcattctctaggctggtaggagtgctttagaaggttgtgaagcctttgaaatcacatgcaa

SEQ ID NO: 89925 - DNA, 1019 bp, Homo sapiens
gaaagggagtttttaaggagaattggctcacaagatcacaagatgaagtcccacgataggccatctgcaagctgtggagcaaggaagccagtagtggctgagtccaagttcaaaagcctcaaaagtagggaagccgacagggcagccttcagtctgtggccaaaggcccaggagcccctgtcaaagaactggtgtaagtccaagagtccaaaagctgaggaacttggagtctgatgttcaatgacaggaagcatccagcaccggaggaagatgaaggctggaagacctagcaagtctgctcttccaccttcttcctcttgctttttctagccaggctggtagctgattgggtggtgcccacccacattgagggtgggtctgcctctcccagaccactgacttaaatgttaatcttctctggcaacacccagatacacccagaaaatactttgtatccttcattccaatcaggttgactcttaatattaaccatcacagcatataaatacaataaatgtgaagtacatgtcaaattcactatgccttttccagtgaaatatgtacattgtacaactcaggtgataaaaagaatacaatgatttccagccttacggaattcctgaatcatcctcatgggctataatatagccactgtgctgtagatatatgaattacttttcagccagatggaaataaaaacttaacaacccacctaaatatgttcagagaatttcttattagaatttgagcctgtttttattgtttttttttttttttttttttgagacggagtttcgctcttgttgcgcaggctggaatgcagtggtgcgatctccactcaccacaacctctgcctcccaggttcaagcgattctcctgagtagctgggactataggcgtgcgccaccatgcctggctaatattttgtatttttagtagagatggggtttcaccttgttggccaggatggtcttgatttcctgacctcgttatccacccgcctcagtgagccaccgtgc

SEQ ID NO: 89926 - DNA, 1036 bp, Homo sapiens
caaatctttcattgaaaagtgggacaggccaggtgcggtggctcacgcctataatcccagtacttcgggaggccaaggcgggtggatcgcctgaggtcaggagttcaagaccagcctggccaacatggtgaaacctcttctctaataaaaatacaaaaattagctgggtgtggttgtgagcacctgtaatcccagctactctagaggctgaggcaggagaagcacttgaacctgggaggcagaggttgcagtgagccgagatcatgccattgcactctagcctgggcgacaaaagtgaaactccatctgaaaaaaaagcgacggtggaggggacaaaaatacaaatgaaatgttttaagcggatttcagtaattggacctttaggacataaataagaaaaagtgattttgttcaagaacatttatgtatcaccgagtgcacagtactaccccaggcattgcaggggactcaagggtagataaggcataatcccttaactcatgttgccttctgtcctgctttcccctggttgtgtggatcttggggatcatgtaggatttgaaagtccaatacattgaaaataaaatattttacaaatactgagtagtggtattaccagtgggtacttcaggggcagggagccatgtgggaggtctgaacttgaatgtttaaccttggagtttcctttagataagattaagtcatggctgggtgcagtggctcacacctgtaatatcagcgctttgggaggctgaggtaggaggattgcttgagcccaggagcttgagaccagtctgggcaactcagtgagacccttgtcactacaaaataattagccaggtgtggtggcatgtgcctgtagtcccagctatctgggagggtaaggtgagaggtttgcttgagcccaggaggtagaggctgcagcgagctgtgattgtgccactgcactctagcctgggtgacgaagtgagaccctatctttaaaattatatatatatataaaatttaatgccttgagaacagtctgcctaaatta

SEQ ID NO: 89927 - DNA, 1016 bp, Homo sapiens
gatggagctggggttttttggccacatgcaacagccccttcctctactcatctcctctctccttcatcccccaaacaaaagctagccttttaagtaccatgttctggaaggtattgaagaactgtggggtcatggaaaaggcttcatgtggactgggattgttgctgttgtgggaagcaagtgctccacttatgacaaaggaattcatttattaattaattttatctagcaatatctgaaattcttctgggtgtttctcattatcagttttacattaagaaagaagacttggatttttttttgttttgttttaaaccatgccaatacagtgaaatgcgtttggttctgagctgcagtagaggggctgtctccagttttgcaccatttgtgatttttaacacttactaccgtctgcctaatattagtgaaaaagttggtgtgtataaatgacattattgaacaaatgttgtttatttcaatttgacaggtgaagattggtgcgttagaaggatatagaggccaaagagtaaaggtgtttggctgggtccacaggctgcgcaggcaaggtaaatggcaaagcttttccttctttttaatgtttaaatatccctgctcttagatgaagaaaaacatacaaagatttgcaggggtttttttctctccccctttttttcttagacacagtctcactttgttgcccaggctggagtgcagtggtgctatctcggctcactgcaacctccgcctctcaggttcaagcaattctcctgcctcagcctcctgagtagctgttatcacaggtacctgccaccacacctggctgatttttgtaattttagtagagacggtgtttcaccatgttggcccgtctgctctggaactcctggcctcaggtgatccactgtcttggcctcccaaagtgctgggattacaggtatgagccgctgcgcccggccctctttttttttttggtatgctggctagacttgaactccccccagccatcctcctgcctc

SEQ ID NO: 89928 - DNA, 1946 bp, Homo sapiens
acacagcaatgcttgatatgtcccattggggaaaagaggtattctacatgggggagtttttcagattaaatgagtttagctttttgtgctcttttttttttttttttttttttttttttgagacagagtctctctctgtcgcccaggctggagtgcagtggtgccatctcagctcactgcaagctctacaggcgcccgccaccacacccggctaattttttgtatttttagtagagacagggtttcactgtgttagccaggatggtctcgatctcctgacctggtgatcctccctcctcggccccccagaatgctgggattacaggcctgagccactgcacccggccgctttttgtgttcttaaccattgttttgttgaaagtttcaaaaatgtctgacacttctctgatttctcacagagaactaaccttttagatgtcacttgcagttgagttttgctgtcaggtgtctcttctgttgtccttgtacctgtgctggttgctacagccacttaagatctgttgcttatagtctgcttttcctggggaactgtatcgtgtatacccgaacttgctgtaattgtttgtgagaggacctcagagcttcagctttaaccagtgtgcttctttttttttttttttttctcttgagacagagtctcgctctgttgcccaggctggagtgcagtggcacgatcttggctcactgcaagctccgcctcccaggttcacgccattctcctgcctcagcctcccgagtagctgggactacaggtgcctgccaccacacctggctaatttttttgtatttttagtagagacggggtttcaccatgttagccaggatggtctcgatctcctgacctcacccacctcggccttccaaagtgctgggattacaggcgtgagccaccgcgcccagccaaccagtgtgcttcttaaatgttcaaccagtcactgtgccaatatcagcttttggctgttggggtctttatgcttagattgttccagttgccttatacttgagatgttattttgattttaagtattgtacaatgttcaagaactgtcttttctctcctccctacccaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggtgagtcctgaccttgccatcgtgaacgttgttaaagttagaactctggcaaccatgttaacaaactgcttcatcattaaaattaggcagaagatagtttacgaagagaaaagaacctggaagaagcaaagaagattaccattaaaaatgatccaagtctcccagagccaaaatgtgtaagtttgtttatcttttcaaataccgtggacttggctacatcagatcattatttctgtgtatgaggggcatgtcacatggtttgttcctttacattttgtttttactttccatttatttatttatttatttatttttgagacggagtcttgctctgtcgcccaggctggagtgcagtggttcaatctcagctcactgcaagctccgcctcccgggttcacgccattctcctgcctcagcctcccgagtagctgggactacaggcgcccgccaccacgcccggctaatgttttgtatttttggtagagacggggtttcaccgtgttagccaggatggtcttgatctcccgatctcgtgatctgcccacctcgacctcccaaagtgctgggattacaggcgtgagccactgcgcccggcctactttccttttattttttatttcttaattttaaattttaatttatttattttgagacagggtcttgctctgttgctcaggctggagtgcagtggtgca

SEQ ID NO: 89929 - DNA, 2081 bp, Homo sapiens
tcgcagctggcgcggtgtttgctggtgacatgaactcaaccagcctccaccatctggggatcggggcgacatccttggtctggtttgcaagaggacccgcacgcctccagctggggcggaattggaagattcagaaaggaaagttggggaggcggggaaggaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcaggcgccctcagatctacgctctctgatgcaacgccggaatcgcggaaaccgccggtgcacgttggagtcataagacggcgtcggtgttgcagtctgtgtccttggaggtgaccagggccactgcaggcatggtgctaggtgggtgagactcagtgtatggcgcggtgttccctgcctggggcaggaactctgctccagtcgggtttcggcgctttccttagtgcctaccagagtgggcgccccgcgaatgtttggggaccgattgcagggagggagggagggagggtgctggcctttgctgggcccgggacttgaagggccaggccgggcttccccgagtccgtcgttcccccgggctgcgatggcggtggctccgggcccttcccctgccccgctgcgaaacctcccgattgcgctgagactcaggcgctgggacgggttcagacacagggtagcccctactcctgcagttcttcaaagtgatcgtcaggaaggggctttaggattctagttgtttttctcccaccctcatttttttattgaggtttccggggagaccatactgtgcagtaggaaaaaaaaaaaaaaaaagagagagacctggatggatgttaactgttcagacctactagttgtgaggccttctgaaattttctaacctcagagcttctgtttcctttaaagtccagagggagctggtgtttatttgccatctctacaaaaactggcactgggatatctgatttgtatgtgttattttatttcatcctcagcacagcctttcaagatggggattgtttttcctattttataggtaaagaaataagctcagaaaggttaagtaaattctccagagtcaccctgccttttaaggtacaaaatccaacattccagcgtatgtctgatcaacttcaaagcccatattttatttttgggtgcccaattagatagaataaatatcacaaattaaaatgatcagagttcattttgaaaacctggattattaactaatgtttttatgagatggatgttattgaaatggagtggggaaataactaggatattaattacttatggacctcaatttttattaatcgatgcttgttctgtttacaaagataaggaatgaataaagtagtaaggtgactaatagttaatggccagaccataacttaccctcattttgtcaaacagcagagctgtacgtctctgaccgagagggaagcgatgccacgggagatggaaccaaggagaaaccatttaaaacaggtctaaaggtagagtctcttctcattaggaaaatgagactgcatttattaatgagttatgtcaattttcttgtgacttgccaagaacttaatttcaaacactaggttccaaagagaattttcagaaaagggaaagtaaggaatgcatacagatatgtgactttaagattgttagatgatcaaagtctaaacttactttttaacattttgaaaaaaggtctcttctttcttaccacatggcattgcttcttggaatttttctctccattgagtcagattgctgggttttcaattcttgtaaagataaaagttacctttcctcagttacagtgagctcatgaccagggggctcctgagagggcttttggtgaatttaccacaatccagagtgtgatcctgagatttgactccaagaccaccaagaatggattcatttgtcagagctgac

SEQ ID NO: 89930 - DNA, 1040 bp, Homo sapiens
ggggtctcgctctgtcatgcaggctggaatgcagtggtgcgatctcagctctctgcaacctctgcctcctgggttcaagtgattctcctgcctcagcctcctgagtagctgggattacaggcatggccaccaggcttggctaatttttgtatttttagtagagacagggtttcaccatgttggccaggctgatcttgaactcctgacctcaagtgatctgcccaccttagcctcccaaagtgttgggattacaggtgtgagccactgcgcctgactttttttttttaaatgtaaaatatacataacattgaccatcttgatcctttttcagtgcacagttcagtggcattaggtacattcacattgttgtgcaaccatcaccaccatccaccttcagaactttttatcatctcaaatagaaactatgcccatgaaagagtaactacccccttcttcctatttcctggtccctgtaacctctattctgctttctccatgaatttgactattctacagtacctcaggttaagtggaatcatgcaatatttgcccttttatgactagcttatttcactagtgtaatgtccttaaggttcatctatgttgtagcacaagtcagaatttccttccttttttagggctgaataatattccattgtatgcacataccacattttgtttacccattcatctgtgatagatatttgggtagttttcacctctggctactgtaattttttcaattaaaaaaattttttttaagacaaggtctcactctgttgcccaggctggagtgcagtggtgtgatcatagcttactgcagctttgaactcctgggctcaagccatcctcccgcttcagcctcccaaatgtctgggactacagacactcaccaccacacccagctaataaaagaaaaaaaaaatgtgtgtgtgtgtgtctgtgtgtctcgatatgtcgcccaggctgaactccagggctcaagctagcctcctgccttggcctcctagtgttgagatgacaggtgtgagtcaccatgc

SEQ ID NO: 89931 - DNA, 1083 bp, Homo sapiens
gacttcacatttcattggtatttgtttttcatgggcagtttcatgctgtcacgttgcccttcagagaatcagggaatgccttcgtagaatattaacgacaaattgttgaatttgcacagcttgttttgtctccctgaattagtatgtgtaagaaaaaccaatggaagattttagcaggctctgaaagtagaatgcccgctgaagcaaacggcagggttgttcttccaaggcgtattaaatatgggtacacttagtttgcagacttggtgtgctgcagaatatcacatatgaagatattttgaccgctatttagaagagtgacctcataaatcttttagcaaagtagacacacatacctaccacatttcttaaaagtagattcgtattttgatttgagattgttgaaaagcatggtatgtttggagtgcacttagttatgtcccatctcataaagactgttgagctctctgcactgctgatgatgaagcattgcatgaacccagaaaacggggatgccaaagcacagggcttaggtgctgttccttgcgtcatcagcagaggtctgtccactttgtagaaggtaaggggttgagatgtgggctttgcttgtgtgaatgtatgtgctgtttaattttttctgtgtgtttcgggcggaggtttctctggtgagttataattcatatttaccctgatttaagtcatgtcactttaggtagccagattcaaaaccatcagatgaaggacttttggtgttagagggattagcagtttaacaaaacttctgattcatggcccaagatcagatttggtttggaatcagaacactttggactagtttctgcatctggcttgagtccttgtggatttcttgttttatttctttatttttggcaatctgtagtgcattttggcatagtttacttatgaatgttaccgctaactttctgaaatcttttattccattttagaaaggtatcatttattgaaaagatttttctactgaacaaaatactgggattgaatggcagcttcttatcacattagatatgacattaagtaatttcgttagtagttaaaatgaag

SEQ ID NO: 89932 - DNA, 1016 bp, Homo sapiens
cagatgactgtagtttctttaccattacagaatgcaattcaaatgaaaaccattgcatggtactcaggcatttcttcaatgcagtgtgtgcccacatcaccaggaagcttacttgggaaagtttgttttgggattctggagtacctcaatatatctggtatattttcccaagaaaagtgaataatcttggggggccgaggtggacagattgcttgagcccaggagtttgacaccagcctgggcaatgtggtgaaaccccacctctacaaaaaatacaaaaacttagttgcgtgttgtggcacgcacctgtggtcctggctgctggggaggctgaggtgggaggatggcttgagcctgggaggttgaggctgcagtgagccatgatcatgccactgcactccagcctgggtgacagagcaagacactgtctcagaaaacaaaggcaaacaaacaaagatcaccccaaagaagaactcccaacatattaaaagtcattgagttttgtacccttcaaatggatgaattgtgttgtgtatgaattacatctgaataaaactgtttaaaaatattaagaatgattgagtgtgacattattgcagcagtacattggagtttctgctaaattacttttgcattcatttcaaaaggaagcaactatgcccattgctaatttaataacctgtttgcttgtgcggtgtttaaaatggcatcatgaaaacatggcaatgtgtgatagattaagagccaattaaattttttattttgagttacaagatctgcattaaacagattttattgttgcccttgaatttccagtcttagatgagtagcagcagtgaaaaaaagagatcctaacttaagagttttcaagctttttgatgttgcaggtatttgaataagtgggtctgtcttactgaaatatttgttaattagcgataaagcaaactatatgttgatcttttggtagtccatgctaaggaggattagaataatatataaataatataatggtaata

SEQ ID NO: 89933 - DNA, 1108 bp, Homo sapiens
gtgacttcttggcaggcagacatctaccaagagattttgtattctttttatacctcctattcaccaaaagaaaagggccattcaaaagtgagtttttctttttttttttttttaagtttaaaaagctatgatgtggccacccatggtggctcatgcctataatcctagcactttgggaggccagggcaggcagatcacttcaggccaggagttcaagaccagcctgaccaacatggcaaaaccccgtttctactaaaaatacaaaaattagctgggcgtcgtggcgtgcccctgtaatcccagctacttgggaggctgaagcaggagaatcgcttgaacctgggagatggaggttgtggtgagctgagattgcaactctgcactccaccctgggtgacagagtgagactttgtctcaaaaaaaagctgtgatgtgaaacctgttctgtgaaggtggaacttggaaaggcttgtaaggatggtggtcccatgaagaggatgaacaaaccaagggaactgtcctcttgctggtttgggtgatgtcccatcacctgtcactttgtttgtttgggctgcagtggaccaatggtttcccaggcacactgaagtgacatgtagatggattgcttgagtggctccggcatgtttccatctcctgtctaccaggcagagaccgtgttccctgttttgaggggatccagaagtgcagtgacaagggcctgatttgcatctccagctcctggtcttgcctgtgttaacaattttttttttttctttccagatggagtctcactctgtcgcccaggctggagtgcagtggtgcaatctcggctcactgcaagctctgcctcccgggttcacgccattcgcctgcctcagcctcccaagtagctgggactacaggtgcccaccaccacgcccggctaatttttttgtatttttagtagagacggggtttcaccatgttaggcaggatggtctcgaactcctgaccttgtgatccacctgcctcggcctcccaaagtgctgggattacaggcatgagccaccgtgcccggccaacaatttttacattctaattaatttccagtttccaacctgactcaagg

SEQ ID NO: 89934 - DNA, 1830 bp, Homo sapiens
ggaatgcgctgagtaatgattgcaccaccgcactcgagtctgggcaacagaatgagacctcatttcaaaagaaaaagaaaaagcaagactgaatcatttcactttgtattctcctccttgctctcattccttttgtgcttcatgcattgtgtgtgacaattggatgcagccgtaattattgtcagtaacttggtttttaagcttcagactgtatttcctcctcacttgttaacaccagaagataaatgaatgtggctcttggattgaactacatctacagggagctgaacttcccatgttgacgttgaattctagagtatgcttatgctgattcttgagaaattggtatgtgccgtgcctttggaattgataccttaattttcagtgaatattattggtattattattaaagagaacactttaagccaggagtaagagcttttcctccttttgagaagtgaggtacagaagagtatactgcagctgtgggagtgatgggtggggtggggcagtgttgaagaatatttaataccacgaagatgtcaccagtataatattaaatagaaaaagtaggttataagacagtggatccagtagaatcctattgtggttaagtgtttatatgtagagaaaatgactaggggctaggcacagtggctcacgcctgtaatctgaaccactttgggagatagaggtgggaggatcacttgaacccaggagttcaagaccagcctgggcaacatagtgagactctgtctctataaaacaagaaaaaagaaaaactaactagggatatattccagcatgttagtggaggttatctttgagcaaaggggattataggtaattttttattgtcttgtgttttgcttacatgtgttttctatatttctacaataaacctttttttcttaatataaaagtaagtttaaaagtgagtttaaaaatccctgaaaggcatgtacttcaagcttcaagtgaaagttatagtacttgttcagcacaaatactgatatagtgtttgttcagtggaacacttatttagggtctgccttgtgttttgtgtctaaggattaccaggtcattttcatattaggagctcaccactacgttgggagttggagagatagagcaaggactattttaaggaaaaaatgactggtaaattgtatttctttttccccacttgcagtttgcaaaatagatgtttcatttctctccactgtggacacttaaagtttgaatttccatccttctgtgcactccagttgcgtgaaagtaatttacattgctagtagtggtttgggttctctgaaattttttgtgtgtgctatggaaattgtctcctgtgatcagactcaaatccatttctccttattattgttttcttaggttttgagttagagaccttttcatgaccgtataaggtgttgaataggtttagatatcaaagtgatagctatgcatagctatactcacctgtgagcggtcagctcttcagtgtttctttcaactgacttgtaatatccagccactgttgggtgtgacctaaagtgtatctcttcccaaacagaagggaggagttgacaaacaccatgttacttttaatcagagacttgtccttgtcccccttcccccagccttttaataattctgaattcatgttgcagtcgatatgtgtttaaagtgttggtaggtttcttgtactcacaccatcctcctccactcctctcacccccaaaaagtgacagctgacagttgatggcatcttagaattgtgaggcttgagttggtctgtctcaattcgtgttttatggtggcccataaatt

SEQ ID NO: 89935 - DNA, 1055 bp, Homo sapiens
atggtggctccagactagaggaggcaggaaggaaggtggttatttatagtcagctgtgcataggatcgatttttttcaatcctgaaggacttgcagcaggtagttcaaagaaacctcctttagacgttgactttcccttgcagttgtaaatatgggaacatttaccatcttttgctttaaaatatactgttataattaaggtaaaatgtaaaacttataacttaaaaactttactccctgtgcatatgaactatggcaagcttctcaaattaattactatccctttgggataaattaaaatattttgatttgctagaggtaaggagcccttttgagaattagtttgttttagttgagaatgattagagggctagaatgatatatagctctaaataggaaggtttctgattcttttggctactctccacttttactggttattttccagttctgggaagattctgcatgtatgtagcagcctcccttggctatccatggtattagagctctagggacagagttctcctagttgaactcttcataatatctcattattggtattttcaaagttatatgtgtattttaagatagtctttggatgatgttccaaagaaggctgctttgttgagattgagatagttgttttgcagttgtgatttctctttgtaaaaagaagtctttgtgtcggtcccaggtcttattttttgcttgatcacccagtacgtgggtgcacttgggctgttgggaccatctggtgagtgtgaggtctctgtacttcacctgtggagtctgttgtcctgaaaggtgccggctcaggtggtggtgctttgaggggagcttgtttgctgcaccttccagtctgctagaaaatagatgcttagaggggcatttcggggtggaatctgatcatggagtttggtgagcaaacagggcctcaagttttatgttgtgagaaataaatactgagtttatgttttaattatggcacagattaatacaaaatctggtgaaaaatggagaaaaggagagcttaaaacttagctgtttgttgctgt

SEQ ID NO: 89936 - DNA, 1676 bp, Homo sapiens
ccaaaacatcttgtgcatttcttgctttttagtcatgcacagaccttgtctttactttcaaagacagtttggtactgaaaattgctctggtaaattaacacaatttatttaatccctgctctttccaatctttagcaacgtttttttcattgtcaccatcagatgaccttgctgagcttccaagtggcaattgcttttgttgtattgtttaaaggcaaacaaaaatcaattattattggctctagagtgcctggcgaggtggagctcagttctttgtgcattgcgcactatgctgctggtgtctcagctgccatgcttatggttgcattactttcctgtctagctttggtattcttgcctttaaaaatttctttttccatttgcttttcttagccagtgatgacagtaaaataaggaacgacctatttattgttttaagagatacgctggatggtgcccaggcagatgagcattgccattcaaggtggcttcttggtagactgcatttactcttaatcgggtgcctgtgggtcagtgcatttcttggtcatccttactctgtcaaagctgccttgttagccaggttactagccatactagtctcattaccttacgataacacctcattcaaatggccttaacgaagttgaacacttatcttagtcactatggttggctttgaaccttttctagaagttaagtttattccctgggaaaaaacgtgtttgccaccacacagagtgctgggtgtactgggaacccggcttcaaaggcaactactccagtagggaaggttgaggagggtattgaatgatagctcactgcttaaataagtgtttagagtcccaaggtatatgtaatggcatatgaaatgcctagtgtttaaagaatattcagaaataatcagtcatactctttaatattcatatctcatagagttagcatcaggaaggaaacttggtagattaaataaaatagcagaaattactgctggatttttgtacagtagaaatgtatgcacatttttctcccctagtagtcacttaagttgcatatccatttcctgttacatctcatgacatgttttgggtaaaccgtttttggaagcgtccatttgtgtagaagttaggtggttctgagtttaactttgtacacatttctaggcacaaggaaattaaataactggctgagtgagagtgatctcgttgaatgctgaggcttgtttgggaattgggtttattttggtgaaatgtaaatttagatccactctgtattagtttttttttttttttttttttttaacggagtctctctctttcacccaggctgaagtgcagtggcatgatctcagcttactgccaccatgccaggctaacttttgtatttttagtagagacggggtttcaaccatgttggccaggctggtcttgaacgcctgacctcgtgttccactcaccttggcctcccaaactgctaggattacaagcatgagccatcgcgcccggccaagtccgtttttacactcctataacgacatacatgagactgcgtaatttataaagaaaagaggtttaattggctcacgattctgcaggttgtacaggcttctgcttctggggaggcctcaggaaacttacagtcataagggaaggtgaagaggaagcaagcatgtctta

SEQ ID NO: 89937 - DNA, 1420 bp, Homo sapiens
cctgaagcctctctccttggcttgcagatggccacctggccaccttctcactatatcttgtggggtttttgtgtgtgtgtgtgtgtgtgtgtgtgtgtgtgtgtgtgtttgagacagggtcttcctctgtcacctaggctggaatgcagtggtatgatcatggctcattgcagcctcaacttcctgggctcaagagatcctcccaccccagcctccagagtagctgggactacaggtgtgtgccgcaatgcccagctaagtttcgtaattttggtagagactgggtcttcctatgttgcccagcctggtcttgaattcctgggctcaagtgatcctcccacctcagccccccaacatgctaggattgcaggtgtgagccactgcgcccagcctggtcttgtctttgggcacaaatatccgctagtgtctcattgcgtgtccacatttcctcatcagctctactggattagagcccagcgtaatggcctcattttaacttaatcacttctttaaagtcccagtctccaaatacagtcccattctgaggtagtgaaggttaaggctccaatgtgaattctgggggaacatggttcaacccaatgagaacaatggttatctgttgggagtgaggactgatatgagtggagatgcatcggtaaagatgcgcggaccacagatgtgacgcagcaggtgtgcacagaggtatgggatggggtcagtgtggagggccgtgtgccaggcagcagtgtggacttggtcctctacccagcgtaggggggtcattctgggggctgaaccgagggtgacactgtaaaaccatgcttcaggaaaattcatctctgcgccctggaggatggactgaggagggaagaggctgagggaaatgagtgtgcaagataatgaggcgatcccaagggaagtaaaaggattggaggccttgcaaaagcaaagcgaacccaagcttcagaacggaggcatctgagatgatgtcacagttttgaaccttatttatagaagaaagagggtgaaatggggaattaggtaaatgaaaatataggtcccattgttggtaagatacatggagtgtcattgattcagtatttagtgtgcttttccttattttaaacagctttcatagctcacttccaaactgtatttttgcaaccaactctttttctctctctattaaaaggagaatcttttattttacactaattaacagctgattctcctaagagagttttcaggaacctaaacctcagagttagatggagacaagtgtctttgttaatcatttatgtgaggtcagattgtacaatttgtaacagattttacagctggttcctttattaagggatgggtaggattcctactaattattattttgagttttactttgtttttaaccattgaaacttgg

SEQ ID NO: 89938 - DNA, 1128 bp, Homo sapiens
ggagaaaataagacgagattttcatatttgcttgtagatccataagaaacttgggaagaattcctaagaaactagcagtagtggttccctgcagggtgggggctctggatgtgggtgtggcaggggatgggagagactggcaggttgaggagcagggtgagagggatgtttttatgatgtacattctcatatatttattttgaactatttgaatgtattactcatgtaggaagacaaacctttactttccaaaaatattagggaaaaactttcaagtctctcatttttagcctttttgttgttctgatatttccacacaggacagacggtaacatgcccgatacattttaagtacaaacaaggctgtaagttgccttacttgactttcttcactattttctattcaaaaaagtatttttgaatccaagggaattagaggaataatcttgaaatgattatgttttgggggaaaagtatattattaatatgatagttatctaatgttgtgtaacaaattgcctccaaatttagcatatgaaaacaataagcattcattgtgtcacacattcattctttcttttcagtgaaagttaacctgtttccatctgaatagatttctcactctgtatcctgccagtaatcattttgtactgtttctgtgcctttcaatccaagagtccaacctgatgaggttctgctggtgtaattcttttaaaagcattgtggatgtcctgtgaatctcactggagttcactttttaaacattagacttctgtggagactgctgaaggacaacacccttacttcttagggcctttggtttgccagaattgttctctgagccattgccttggattttttcctgacttcttaacaaaggattttataggtgggaccttcaacactctggaaattgccttagctacattcagccatctccttaggtacattttccatctcccacattgtagcaggcaatggcgttgctaaactttccatcaggaaataacaaagatctccttttccagtttccagtaacattttcctctctacaccatcatccacagtctcctgaaaggccctccaggttctagcttttccagggctcttcaggggttttcgaactct

SEQ ID NO: 89939 - DNA, 1687 bp, Homo sapiens
cttcctgggggtcagggatcccagagtgtctccgctgtgtcagtatgtctcagggtttcctgaggctgcagtcattatgcccgctagggcttgggtgggactgaagcacctgcttccaagttgcctcactcacatacctggcaagttggtgccgttgctggcaggaagcctgcttttcttgccaggtggacttctctgaggggtgcgtgaatgccttcactacagggcagctgacttccctcaggacacatgattcaggagaccaggggaaagctgcagtgtcattttatcacataatcccagaagtaacactctgtcatttctgcaatatcctgtgggttacacgtcagcattattcattgtgagaggtgactacatgagggtgagtccaggaggcaagaattattgggggctatcatggaggtttgataacataattggtaagaaattcagatacacctcagacttgattgtggcataccagtgtgttgtaaaacttgtgagaatggcttgccttagaaagacaagtagtccatccagtgtcttattcttatgttaagttgggattgctattttgttacccttgggcctctatatacaaagcctctcatagtaatagatctaattgggttgaagtttagtattatgtatatgccctctgcttttattagtagattttactttcgtgaaaggaacatataaacttcattattgcatttttgtataaatgcagctggggacatggttttattacccaatgtccattttgtaaatatttagagaactttttttttgcatcataaatcagtataaatagaagcttggtttccattgttgccctggctatgaggaagctgagagtgaaatttgtcgttcaagtgtggcagttatgttactgactggcgtatttatattctcctttatttgatattttgctatgagatgttccagtttacttgtgggaaaaaaagccaggtgttcttgaactcaacaaatatttattgaattccacttgctggccagacagcattccatgtgccccagatatggcactggacagatagataaggtccccactcgcctacagcttccaacctggtcgtaagaaaataccttagcttttgctccataatgtggaagaattggcctcagagaaaacctaattcatatgtaccacgtttctacccattcaagttttatttcataatttttttttttttttttttttttttgagatggagtcttgctctgtcacccaggctggagtacagtggcacaatctcagttcagtgcaacctttgcctcctgggttcaagcgattctcctgcctcagcctcccgagtaggtgggattacaggtgcatgccaccatgcctgactaatcttttgtatttttagtagagatgggctttcaccatattggccagcctggtcttgaactcctgacctcaggtgatccacctgcctcagacttccaaagagctgggattacaggcgtgaaccacgatgcctggccgtatttcataattctatctttccatagaaagaattggctggggcacgtataactaatgtgagttactgatttcagaggaagcttttggaagtggttgataggcactgaatgggatggggtggtgagtggtttaaaataacacttgaacctttggattcaaatggttttaaat

SEQ ID NO: 89940 - DNA, 1124 bp, Homo sapiens
ctcatctgccaccttcctgcctttgtgatttctcctcctgggactcctgcacccccttttttttttttaatttttcttttcttttttttgagatagggtctccatctgttgcccaggctggagtgtggtggcgcgatcatagcttattgcaggcttgacctcctgggctcatatgatcctcttgccacagcctcccagatagctgggaccacaggcacatgccaccccgcctggctaattttttgtatttttttatagagacgggatttctccatgttgcccaggctggtctcgagctcccgggctcaagcgatctgcccgcctcagcctcctacagtgttgggattacagacgtgagccactgcacccagccactcctgcacccttaccttttcgccgccctggccggctggacgactgcacccatttcacccggcattcttgtgcctgactgtgctctggccatttcctgtgtctggaatacccccattctcccatgctcagccccgtggactgtgtttattcgtaatcacacctcagagcccttccccttctccatggactccacccctgctgtgtagatggccccaacatcattttgctgagtggagtgccactgcaaggcatggcatggaggagcctgactgcataggtggcggcaccttgagggccttacagacctggcagttgaaggtatgggctagaagacagatgattccaaattacggctaagaaataggtaggctgtaaggcttgattgccgtgaatgcctctagaaagagcacttaaaaaaaaaaaaaaaaaagaagggatttccctgttcatggcctatgagtttaaaaacaagcaccccatgtcattagccctttgctcaccacagagttgctgacacattagacgatctagatatgtgtctgagattttggatgcctattgattgtgtattcacttagactttggtgcttttctagatgtttcacaagttaagatgttgttaagaggttctcattgttttattcctatgttctttccttccactcccaactcactccgatgtcactcatctgggttcttctgctcctgcctgggctgcttagtatttattgagctacacactgtgcttg

SEQ ID NO: 89941 - DNA, 1085 bp, Homo sapiens
gtttgggttctcatgcacatgacccacatttgtcgaatgtctgctgtgtaccagccagcagctttcttcctttagtgctatttcctgttagagtgggatagtggtatttcagtccacctgatgaccatttaggccaatcacatgttaatgggaattgaatgcatgcattaaacacaacaccagcgggtgctgtccacattaaaaccaggaggtctgcttcattggttcttgactatattgaaagagttggaaatctgacctgggcatttgaggtagactctaaggggtgtaagacggccctttgttttagagacttaggattggtgtgagtgactggcagggactgctttagtgcccagacctttagtagcacagacacaatataggaaaactcttcaaggaaaaccagccccaaataagagagtaggtaatgttctgcttctcttgctttatattctgcttgctttacagaataatctgagatagctaataatcaaagtgcaggtcccccaaaatgaaagtgatcatcatagaaccagaaaagaagggataaaatactgatttcaaggactcctgaagccaatggcagctctgagtttcctggcagccaagacaaagacagaagcatgctgggatgatgcatcctcgggctcggtaaaggaagcacaggacctgcctgctgctgtgggctcagggaagtgagtactattttccctgtctggagtggggaggagcacttgtctgtggtagggtgaggaggaccacttccttgggctatcagtcattaaggccccttaacatcatggccgattctgaaattacctctgaaagttgagatttatgttagactgtagctctcaagccagttcccttagaggccagagtaatgacagtgtaatttacttgccacctgcttgagagagacaattggtggttaagggactttcccaaggtgataaattgttttagcaaacagatccagaggacagctcctttcccctggtctatgtatgccttttgaacgccaagaccttatcctaaactcaagtttcacgaataggattaaaataccctttggggacctt

SEQ ID NO: 89942 - DNA, 1965 bp, Homo sapiens
agatgcatttgtaaacctctttggatggttgttctgcctttgtcagttacttcatagcaaatgtcaactgtaaaccaagagagagaatgagccaggatggagaacttttttttgtttaattgtgtcatgttgggtgctttttggaaagtgggtgaattattcatgatgacatgaatgggggtattattttaaattagtatagaagcaaatggttcacaacccatttattaagaccctaatgttgatgtggctaccaagaagctttaccagcaagggccagtgtgttgccttccttggttggttagtttttctacatccacttaactcctagcctaattttatcttttttttcctctgtttttctttccctgaatgtttatttaagctctgataaatcattttgaattaaggtcgggtatgtatttcctttcttctcatcttcttccccctccatgactgcctgcatttgaatacatttccattgtgtgagaggcagtaatggtacagaggggtggggggtggtgactgcttggtgagctgtggctcacatgtctccagagacacagggcctaggaagactgattaaaaatcaacttttaactactataacggctcactttcctgaaacttgttatgctgtaaccccacctattgaagacataatcagaaccagaaagtgaacaaaattgaccctggaaatatgtggcaaaaattctgtgcaataagtatgataacacttttctttcagtgaattctctctcagggcccactcacagaaccaattttgacatcaaattttcttccttttaaaaatacagttaacccccacccccatctgcaggttctccctctgcagattcaaccaactgcagattgaagatattcagaaatttagaaaaatgaaaaataacaatataacaaaaagtaatgcaaataacgcagtatcacatctatttatgtagcacttgtgttgtattaggtattatatgtaatctagagatgatttaaagtatatgagagggtgtgtgtaggttatatgcaaatcctataccattttatgtcagagacttgaggatctgtgaattttagtatcctcaggtgtcctggaactactccaccatcaatgctgagggacaactgtatataatataaaataaataaaatatgtactgtaaaattgtaatcttgaaagtttgatcctgtggcagctgctattttcaggcagctcagcctttgtttgcatgctcaaaaccagcttgtgatttggtttctaagatcacggctggcttattatctgtgctggcttatcatgacagtggctcggtgttatggacacagtgagcatttggtgtcgatactcccagaatgaactgagtagaatggacaggagactgacctttgtctatttgtctatgtagcagtaatgccactaacttgttgcagtgctctttatcctcaaactatttgctatatatagtaatgcttaaattacatatattatatatattacatatacatattatatatgtggatatattatatattataattatatataatatatataattatatattatatagatggttctgactttgcacagttctgatatgcatgagttgcaattaccatgatttaaataataccagttccccaacaactctagtcaaatctcagttacccccgtgtgttaattgagtaattgcatgaagtacacaagcttgctgctagtgcttcagtatacaactcaccatgtaaataacagatgcatgtcagaatccgtggccaatcacagcacttctttcaaagcccatgggtgattggtcagtgcacatgttccttagttcatgcacagacagcagagtgtgtagttctgtggccttcttggctattggggataaaccagtgtgacattttacaaaaataccaaaaatcgagagggaattggtgaacgaagataaaagt

SEQ ID NO: 89943 - DNA, 1202 bp, Homo sapiens
ctgcttcatggagtctatggtctagttggggaaatatacctttattgaatcaaggcagatgtgattacagattgaacaatggctgtagaaggaaagggatttccaagagagaattagaggggcttctcaaattgagtttgactttctctttggtgggggttgagtcaggaagaacctttttgaagcaggaaaaatctttagctgagacctaaaggaaggggaggagcttgcctgggaaggacactgtggtggctggagggggtttcccaggcagggacactctggcaggttagagtaactgaaataaagtctgtattggagtgcagagactgccagaagaggggctcatagaggccaaagtgggacggccttacggacgagctgataatttgggcattattcaaggtggggtgctatgtcattgaagggttttagcagaggggaggcattatccaagttaaagaacaaaacaaaacaaaacaaaacccactctagttgctgtgtggcagatggattgggattgggggtgtggggttggtggcaagaatagatgcagggggacaagttatgaactgagactgggacctcatgggtcttcctgcccaagaccgagatggctgggggtgggggctgcggctagggacatggggcctcagtgcccacgttttctgtcctctgtcccctgtgagggtatgtgcgctctcataccagccgcagggcactttggctcgcttgtgttgctgggagagatctcctttaatgtttttttgtgtttttaaaatatgaacgtaggccctggcagagacaaggcagaaaccacttttgagtttttagggctgtgcattcttaaacaactctgagtgacccttccatcattacaatttatcaactaaattagaaaacgtgctttcacagatttctagtacttgggcaaatttgttatttacgctcaagatgaagtgttgcttctagtgacagttttgctgttgggcagcatttgtagggtaaaggtgtttttgcttttggaatccattgggagatttaaaaaaaatatatatatatatacacacacacacacacatacacacatataaagtaaaaagcaggaagtctatgtgtgtgccaggggatcccaaactcttggcctccagcagtcaagagattttttaaaacctttatcttttaccgtcttgctttttaaa

SEQ ID NO: 89944 - DNA, 1079 bp, Homo sapiens
cgctcagaattgcgtttcttacttccagtcttcttgccctgtaagcattttctgtgagtcaccaaatcaaccacaaaatcatttaattttatggaagtggaaaatcagacttattaaaatactgtgtttttgttttaaagctcagaggtatagagatccatgaatttttttccatgccttctcataatgtggttttggtttagctgcggttcttccaggcgcagatgtcagccctctgcagatctgctgcatcagagtttatggcctgggtcttaggaatttgcaatttaaaataaccccttcaggtgcatctaatgcagcctaaatttggggccagctcatgggttgtaaactgtactgccctatacaatagtagcacagttctaagctcaagggactcaagggggtccagtaagtacagttcaccagagaaataacaaaagcatttgcagagggagaccagagcatcacctttgttagggcaaaggcttaacatagaggaatgtggcttctatgtccaggccagtgggcttcctaacacagaacatggaattaggcagacttaacatcccccatgcccaccctggtgagtgccagcatgggcttgagctgctcttcacactgatggtccatcctttggactgatctccttgtgaaggatacaatacagcaaggagcgggggcttggcttggcacagccagttctttacccaaactcctgccaacgctggcccttctttcttaccctggttggagtgtgtgagggtgggagaggcaggaggaatatgctggacagagcttcttccatctagaagggaatttcaggagtaagaaagcggcagctcttaacatacctgggagaaagcaagtgcttagtaaacagttgaggaatgaactaagaattttcagacagattttcctcttctggagcatttgcagaaccgcctctttgctcaagtgctttgttttttacagattcatttaaggtcatggttccagacactaatgtaaatcagcacatatattattgaagaagtagaatacctccaggcccagttgccttggagcaggaaaaacag

SEQ ID NO: 89945 - DNA, 1049 bp, Homo sapiens
aagaaagtacatcagggaagattgttcaccctgagccgagaaagtggagtttcaagtaagaaccctgctccgcatcctgccactgagttgagatcatctatttgatttagctactgataaagtgtttttaattacaaattgtctgcttgcttggggactgacacaaacacttgttttgttttcaaagtgccttctctccccagtgttgggtttggagtagagcaagagtaacacagaggttgcagtcagtgtcttccagcgattttcattttgtttgatatgcggggaacctgatgctgatgaaagggaggaacccaggagctactgactgtgactacagtggatattcacaaaagaaggacctcagtacagttccaagtagtgagaggttgatggattaggacagatttaagtaaaacttaacaggtttaaggtcaaagaaaagtgaagcaacattccagaaggacccagaaaagccgagcaagtcaggcactgagatcttgggattgagaggagttgctggttcagacccagcactgttctggaactttcttttgggtactctttttttgtttcatcgattcctttaaaaggtacaatccagaactgaacatgtcattccacaagtggcccaaccagtgttgtatacactgactggacaggttttgccactaaaatggaataatagtctggttttcctaattccaggaaaggaaaatcaaggaatagatacattttttaaaaaagcatttaaagaatttctcctgtagacattatcttaaacttttggtccctgccattgtatgtgtatcttgaatccaagggtaatacgatacgcagtctggcaaaagcagtcattttaaatgattgagcaatatttagtgactttcaaagagcagagagcacaacttggctaccatagaagctccaccatgatgggcgcagggtttcctctaggctggaagttgtgttctggttatcttgtgagagaaatgcatcctgtgtgatttatgtggattcatttattcttagaggaaatcagacaaaaa

SEQ ID NO: 89946 - DNA, 1035 bp, Homo sapiens
tatagaagccctctgtttgtcccacaaagggccactagcacaaggaaatacataatgtgttcccttgtcattttataaaaatgtagactggtgctgcctgctgtgaaaatgccagtcaggttgcttccttcatagtaatcagtggattcttttgtccatttctgagtggaggattagccctctgtttgccccacaaagggccaccagcacgaggaaatacatagtgtgtccccttgtcattttataaaaatgtagactggtgctgcctgctgtgaaaatgccaatcaggttgcttcctttatagtaatgagtggattcttttgtccatttctgagtggaggattcctttccataacgtggtgtatttgcagtgtttctctcagaggaggagtgcctttctggtgtcatctgtcctgttggtggcagagttctgctgctgaattaaacctttgtgtcggccttggccactcttatggctctgctggaggtaaagccagtggagtggccttgtggcatttgctccgagttgttgctcatttttctgagattatcagaggccttagagggaagcattgaggatttcattatgctccgataactatcacgttgtcaataatatggttctgataagagtgatgggggatggtggggttttgtgagttgacagacgtgggtttgagacccagctctccagtcagaagccagcgccaggcctgtttctcttctctgagttttagtgtcctcaggtggaggggaggataatattaataacaccttcctgatgtggctccactgggctggccacgccatgggcacccagcacggggtggctgccctggttcgtgttaaccatcagcagggttggagagctccctccttactggtgttggaggtcattacctggcgggggatgtggtagataaagcaccttttattgtccctacacaaggcaactatggggtaacacaatataagttattcagattagagaaaatatgaactcttgctacagtgttactgcagacaggcacatat

SEQ ID NO: 89947 - DNA, 1036 bp, Homo sapiens
ttctgtaagcactttgggacgccctttgctatagtagggtattgtcttagttatccctgacttgcctggtgttactttacatcccttaatcctttcatgaagactggcaaacacattcagtcctgccaaccttgaaagtaggccatgtttgaaagaacattggcacaaacgagttgcgaacatcttctttaccatattcatgttctttaccgtattatgaggacactgtgcttgccacatgggcagtcttgttttggggatacgtggttggatggacggttgggtggatggaagactcctggaatgtgaagtatctcaaggatgtgtgtccattgcatgaatgtatgtttgatctatgcagctaattgacaaagatccaccatcctgtaccctccatgttttatttttgccctgccattgttctcttcgacattctataatcatcaaggttttcttgccctcacctaggtcttgactaaacatgttgggtaaatgaatttcatattactactttcttgcgccgtcagccattgtgttcttggggactccatcctgagccttttttttttttttgagaccgagtctcaaaaacaatgaaggcaggtgactggtgaggagagttccagccactggattctccctcagtcccctgtgctgtggcccttggtgacccctagatttcagtgcccctgcctgacactggagtccctctgtaaagaagcccctttctagctagctagctgttccatcccgcacacccccacagaagccttttgctgccattagtaagcacgcctctattttctcacctgtgattgatcatgcatgattgagttttgtctattaaagcaattgataagttactaaaatggcaccaaaagaaattagaaaaaaattgttgcaaatgtcagtgaaatcttttaaaaaactgttgtactttagaagtgcctcaagtgactaatggaggcttaggactctgagtggtgtcgcaaggaaccttatgcacagggacactgacattagcctgtactgtcac

SEQ ID NO: 89948 - DNA, 1046 bp, Homo sapiens
tcggcctcccaaagtgctgggattacaggcataagccaccatgcctggcccctgggccattttttattcttactcttaggctaggtttctgcagaccttggttataactgcaggctctacattgataactgctgagtctctaagtcagaccagacgtttctccccatttagtgatacatgttttccatccaattgcttcatagacaccttggacacagtgctctatttcaatttatgttgacagttcatgacccaaactggaaacctgagttatcctggacttctgcctaccaccttctcctaagccatctcacctgtcctaaatgtcgtagcccttatctagttctctaagctgtcatagggtcctgtactgctgggctgcttgttgccttcaatagagcctggagcatattcatgtcggtatttcaaggccccgggcataagagcttcttaggaaatattggaatgaatgaagaaatgatgaataaatgaacaaatgaacagttgattgatttccaagacactttggggtggtttccatttagaatggtttttatttctttttactggaactaaggaattatttttgcttgttgatgccaacattttaaaagcactataattttgaaatgttttaccacattaaattcttttctattgcaggtcacatacaaatatgtcaacttcaaaggaggaattatttgttatatttatgcaaacttgtggcacttggacatttatctagatggttttttgtgtatgattgtgttcttggtacagctggaaaagctaactttaaatggcaggagtaattgatcttaatgacttactttgaattaaacttgtgcttaattaacttggatgttctaagtttctagagtcacagacttttagagctggaatattgctttttgaacttcagtgtaaggaagaattgcttatgctcgaattgatttgttctgtatcccaatactggactgagtagaaatcaattactttaatattggatgagagagtgattgattgaagatcaggtttttaacctc

SEQ ID NO: 89949 - DNA, 1050 bp, Homo sapiens
ccagtacattttcctttgtggcatggtggcctgaaaatactgtgaggtttaacaatgaaggcaggtgactggtgaggagagttccagccactggattctccctcagtcccctgtgctgtggcccttggtgacccctagatttcagtgcccctgcctgacactggagtccctctataaagaagcccctttctagctagctagctgttccatcccgcacacccccacagaagccttttgctgccattagtaagcacgcctctattttctcacctgtgattgatcatgcatgattgagttttgtctattaaagcaattgttaagttactaaaatggcaccaaaagaaattagaaaaaaattgttgcaaatgtcagtgaaatcttttaaaaaactgttgtacttagaagtgcctcaagtgactaatggaggcttaggactctgaatggtgtcacaaggaaccttatgcacagggacactgacatcagcctgtactgctggtaatgtcagagtgaagcaaatcccacctgaaggcactctcttgcttgaccgtgaagtcacactgagtggttcaccatgtgcctgcactcatgcaaggataagccaggtctctaggcatgggcagaaggatccctgcttcccttctcttccctttcagagcaacactttcagccatttccatgagtctgggctcttgttacccagctgaaatactgtttcctgaaactcacaaatttgctctctaccaaagcccaccttatgccctgcctttccatgaagcctgtcaagaaaattccaagaaagaaaatttgatattcctatatcaaagcgtgtgtctttcctctcctaatccctcttagctgccacagtaggtgcaatgtcattttagcttttgcagatgcattacctggtggtttcctagtatttctttcacttgcctcgattgctagattagaaatttactggggacagacatctttttaatatctttctcctactacttaacatatagagcatcaagggaaaaaaaaacaaaaattatcttttaaaaatgt

SEQ ID NO: 89950 - DNA, 1892 bp, Homo sapiens
tgtttacatgggagctcgttgggtcctcccagcaaagtcctatgtagcaggcactgttgttctttttgcagataaagaaactgaggcaagaaaggtttagtaagttgtagagctaggtattgaaccagggcctaacctcttaacagaagttagttagaggctgttacttgagtgctcacaggttggctggcaatgtgtttggaacccaatgtaatgtcattagattctgcctaaatcttgtgaagaggggatttccatttgataggtaagaaaattgagaagttatcatcagcccgagatcaaacaagggtatagggagtggtgggacctattaagttcagatttatgtgacttctgatgctatgctcagtgatagatctcttcttgaggataaaagtttgagaattagggttcctcgaaaaccctgagatttctttttttgaggggtacctttttgtgttagcagatttaaagagctggccattgtatttgatggtagctgagtaagccttttgaattggagtatcatcaactattactagatttagaataggtatattttgctaagtaagatcttaaagtttttcctttaaacttaggatagctgttcaaatttcaaactcttcttttttcagtaagctggagacatttaaccttttgtcataggcttaaagcagtcattaaacagggtcatttcaatgcaactttttaaacctaactcccctccctttttctctttaattatgatcagtggcttcatttgagcttacctaggatgcatttgagactataaagctgctttcttaaaacttagcaatgttggctgagacaaaccaactgtagaatctcatgctttcataaagaaggttgcaagacattcattcacagttgctcctttattgtgtgtgatgagccattggcatcaaacctgcttgggttgctatcagtttttcttttgagagctggtgacttgcaatttaaaacacacatgggctcaagggtattggagggacatggcagaaagtccttctgctgcctagtgattgagagtgatggggtcctaactctgtgtgaggatagctctttgacacagctcacctcagtcccctttacctaggtttaagttgttagcattttgctgtatttgctccatctctttttttccctgaagtattcagaagtgaattacagacatcatgacgtttagttcctaaatacttcagcccaaacctctaaaaaacaagaacatatttctatataactgtagtactgttctcacaaaattaagactaattgcctaatggactctattacctgatccattatctgaacttccccagctgaccttaaaatgccttttacagctggactgtttaaaccaggattcaattgagaattctgtattgcatttaatcggtgggtctattaagactctcttaacctagaatagtgataaaagctttttactcttggtctctttgcaaactggggacccccagccagcaacaccccacctgggtctcactctaccatgctggggtgccctagctcacctgtgttatagcttgtacctgtgttcagtggttcccgagttcttgcatggcacccaagaagaatgaggatatgctggacattgagggtgaggagggcagagtagaattttactgagcaatggaatagctctcggtggagaggggctgcagtcaggtgcttctctccttcccgtgtggctgggcccagggctttttatgggctcagaataggggaggggcaggctgcaggtagtattggaaaaggcaacatttgattcattaaaaggcattgttcagaaagaatcaatcaggaaagggtgggcagacaggaacagaagttctcgctctggttcgtgggtt

SEQ ID NO: 89951 - DNA, 1056 bp, Homo sapiens
tttcttgtacgtactgtgtattagaagttggactaaaggcttgatcaaatttgaggcaggaatgggtgaggctacgtgcgactggagggacacaatgactggttctgtcataatcagtgattgaaattgatccctgggtaaatgtgggggcagtctcatccctccactatcaaaaattaacattttttttccccaggtgaccagcaagtaacgaggggaggggctgttttggtactgtatacctgcaaattttaaatattgatttactttacttccaaaggattggaaattttgtttttttctttctttgcccttctttgaaaacattgtacaaagtaaatctccttattttactaatggagaagcttctgaaagaggctgaacatacattgaagtacctttgctcagctgtaagcccttctggatcagaggtcagaccaaagtttgcagacagttggtccctgtggaccagactgaatccacacatgagtttatttggcctgtggagcactgaaacaaaaaaatgcaaatcctgagccaacgtttgggagatcccatattataatacaaatcgagatttccaggtttctggaaggtcttggcaatctagccacactgggcctgcatctgtgcaaggctgcatggctagaggtgtgtgctgggcacacccattaggtgggactgcgcctttctggccactagggaccgtacacctcctgttgttttcatgggggctggtttcccttgctgacacgtggccatgaggtccctcgaggtacaggccggcatttggacttgtcctctgcactgtttctttgttagcatttagaactgacttctcctcttcctcccccattgaggagcagcaccttactctgtgcagagtctgtctgtgatctgcaggctctttgcagagctacatttctctctggaggccttgctgagcagcctccgctgtctagggcattgctgagaatcacaacatcaacactaatggcccttgggccaaaaagtgtttgtcttaaaatccctgcaccaaatagcttgtgcaattac

SEQ ID NO: 89952 - DNA, 1051 bp, Homo sapiens
caggaaaacaagctcggggctcctactgattctatattatgaagagttgtataattatttcatcatctattacaatgtaataataatagaaataaagtgcaccataaatgtaatgcccttgaatcatctccaaaccatccaccccactcctccaacccccaaaccagcctggagaaaaattgtcttccacaaaaccagtccctggtgccaaaaaagttggggaccgttggtgtagaggactcctcaagcagcgtccatatctgccctattctctctattcctccacctaggtatagaattctatctctaagacacagacagaccatgttcctgcctgggcaaacacttcggtgactgtgcattgccctgggtgaacgggggcacagaggtctttgtgacgccctgcaacgcatccctctccgagccgcggtgcgctcttcctcctctgtgccttgccggtgcccagaaccacccccttctccctctttgcacaagtgccttgctctctcctttctcaggccagtgctgctgatctgtctgtgtgacccgggtgcacagtccttggctctgtgcctggccctgtgcaggtctctgtggtggcacttagcacatggcgctaagattctccctgataggccttcagcgccgcaagggccagcaccgagtcctgcacatcctgctctagtcccacatcggcccaggggcgttgagctgaggacagctccctaccccctttctgtgcttggccgactccagcgcccgttcttctgcccctccttggctctgcctccccaccccttggctgaatctctcctcctttcgtgcttgttctccaggtgacttattcaggtccatattttcattacccttgcatttcattaattttctcatttattttattctgtaggtttaggacattctttaaaacatgcaggttctgaattttaataatataaaagtcctctgtgagtgcccatcacattgcttttctgtcctccctacattaaagttagcactgatgcctttatgtttaaggaaagcctcctgcaga

SEQ ID NO: 89953 - DNA, 1001 bp, Homo sapiens
gtattttgagggctaaaagaaaggagtttgaacaaaagcaggacagtgttccgaatgtggaagcaaagagtccttccaaggggatgtgcggccaacgcctctgttcagcgatagtccagctgagaccaggacctgtgcctgatgcccaggccaccccacaggacggtcctccagcacctcatttctcctttcatcagacacctcttcactggcctactgggagaaaacggagatgagtgaaaatgtgcatacagaacatagggctcaaagggaccctagcaccagtggtgctcaagcctgtcccagcattagcgtcacctgggagctccaaaaacatattgttgccaagactcagtccaaagcaagtgacttccttggcctggagtgagatgtgggtggccagggtcaggaaccaccgagtgggtccacctctgcagactgggaaacagagtctgggaggctgcttgttccctcaaggacctgaagtgacatggggaggcaggactagccttggggctcctaattctgtcctggcctgtattccagtgtgccgtggggcacgtccaatttgaatctggccccagtacactctcaagccctgtgttgctctggtcccacagcttctgcccttgactttccatataacagcacattggtggccagggctttgcactaacctacctgcctccaacattgtttttgaataatggaagctaagcagatgcatattaatgcctgcattatggagaagactgtctcttcacaagtaatctgtagttgttagtcttgaaagtgggttaattcattgtctttctagagaaaatgattgcatggcctaatagtcttccagttagtctgtgtggcaaggtagaagccaggagtggattcttagctcctgttgagtgctgctgtcctgaatcagagatcttctctcccgggccactttgtcatgagcaggattttgaaccaagaccttttcttcacctgtctcgggggccctc

SEQ ID NO: 89954 - DNA, 1051 bp, Homo sapiens
aaagactacccatgttatgtgccattaaaaaagatgtagaaattaatctgtctttttctttgacctaatcttactagcagggatattggggctctacttttctgttctctctctctctttttttttttttttttttttttttttaacatcagccacaggtaatactctccggtaaacatataacttgaggaaaattgaattaggttaatgctggaatagaaaaccagggcagtgcctgctctttttggataattctgtataaacaatgagaaagtctcaggctgccttagacaaaggctgagacgggagctcctgatgatttttatgagggggaagaggagatggtgaggaggagggcaccgagcatgtgcagcaacttgaagcatgtcagaaagaacatttgccagaaatcttcaaaaccgtggcggtcggtaatgtgtgaaattgaacttctgaccctgtttgcttgatggcgacttctcgttgtgcttgagaattgtgtggcattgggtccctggatgtgggaggaacagcaaagtggtttagtgaatagagagggaagtgccttcctttttgggtgggacttgccatgatagagcctgggccgtcaccttaaaaggagatgtttctgttgagagatggaaaattggcaagacaaacgccataaaccttaacctgtttataattccttacctgtaagctgctttgcacgcaaggtgatggttctacctcataagggacaaggaagaacagcacataaacctgactgaatggagtgtggctgtgggtgggagcagctttacaagaaggaaacggggccccctcctgagacacccccgtttgcttctgctccttccttgccattgacgtgcccttctcctgaaactacccacacctgtgtttggcaacaagcggctgccccttgatccagatgcatttttcaacttgcgaactctcacctcttgccaagggacccaagtacctggttaatgatctttaatgtaaatgatcctttgccttgattaacattgagctgggttagtatgcacag

SEQ ID NO: 89955 - DNA, 1073 bp, Homo sapiens
ttttgaagataagcacctagaaatggaagttaagtatttctttcacaatagcagcagataacctaggaagacattgaactaatacctgtaaccttcttagtgaagaatgtgaaatataatctagagaaattaaaacatgtaatgcctgaatgtatcttattacaaaattaataagtaaatttcttgtgattccggttagaatttccaaagtggtgggttttctctttaattgaataaaataatcctgaagtctttatagaagaataaatacgtactacctgagaggagccaagacaaatatggaaaagaaaaccggtgagggcagatttggcttacaagtaatgacaacatgctaagaataagaagtcttcgtgatcaaagcaatgtggtattgatccagaattacataaatagttcagtggaacagactagagaatctaggactgtgtctcattaagagagtgaatgtataacaagatgatagttcagtactgttgaggttggtactggcataaccagttctttatctggagagggggttgggggaacagcacagacctctatctaatatcataatcagtaataagtcccggaatcttcaaacacttaaatgtaaacaagcaattcaacttttacaagaaaatataagaacctattttgtataatcttggagtgagggagaatggttaagcaaaatttgatacgcacaagctataaaaagagacacactttgaacatatattttatttttatttgtttattttttgagacggtctcactctgtcaggctggagtgcagtggcgcgatcagggctcactgcagccttgacctcccagactcaggtgattctcccacctcagcctcccatgtagctgagactacaggcaagactcactgtattagttctcatactgctaataaagacatacctgagacggggcaatttagaaaggaaagaggtttcacagtttcacatggctggggaggactcacgatcacgggtgaaggtgaatgaggagcaaagtcccatcttacatggtggcaggcaacagagtgtatgcaggggaactcc

SEQ ID NO: 89956 - DNA, 1030 bp, Homo sapiens
tatgatacctccctggaaatgggattcctaaattaaagaatattaggatttaaatacttttggtatagattaccaatttgctttcctaacgtgtggtactagtttatgttgcaatcagcacaaagactcactgtgccatttatcatcagcagagaagagagcagccctgaagatttgggggaggagtgttcgtagagaggcacgtgaaagtgagtttgagaggtttgagaagtagccaggtcagtggggctggggaagggagagagttcatgggggagggctggagatgaaggtaaaggagccatggttctttagggctgtgtgggtgctggggaatttgcatttcctgcttaaggttgtagtaagtcagcctggagagttgcaagaaaggagtggcttggtgtgatttattgtagcaagtgagagtgacccagaggccagttaggaggctgttgcagaggcctgagtgagagaggatggtttaaacaccaaaatggtaacattcagaatggagaggaggagatggtgggagattaaatttggggatggagcccttaggatctgttgattgactggatgtgtaagagagaaagggaagagcagaactgaggaaatgtcctcttgaactggctgggggccactgagatgggacagatgcgctggggagcagtgcagaggtggaatcactgctccttttaggtctaaggcatcccttagatctccaagtggatgtgtgaagatggtggtagaggagaatggagctcaaaagaggggccagagtcatttccatttagatggtctttacagcctaaggaactggcagatttcactaaggttgaggtctttctttcctgtgaaaatgtgatcaggatcctaagtaacagccctaaaaattaaacattaggaatacaaggtttcataaattaggaactgtctgtagctgccagattctaaatgttttgaggatacaaatcttggggtcttttcaaatgctttgagcagaagaggtacatcgtattgtgtttactga

SEQ ID NO: 89957 - DNA, 1045 bp, Homo sapiens
tttagagatattgccattaaaagttgatcttgagcatgacacagaactgaaagctttgatgacaaagccagcatctcagtttagcaataaccaggttagggaaaaaaccccagaaactcaacagtgagattcagctcagcaatgtgggcggggaacccactgtcccgccttgggcagggagcagccccagccgcttcatctgcctgatgctgggttttatccgcttcacaattaaatttcctttttgttatgcttgcgcacatctatatttggctttgcttcttattttttaagaaaggggagaagtgtgggcaaggtaaaatacagcttgcaagctcccaaatggcaaatgcaccagttagagtctaagtggcctcccaaccttaaggtgaaattcatttattcagcaaatatgtaccaagcccatcagggaccactgctcgagataccagtgcaaatagaagaggccaagggcacattattaggtccggagccagtggcctgcacagccatctgtgaccacctacctctctgcttgcagggaacttcagcctggtggaggagacccataatagccaagtcaactgataatagaattagtagtagtgttgagggacataaagaaatcagggtaaggccatcacaattacatgggtggatgatcttttataaaacagcacagttttgttttcttctgccatggtatctcctaacattttccagtgtgtctacttgcagttaatatggaagttgcggctgacactaggttagtggttaaaagaaaacaagaaaaccaacctttagaaatctttagaaacatcattatcatagaaagctataaactcttatgtatagaagggtaagtggccattgatcttggagcagaatgaatggatatttcctggaaaaaaatatttccactcatcaaagatactcaagtctcttctcatctaatcaatattggaaactaggaatatccacgcctatggaatatcctcagagagaattaattattctgccctctaagaggtatagtagtttagac

SEQ ID NO: 89958 - DNA, 1042 bp, Homo sapiens
ataggacctatttaccttttagaactttttcagaattatggactgcagaatatatacagtgtcaatgtcattagcaattcattagtgatatttggctagaatacatagttgtttccacacaaatgccatttcttacattgagatggcacatgtctggttaggacttgggctcatttgtaaggagccacgctgcaggtaggcatgctcccgggacattagttgctcaggtttcaaactgctgccccagcatagcagatggcacggtaacaaagtccctgtgcactctcacattgcctgcggtgatctatcacacattttgtcccctaataacctagctgggggggagctcatgtctctgtttgtgctaatgctcgctgtatccccaagtggcagtacttaatataattgtcattgctctttaatattatctcattccacgtcagctgcacaaaaatttgaggttaatcacaatgaatgttttctcaatccttgttattgagagctgtttaatagtttattttgtatgtgaagattcatatctagattgaggcttatacaacttcatttaaagacagctttttcggctgggcgcggtggctcatgcctgtaagcccaacactttgggaggccgaggcgggcggatcgtgaggtcaggagatcaagactatcctggccaatatggtgaaaccccgtctctactaaaaatacaaaaattagctgggcgtggtggcgggcacctgtagtcccagctactcggaggctgaggcaagagaatcccttgaacccaggaggcggaggttgcagtgagccgagatcgtgccactgcattccagcctgggcgacagagtgagactctgtctcaaaaaaacaaaacaaacaaacaaaaaaggaaagctttttcaggttggaaaaatatcaacagcagacatgaaaaagcatgaaaaatgacgctaagaatgtaagcaactggaaacaaaaattataatggtgcatagtgagctgaagatctatatttaaatgtgaactcccctttcagtttata

SEQ ID NO: 89959 - DNA, 1966 bp, Homo sapiens
cttctttgggattaatccttagaaataaatttgatgaatcaaagggcatcaaccctttgaatgcttctgatacttctgccatgttgtttcccagaaaagatataataattattccttccagtagtagagtattaaatgtctgcctctctttagaaagtattaccttttttcaatctttgacaatttgttagataaaaacttcagtttcaatattattgcatgtattcatggatatttttcttctcacacattctagattttttctatattgtttataaatgttttataagtgttattactttattgaggatagaaattattatgtaacacttgatggtaacagtaaaagtggaaaagaatgaggaaaccttcaacaaaacaagttgtcattaacaaaacgggttttgcaatgcaactttctgtgggttagctaaatctttagtgtgtcaggtagtcgaaagaaatttgctgtatagtgctgtgaaatatgctgcatccatgagccctctgctctttgcccatagggagcaaagacacaatctttttgcaagctgtcccagtgccatattgaccatcttccttttacagcaaaaagttattgcttcctttggttaaggttgggacacccctctggaggcacacttgaaaaatgaagacctttctcgttgttcttctgttatccaagtatcttggaagaacacctctatagcaggtagacaaggcagggtgtcattgcaatctggctgcagactgaatgtaatcccccttgacattttgccccttggaggcaactcctgccctcccctctccccttacgaccctgcccccttaaaatatgtggagctcagcaaagactatttattctgataaaaatgagcaaataataggtgtgaaagaacatggaacacttcagtgaatcaaatggagaggattaagcattaccccaataatgattggtcaggacgactgtccctgtggagtgtgtcccagaagggttgagcaatggagcaaacccagaaaatctcattctcaactctccctgacagatgacctcgtctgcgctgtcttttgcttcatggtgatgaaggtggaacaagacccttgaataagatttccatctctgaattctttaaacccatttgagatcagtgcaggcctgcagtctctctattagaactggagcagaggcccagaagagagaactgaattttcagcactggattctatgttgagaatgaaagagacaataattgaaaagcttttctcttggaaattttgcaaaatccgagtggatttttgaccaggatttcttggtgacctctcctgagagagcaggtgcctgaggatttcctgctgagtatcttggcatctgtcagactccttatgacttcattttagttcagggagtctgtttcctagccattgatttcatgcacaattcctggcatgtctcatatctctaaggtgatgtcacccttgtatttttttttcagatgtaatcttttatgtgacagtgaggtgtcttacttgtgagtgaacagctagaacctcccaagtggtttttcttttggattttgtttactcagtgaaaaatactgaggaacctgagatccttcagggtgcattttggtgtctgcccaaccttgacgtggatttggaggccaggctcaatgctcgaacttcttgttggagtggcactaaatcattaggatccctgaggacagacagttcaggccatcattatttggtaggcccttgcacacttacacacaaatgcatcattatgaacatggagcagaagattctagggccccgtgtgtaatggcacaatttgtcaagaggcctgagacctggagttggcatggattccctctcctcctgacccacctacctgctacattcagttggccaccctgttcttttgagtccacctttggatgagtagtcagtcctttctgatttttgc

SEQ ID NO: 89960 - DNA, 1087 bp, Homo sapiens
agggtctgacctgctggcctcctaagtcccagcccagtgatagtttgggaatgtattgaatctcatatgattagtattattctccaaaagagaaaactaacagattttggcctaccatcctagtatcttttccattaaagtatgggatgttgggtgatgaacagtcgtacagtgtaactaaaccacttttgttgtatgcatcaaagtactttcttgtgaaattggatgagagattctgctgagggtgcagttcttgtctctccatctctcatccagtgaggaccaagtgagttaagcagtattgagtagtataacagtacgttcctggagacatgggtgtgtctgtagactaatccttattctccaattattgagtataatatctcttgtttaacatgaggaaagggtcaaatttgaggaaaaatggcctcttgtttgatgtgttttagttcattattctcttctattaagagaaattcactgttaaaaaattgtttcccatttccgtatctgaaataatgactgtagttgaggtgatcttgccctgggtctgaaatcatacttccaaaccaaaaaggactttgaatacaaaacttttaagaaatcttgtatgaatacaagctatatctgaaaaattgtgttttataatattgatgcctagttttgccccaggccatctgcagtgtggttactatgcaaagaatgctggtgttgctgtttttttttttttctttgttggctattaacccagcggagacaatatgtggctatggtagtacttggaagttctagcattacacagactagcttccatttctctcatagaggtcatttttggcatttaaaacacatacttttagaaaacagatttggatgtatgtaaacacagggttaatccaccacactctggatgctagagctgttgacaaagtcatgctttgcagattttaaaataaactttttgttactcttacagcttggtattttcccctcctattttttttacctcctctaaataaacctctttgttaaataattgatgtttctggatcatagaaaatagtaagtttaaaatacagaatatttc

SEQ ID NO: 89961 - DNA, 1034 bp, Homo sapiens
ccgcttgccctagccctcctggcccccctggtcaccatggcccatcggcttcggtttcattttggctctggtcgcagcaacacagcccccgaatcagacatcctagaccaggagagagaagacgacttcttcatggcattccacaccctaccgcggagaagcagcccgcaccccttcgcccagaacggaggggaggacggcggcggaggcctgcagggaggcgtgggtgcgcttaagcggagctcgtccatgttcatcccgcagctcttgaccagcatcgacgcccgccccacgtgcagctcctccgtgcagatctccctgcagcgcaaggccacggacggggccacggacgggtgcgggccgcccgagggcgccgacgatgggcctccatgcgcaacgcccgaccccagggaccaggcctccgccactgccaccacgagggcctcgccccagagtggctcccgggagccctcgccgagggacacccccgggagctcccctccgagggcagcccgggacccagggctccaggtcaacggcacgtgcggccgccgcgtgcggtgctccggccccgtggactgcgcggaggaggctgccccgggcctgcgcatccagcaccgcgcctccagcgccgacgtgcgccaggtgaggctgctgcccctgggccccgatggccagggcggcccggccgcggcagagcccaggcgctggtccctgcagcacgttccagatgcttctggaagctctgggaagcggtgttttgtcttccagttgcagcagccccaacaaggcgcttcggggccaggcagcgacctcaactttggcttcacgggcacaaagggggacaggttggtgaggtatcctcgcattcggctggagaggagcacctcgtaccccacgcagccccgaagcgagcgagggagccccacggaagatcggggagccctggaggcatcgcctcgagctggcaggatggctcctgaaatccgcaggacgaactccgcggagaggactccgcagggccaggggtgcac

SEQ ID NO: 89962 - DNA, 1840 bp, Homo sapiens
agtttccctgcttcaggccagtggatctgaatgtttggccgagttctggcacgatgatttgtggtccagtgtttggtgcgcaaaacaccatttctgcaaatgtcttctgtaggtcctcaaagtcaaagaactttgtctgtttgggaaatccaagcagaataccttccccctgcttttatttttctgaatagaagaatttcgaataaaatttgttactttaatctgccaaaaaacaagtcagtgccccaacgtgctgatgttggaattgcatttaaaaagctgcttgcaagtatagcctgtgacaatactttaaaaataatcagttctcggaaaggggaggatattgcaaaggacctcagtttcgtctcttaatagttaaaataggtgaacgtaaagtttagtggaatttgattatctgtcatggcctgtttgctgcaggaggtcaggtcagtcgttgttatataatttgctttgttttttgtcccattaagtaatactgaacgagagtagtgtcgcttgtgggatagtgacattactatcccacaagtgacactgctaagatactaacagatgcgtttttaaagcacattgggttatggcccaaggctaggggaaactgatggggactcgttaatggtcagatggcgtggcgtgcaatttaacactgcacacttgagtgtccaagccgaggatgctgtatatagaatagtaagtaccctgtctccagctgtggagaaatagacgccttagaacagattctggccttcctgtttctctgttcctgatcgctccctttcagtgaaatggagtacagagagacagctgcacgctccatcgaccaggcatatgatgactctgcagctttcgtggtttagagtggaatgaaaagtttaatcagtttggtttcttttactagtaatcactagccagtgagtgctttctcctaaagaacaagctccttatattttgaattggatattttttctcctgaatttcatgtgactgccagtttgaggatatgattagtaaatgtctaggggacttttctttggatttcacttatgaattgtgattttgaaaagtgagcgtctgagtattactctagaattgtattgtcttttattgctttgtgttcagaaataagtttcgtctttcaagtaaactttatcactcctccatcattggttttcatcattttgaagatacaatcagatgcttaatgaaaatttatttttcttcttctctttccttccatgtatctcctttctttcattatctcaaactcttctattgggaaatggctaagtgctttgtcttggtctgaacctataccatgtattacacaatggtacaaattttgacagtgttttgatattatagtagcctttaacgcccacccccaacaaattaccatcatgacagttgtaggctttgttcggcaacacaattccatgctgaacttggaccacttaccgcatgaagattgacaaaaatatatttcctaaagtttgataactattcaattatattaccaaaaactgaaatcactttgcagttctgatgtggaagacaaagggattcatacaattaaactcaaaaaagttcaaactcatttggtttgaactttcaaatgtaattagaaaacaaatcgaataaactaaaacttatgtgtaccttgcttaaaagggctattctaacttgcaaggcctatgtagtgaaaaacaagtttctacacatttggagaatataaattctggaataaagagcttttcttggagagtaagttccaactagtgaacagtagtttgcattttcatatgtatgtatttttgtacacata

SEQ ID NO: 89963 - DNA, 1055 bp, Homo sapiens
gtgccaatagaaaatacaatatatcaaattggagaacttgtggttgaaaataatatacgcagattgctggtggcagtattcatggatgtgactttggagtgatttttaaacacttaagtatttttaaatgataagaccaattataggtactaagagtcttgtgttttgaagtgttggagttaatccagataaagttacaaatctaagcagacaccttattaagagatcattattctctgcttttaaagtggacttgctttctatatagttatgaagaacagatagaaatgttttaagattactggctactattaaaataatctggtgactgcagttatatctgggtctaaggcattagactttttggaaaatggatgcttttaatctttccttccgtatatttgtcacccagaattttaaaatttggaaatttcattcattcagtccagatagagaattgatcaattggcaattttattatttttcgctcatgaaaaactctagggttacaagaatatgctcctgaagttaacatagttacttttaaaatgtctcaattctaatggttaggtattagtcctctgagttccggttgccccttaacttggatcttaatttacagtttacagaaaattgttcatatttcatattttaagatcatgtactctaaaaccctattatacttgaaatgaagacctgttatgttatactagaatctctcatgaaaatgtaacagttcccaaggaactttgtttctgtctccatggaccacactggctactgtactggatggagggcaaggcgggagctgagaggcctttgcagaagtgcatgtcgccttagtatgtggcagatcctggtccctggcctgtgctgtttccctccacaccctttgatttctccgaataccaggaaagatcatggattgtctcgggagttagtctcccccttagtacttagcctgtcattttcatgttgcaatgcctagaaaatgggaggtttttcttctccttaaggaagtgttatttcaagatgctttctgctgcctgtgtcat

SEQ ID NO: 89964 - DNA, 1097 bp, Homo sapiens
aaagcaagaggaggctgggttagatcagctcactgtataatttttgcaaaggcggttttattgaaacctgttcttttttgaaagctggctctttctaacattcaaatgcttttgatcaacctattttatggaagcagaatattgaaattaaagtaaatattagatgaactttatagccagttgttttcctcattcttcaactctttaccctacaaatcttatttaaacaacatgttcagcaagctgttatcttgcttacgcaatgaatagaacattatgttctaaggtacagtttgctcacctatgaaaagaatttaacctcttttctaagtagctatacacaattgtcataccttaagttcttatttagatgcatttcagaatattagagcattttgcaagtagatgcacgttcttacccagtgtcagtgtttatagacagacactcaccatgggtatatttaagtctagggtggtaaagaatataaatgtcatttattaaaacctgaacatagccaactatgaattatttgtgttaatgtaaacgtcgaatgagcactgcaaacatttgatgtttgaatatttgcctgtagaagtgcagtactatgttctatagaatataagtagatgccaccccagtcctcaaggtttcagtgaggtcatcattgtatcaataaaggtgccaatttaagatgctaactggacattggaaaaaatttgttgtcctattctgaaggatgagtcttatataaagtgtttttaaaatactttattgaaactgccatgttcttttcaattttggtagctcccctgcatttaatttagtcataagcgtctgtattaatgggtgtgttcaatatgaaggcatcctgtgaagacaataaattatattatacttatctagtctgcactctttatcatgttgataaaatggcccttaccagtaaaaaaactgtttcagaatgtgtaagagtaagtctgtctcagctgactgagggcttcatcatgttcatgataatcccagcagcttgaaatgtcaaactggtagctgatccatagcacacagtagtgctaattgagataggttggtgtggata

SEQ ID NO: 89965 - DNA, 1069 bp, Homo sapiens
acacatgcttcgaggtgatgtacttcttggagatagtgctttcctcatctcttctaccttgtagtcgtcagtagagggcatgcagtgcaacagaagtggatttcaggactgagactagggtgaggcaagagaggcatcagaatgcaaaagtgaagtagacacctgccgtcagcactgggcagccctgctcctggggccttacttgactcatcctggtgggttttccaaatggcagaggtgcacaaccacttcttgcaagcatgggcacttgaattgtagcccatgtacacagtgattcttggaaaaagtcatgagtaatgaatggaacttttctctcccaggttgatcttgtgttttgagacataaagagtcaaaggttggtgcctaggatgctcattcttattgtttttggtagtttgattgttgaaggcttttgacacgacattgaagtgaatatttggggcattttgctcctctgggcttttctctaaagcaccctcacatttcctctctcatgttcctgggctttcctggctttgatgctagccccactgtgtgttcccattaatagccctatgtagcctggctccttattctggaaactgtgtaacttttgctcttgatcttaaacacaactcagtcttgcaaggagctccgcctttggtctcagcttcttggggatttccctggcagccacatagtgaactatgtcacactctctgttttacccgttaataaggaaatactctggtacatggagctttgcttgctgatctttttctaagtactctgggggcaaaaggaaaagcagctagaggataaggatgtaactttcttcaaattaagccatcctgacccgtggtagagattagccactaagaaatagtggaaacaaataactgtttcactcttgagtgttagcatggaagagattctggttgaaatcctagtcctgccactttctggttacagaaacttacattacttttcttttgatgtttcaaggagataggagttaaagaaaaatgaacaccagattactagaacattcttatagagttgcccaaag

SEQ ID NO: 89966 - DNA, 1004 bp, Homo sapiens
agcccttacttcctttaatacttttcttctgcacagtcaggtgctctccctttgagcttccgtgtgaagttcactgtgcacccagctctgctaccaccgcctctgtcttgaaaggaatagggtggggtggtcattggtgtatagtaagattcgaatcacatccttcaagtacagttctaccctaaagataagagtccctgtggtttttgttgttgttgttgttgttgttgtttgaatggatgtgttctttgagaaattgagtcttgagtattttgtgaggacatctaagcctggcgtccacgtcagtgctgacagatttgacctagtgtgcactcccatctggggaaatgcccataggctataatctctttcactggagcgattataatagcccccgggcttcaggtcccagtggcatccacccttggtggcagcatacccctctgcatgaacagggcgcccacttgtcccctccttcttacttagtagtgatttttaaatgggagggtggcagtcctgaatgtagttcatcagtatttaccgcacaagctctaaaggacacagtgttttatttgtgtatttatttaacttttccaatatcggaatatgaatttttgtttcacctgataggacacgtttcaggggctccattctacattgtcatttcacaggaaaaatatttgatggctcattagaagggaacatctattattttgttactgaaaggcacattttcaaccttgagaattggatggcaggtaatggcatggaaattgacagcattttaccacttaaaaataaccacaagaaataccaatgttcaccgaatgagttgaagttaatttggttttgtaggctattgtagttaacttgatgcttgatggaaataattttgtattggaaatcattaaaaattgatttgattaatgcttttataatgttggtatgaggtgttgcactgtggtggtgatgacctaagggtgctgtgatggcctcaaacgttg

SEQ ID NO: 89967 - DNA, 1045 bp, Homo sapiens
tcccgggtgggaagaaaaagtggacaatttaggccgaacttactatgtcaaccacaacaaccggaccactcagtggcacagaccaagcctgatgtgagtaccgtgtgatggtcaggaacacgtgcacgtgcactgcacagctagggacaaatatggcggccctttgggacaaggctgggaaataaatcatatgtctataagagcagatggtggtgtggtacgagattcctctccatttacgtaaagcatgcaagagcagtcagaacttgtatattgtaagcgattgcctttgagtcacatgctgctgttttcaatatgagctgatttattttctatgtcttcttttatgtcgattcctgaaatacaaagcagaggttgtttttcttagacttattttacatttgttgattatattgttttcttcttcacctttctctcccaactgacccagaacagaaccggcaagcaaattggctttgcaattttctgttttctctaagtttttggatgtttactctcttcaatgcattgatttggaaacctcaaaaatttttttttctttaaggaaatttgagccccttaatataatcagaaacacatgggagagttgcaaaatcagaattagtaattactgtgtattttaatccctcaccagcctcagggatgcagtaaaccaattcctgttttgttccctcagcaatttgtggtttgattgatagcaaataaacactggttaaaactcatggactttaaaaatggttttgtagcagcttgtttttaaatcattttatacagcaagatctaagtctattgataatacatcgaagggcaaaaagaaagtcttaaggaaaaggaattttatcctagaaattatgagctgcctagcagccaagacaaggaggaaattatcaatgaactatacaactttcagtatgtaataaaagcaagtctactgggtagtataattttcttgtctactcgaactctgaaagaaagtggctaatgatacattttagacaacaagcagtatgaggtatcatgttct

SEQ ID NO: 89968 - DNA, 1138 bp, Homo sapiens
aatcattcctgtctttactacttgaagtccacttagaagctaaaattggctgagcatggaggctcacacctgtaatcccagtactttgggaggccgaggtgggtgaatcatctgaggtcaggaggtcgagaccagcctgaccaatatggtgaaaccccatctctactaaaaatacaaaaaattagccaagtgtggtggggggggcttgtagtcccagctactcaggaggctgagacaggagaatcactggaacctgggaggcagaggttgcagtgaactgagatcatgccactgcactccagcctgagcaatagaacaagactctatatttaaaaaaaaaaaaaaaaagcagctaaaattataaataccagatctttcagaagtaggccaagatgatgtctgagctcctctgaatataggatgcaactgactctttttcaattgtagtaatcaataaatgttgggtagccacatatcactatttcttccgtctattcacatcacattaaaatttaccctgagggtgcatcttagagcaaactacaagactgctagcttctttctgtttgtaaagcagcattagagtgttgcagagtcctgttgagtctcctttctgaaagttttggtctcctcttacttttgccactaattctaaggaccaatcaaaattccagtctgcttaactgaaaattaaagtgaaagataactttttcaaggatgactgtccttgctctgaaaagatgtttcatttaattaccttctaatatcgaagagcggtgaatatggttgagtgatatgtttgttaaaccaatgaaagttgcttttaagaatatatttcttgatgcttcctgtcttttcctctccttccagcaaagagaaccctcctcaaggttgaggtcatgcagtgtcaccgacgcagttgcagaacagggccatctaccaccggtaacccatgctaatttccagtcatcagttgactttttgggctttcatttacaatcatctgggctgctgcaaaaagagtttttcctgtgtaaatttatttacaatataaatgagatgtttttaaatttcctggccaattgccctaggaaagtggatttccaatacagagaattgttactgccacccatctcta

SEQ ID NO: 89969 - DNA, 1493 bp, Homo sapiens
tgtttacccaggtcaaggatgagccaccttggggggcataggggtcacgcttcctttgtgctactggtcatcagcgactgctggctttgtctggatagggtgggtttcagggattctgatctcacgtcacctgccttacagcgctgccacagcagtgggccctgattcagacagcagggggtcatcccctaagtgcatttcactgatgtaaattatcattcacagcccagtgccccagctgggagagcgcgttcatcaactgtcacgggtggtgaggaaccaacggtaatgatccactttatcagacatcaatagcaagaggccgtgaggcagttttaatatttcgtgtagtggtgaatatacgctgtttttaaaaataagattagctcctttgtgctacagagctgcacacgtttcttattttaagcttctcatttggggattgtttaaaggtactgggtaaaatagaatgatttttttagtcccacataattttattaggaatactatcaggctttggttaagtgcatttaacttgaccatttagaagatatttttgacttttagtgtttgtactcctgataagtttttccatttcattagaatgcttggttaaagtaatttggttggaagatcatcaaagaagccacaggaattgcatgagactgtgtgtgtgattcctggatgtgcccagggcccttctcttttctgtatctcccctaccacatttttcacagggggttagacttttcttgtccccagaatgcaccatgaccctttctctgccaccaggggctctcctcacacaatgaacaagtttccgtaattccaagggaacataattaggatatataagtgatctagaaaaatttatgtttctctaagccaaccattcttattcattattttaaagaatgtatggtattcctgtctgtgggtgacttagatttgtattttaattgcctgttttctacttgatccctaaagttaggctagcttatagtttatgcttcgcactgcaatagctgtttaaagaatttcctggccgggcacggtggctcacgcctgtaatcccagcaccttgggaggctgaggcaggtggatcatgaggtcaggagatcgagaccatcctggctaacacagtgaaaccccgtctctactaaaagtacaaaaaattagccgggcgtggtggtgagcacctgtagtcccagctactcgggaggctgaggcaggagaatggcgtgaacccgggaggcagaggttgtggtgagctgagatcgcaccactgctctccaccctgggcgacagagcgagactccatctcaaaaaaaaaaaaagaatttccttattgtttcacctgtgttgtattttgctataactgctcattacttgtggataactttacgtatacaattgctgattttctaaagatgttgatgacttcaatttaatgctcagcattgtacagaggaaaatcaaactggcaacagtca

SEQ ID NO: 89970 - DNA, 1055 bp, Homo sapiens
cagagattgagtaactgcaaaaatatccttaaggtttccagagctaaggtttccggagctgagttttccaggggcggggccagggggagtggggagttatgggagggaaggggcctgggagagggggaagtggatcaccagaacggctgaaggggagggctctgggcggagggagctgagaatgtaacacattccatttagtatttcattgattgtataaacaatagtaggtcaaaacttgatagcacatactttgccagagatactaattgaccaggaacttaggttacaacttagctcagcaggggagtccattgaagtgcccggatccacgtagctctttgtgttggcatcgctgctagaggaggaggggaggaaggagcttcactcaggctgcatgctaattcatcgatgtttaatattcatgaaaggattaagtcagtgttgatgtttcttctgctcctgctgagtctccacacctggatccagaatgctccatgatccgagtctttgtgtctttataaactatctttagggagctttaggactttatctcgggaaatattaaggaaatggttttccttaatatcagcagaaagttttcttacacataatctaaaatcagctgcttcatgatcttacccaggtgatctttctctgaattgtgcttttaagcctgggaggttaacatactgcttctctgtggatggggttttcaaattacccggcagcatccttgttggtgctttctctaatttgagatcctggagtccaccagggaactccaggtgaccaccttcaccaagacacattgctggtagtgcagggaaaaggtggcataagcacaggaagaagttaggttcagaggaaatttgtatcctcagcctaatagcaagaaaacgacaactgctaaaatatctggaagtaaaagaagcagcttccttttgtaacctcacgtgagaggttattcctaaggcatgggctcctcctatacctttagattcccctaggagccgtggtatagctgtggtcggcttctggtttctgagcttttc

SEQ ID NO: 89971 - DNA, 1753 bp, Homo sapiens
gcagaagatggtgcgtccggatcagccacaaacagtaacaaccatctaatcgagcctcagatccgccggcctcgtagcctcagctcgccaacagtaactttatctgccccgctggaggtgagacggctacctcatctaactggactcactctgtcctgtgactcccattctttcttctctcttaactctgccttcagtttcgcagccacctcctctctctgatcagtcgttgtgttggtagtgaagggtgttcttgtgcagcctttctacctgcttctctgtctcgcccagttaacattcctggactctctcacctgattctcattctcatttggctaaggccgtggtgacttgtgctggacgtgggcactctcttttcaggacttccaccgttcttgttgtgtttcgcttctttttgcctgttacctcattagaattgcgtaatccctctttcaaataccaagtgctgatattgagtttttaaacatagctattgctttgatcatttgtttttctttcgactgtagggtctttcattctatgggcatacatgtttctgatgcatatttgcatctctgcatcatggctgggcatctgcttgtgctctctgtcgtgtttgtgttgttttggtgccatcctttaacatcacaaatgtcagagttagagaagccaaagagcaaatgtttgaggtcctaagcttgactgtgtcttagagacagctgtgggcttctccacgccctgggtccagatgctgataagtgggaatggatgctgtctcttccacactctgatatgaatgtcatgggtaacaactgtgagattccagatcgttgtatttattgatgtagcttttttcctttttgtgctctaaaacttgccaatctgttcttcattagactgtgagctcattaagagcaagggcacatttttctccactctgtaaaatctccatccataatgcttagtacagaacagtatttttggtacatactgagtagctaccaaaggatggtggttataagtacttaatattgttgtgtgtttatccaacagagaaaatgtaaagttagattgatttaaaagtaaatgaatgacagaaaacaggttttggggatcttccctcttgtccatctccaaagagaagccttctgcaatacccaggtacattttggcacattggaatcgcacatgctaaagagttctaatcctcattgttattctttagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggtaaggctgctgcttttatttggctccattttcatcatgaagtctggcattaattccttgatttccttagtgtttgtagttcttgcagaggaattggattgactgtaaagggtgtctccagagggtctcctcagcctgcatctggcccctgcataaatgggcgggtgggagtgggtgggcacaggctggtagctgtctttggtattggtgctgggactgccttttctcctgggaagctctagtttagacagttcaccgtgctggatggaaaggtattgctctgtgctgttaagattttgttaattgatcccgtctcacaaagtaatctca

SEQ ID NO: 89972 - DNA, 1751 bp, Homo sapiens
attttttcttttgtcagtttcttcttgcactttcattggcattacccaccttcttttgatttgtcgctttagtttttaccgttcacatcagatcagtattcacacatctgaggtacattttcatgcccttgatcatggggtaggggatgtactgagtgactttggttgtagatctgatagctcctttttgtgatcattttgtcaaaattgatttttcttaccatgcaactctttcatgtactcctgaattgtacccaagaaagaatctgtacattgtattatcttgagcaaaatgagattaatcaaaggcaaatatgcatatctttgtatttctgtgtcagttctttatttctttagccgaatcggtggctttttcagtgtagtatatgattcttttaaaagtcagttggtattttcctgctatataatctctatacctgtaattacactgaaaccggttcccgtatttctggctatttttgatgctgcagatggtttttcttccggttatgtccccatcgaattgtctagctagagttaactcagagtttaacttggtcctactattatctgtgctacttgctcaaaactgatgttatgggaatgctggttgagttttggtgattgttattggccctagctcttcggtcttggaccaacaataaacatacaccattaattcccatttctagtgatggacattaagtgtgtccatttgatagaccagcagccttatattcaagaacaagccctgctcaaggggatttgggctgtcattttatgccttgcccattgtgtggtatcagttcagtccagcaggtctagagggcgtgctcctagaatcctttgaaccgtgggacattgtgtcttcaagggcattcttggcatttggggcagggacatttgtgccttcagttgcagactatttaacaaacttggcttctgctaccaggtgctaatggtcaccattacccccaccccaacatagtgatgaccagaaatgccctacacatttcaaaacagccctaagtgagaaccactctaagagctctttctattttgaagtaagggaatggcctgccaagagaatttctcatttagatctggtaacattcatttggtaaactgataactgcttctaaggcatataataacatgtaggtttgactcccctactagtctgaagataatgttacagatttgcaagcaagccaagagtaagagacgggcagctcgttggaaaatatagtaatggagttctttttttttatgtctttttacttattaccatggaacccctggctgtcctgccagtgttctcatttactatagcactgctgtaatttcaagtccttagccagaaacaggctccagaaataagggctaacgaatataaaagtagatggattagtgtaaggagccactgtggcttgccaacataagctatgattttagtaattttaactagcttggtaatcaaatcccctaaccttttcacagcctttcaagccacaacaacagtgtaattgcagctgggcagattgtattttaaattaaacagcactcgctttatttattgcttgcaacattgctgaatgaaacccatttttactttccagttgcgcctgtttacccagatacttgttattgactaatttactgatttaaaatcataatctgttagaacaacgttttgttgctgctgctagtgtgggaaatcctcaaggtaacaactggaaattccacaagct

SEQ ID NO: 89973 - DNA, 1001 bp, Homo sapiens
acccatctcacgctccaggcatggacagcctggttgccttgaaacaaacagctcaagaagaaaagcacccagtaactgcacacagatacttccacttagcatctactgtcttttacatttttcttgcaggaagatccacgtttgaaatttccagtacatatgcggtcaaagacatctttaaaccccaatgaccttggcccccttcctgtgagtacactggagacacatggaatggtctgaatatgtgtgttcctttatccgctcaatgttgatggagaggccctgtggaccttctctatctccaggctttgtggatctcattggtttgtgtttcttaacagaattgggtgtttagctgaattgtagtcatacattatagttcatgtgatatccagtacttatgaaagaggtttctgaattgctagcttctagcagaagatagaccttgtacacaggatgttcaagagacgttctctgcaggtgacaatttaagtggcactcattcattttgtaacttagcaaccactgagtttcagtcatattgctgattaagtcatcagaacaaaaataatgaaaatagtatgggagaagaaggcctaattaatcatagaaagtttctataagtcatttaacctgcagatttttaaagtttttttctcccttgttggtgacggctcagtaggagttgagctatatacttaaaattggattttgaatgaaaccttcacatacatcctcctcaacaactcactctcagtttgaaaaagccgtagggggtgacagggcagtggttggactccaaggctatttttaaatgggaatttttgttgttgttttccaagtgtaagaacctttttgttgcctggtatattagggcaacattggaggctgcgaaggttaaggttcaatcattattcattaggttatacaggtatcccacaccaaatctgtttggttcctgggttcaaatagaaagaaccagagagttagtttagaaaaca

SEQ ID NO: 89974 - DNA, 1083 bp, Homo sapiens
atgctctgtaatcttcctctgctgtatctaattctcttttttggactgcctaagctgctttgatttttgtgtgcatatgagtgacgcatgtaatagattattcatttgttcaatgcaggattcttaattgaaagcagtttttcaacaccataagtaaagagaaaagtatttgaaatgagaaaaaaaatcgtgtgtgtgtttgttagccttttgggaaactaagactttttaaatgctttttttcaactaaatgaaaatcaagatcaagttataaatccttaaaagaacaggggtttataattcccattttagcaagttatttgcccaaaacagtatgaatagatggtttatctttagttgtgcatttttgattgagtgtttttaactaaacagtatgtgaggggggttgccatatagactgtagttacctgctaactctgaaatactaatttgtctttagaacacagggtgggggactggacagcttttgaagaatccagaaatacttccttccaaaactttctttacatagaatagatttgaactaatgttctgattttttttttttttttttaacattttcagatagcaaaattactcagtgggaagacccaagactgcagaacccagctattactggtccggtcagtattttcaaattctgcctcttcagtataagattttggttacgtgtttacgtgtttcttgtgtattactgataacggtgatgtcaagggacaacggtgattgagtagttgactagaaacagagcactttgctgccatctccttactgaagtttccaggtgaggtacagctgcatgtgccttttcagatggatttcattataaaggaaaacagcttgataacgacagcagaattaaacatttttcttctcctttataaaagggtggactataagtatagtcaaaattccctcccttcctttttatatgaagcaaaaccaagccctatcttcataaagtgttatcatttctttaggccaggagtagtaaatgtatgccaaaagtttaaatcttttacaactttcaaaaatctgtagaagtttgggtgagattatagc

SEQ ID NO: 89975 - DNA, 1228 bp, Homo sapiens
acattttcaggagtagggggaactgtgatgtaacagtgatgtttggagaaccctcacgaatacaggaacaaacaaaaaatagttgctgggaatcacagactttcagaaatagaagagctgagtcacgtttgttcatccagtcaaattcttccacttaacagtgaagaaactccttagtagagaggatgtgatgcagagccagctgatgagagtctacccgagagtgcaggccttctaacgctggcaggagagagtggaaggaagtcacttttttagttcctatggggtcatttttttcctcatggcactaccacggtttattcattgatttcctattgcctgttgctctcaacagcttgtgagctccaggagggaactgggaaagctacctttggtttatgtactgttatttttctggcacctaaaatgccttgcacagagtaggtgctcaagaagtatcggttgaatggacgagaatgaacaccagaaagtgagaaataaactagagaggaaatcttagtttgtgacgggatgtactgttggtagagcagaaaacatgatctctttattggcttatgtcagaacattgtattctttttcttattttggtggttgtccaggtattaacaaatttataccttgcctagactcagaattgctatgtggtttcatcagactaaacactgcctaaaataaataggatgtgaggtcaaatctgttgttcagtggaaaatcaaagaagactggcttaaaaactaagaaaagaccataggcagtgtaaattgtctatagattgctcctaagctatataaagatgatgtattttttgctctggaattacagagcaaaacactgacgtgctcattttctggaagagtggttgtttgttttgtttcgggttttttatataaacatgtcttaaaactataaaagagggaagttcatgttcttcatttcttctgtttctggtcaagataagtatggtgaaagtgtaaggtttggagtctggagatactagactaaggatcagtatattttattaacttaggccgaaatgataacagcagaagtattctctgctgaaattcatactagtggctaaaaagcaatgagttgttttcgaggctgtcatagttaatgtctgtgtatatgcaaaacccaatcctttttgctcataaaaatatcgtaagctttttcagtagccaaaactcacggccctgactctaag

SEQ ID NO: 89976 - DNA, 1031 bp, Homo sapiens
ggaatgatttttatgggatataaaataattcagaaccctagtcacaaaatctgtggaagcctattcaattatgcgcagttatcatatttaattaacctggatcccggtaagaaaaatgttcaagtccttccttgtaaatgcaaaagcttagtttcaactacagtatttataatatagtgttatatttaattataataattggcagtattacgtccaaatgtaattttctacttataattatccctggcagtttaaaacctagaaactctaaaaatttttatgggcaacattttaaattataacattgcattttctaatgacacaccatccccaaattgttcaacattgcatcctctgttttactttccgattcctccttagcagttttctcttcaattttctccatcactatggttacacctctagggaggggagagaagcggctgcagctcagaccccctctggtggcctgggctccattgccatctctccctgcctcctcccctcagctggttcctcctgcccgggaacatctctggatggggcacaatgtctgctctcatttaggggttttggtctctgttccaaagtcctgattcaagagcttgcgggtaactgctattgaaatgattctttgccttcaaaactcaaatgatcactgaaaattccacagttttctttgtgagtcatgtcccctggtaatgatgatgactgtggtcatcacccagtctcactctatggctctcacatagcagtgtctgctacccggaaaccatctctgcacattcattcttacagccagaccaagcctggaccgcctctttgcaggaggcagttgccacaaccttggtcaagtgttttgttattttcatgtcagcgaaccatgctttgggctgctttccccacacttggcataatcaggatcccactccccatggcaacaaaatggacttgaggcagcgtggattatatctaccacctggcggccctgccacagttgagcatggataggcccaacctggccaggtggg

SEQ ID NO: 89977 - DNA, 1997 bp, Homo sapiens
ggaatttcacctggcctttcactgactccccactgccctcagagagcaccccaactctccagcaccccatgtgggctctgcactgccggccccttctctggcctgtctacccgccctggcaaacggctggcaagtccccagccttgttcctctgcttagtgtgcccttttctcccccaattcctacgcctgatttgcactgcggactctgcttgaccttgaagctcatctgtcacctcccagaggcctttctggccccactctgctgcgccatctctcttagcacagctgccctcctcatgccactctccccctgatctcgcctcctcgcttgtgcaatactgtagaaggcccttggttactccttcatggtttctcatttacattgaaagcaggttaatcttttctttcatgctctgatacatagcagtgtcaaagacctgaaactaaacccagtgtttaccgtgttttaggtttcttcattagaccattttacaagatgatgttgggaaagcagataaccctgaatgacatggaatctgtggtaagtaaatgcacgtcacacactggccatcaccgggcactcgtgtcttatgagaaggtattggagagccatatttgtagtctcagccacttttatgggtgttgcattccatgtgaacaacaggagacatttaattgcttgaaaagttcattgatctaattcttgtaataaatcattgttcacatttcctggaaccatggtacctagggtggatacatccaaatcccagttgcctctgcttacccggcataggacttgtgtgaacttactaaatccaagagacagctgaagatctatggtagcctgtgttttctataaaaactgctgctgctgaatgtttagagcttcatccgctctccctctgtttcctgacatcataaaaatggcagaggcaaaggtcaaaacaataggaagagtatcaggcagacgtcctagacatggatgagtgacgccacagctcaggcaagtgaacacttgagacgttctccaagtagtgatttgggttttcatgttgcatttaacattaattttacctagacagaccattttagagttggaaggattttattttttttttattttttttattttttgagatgatgtcttgctctttcacccaggctagagtgcagtggcgcgatcttggctcacttccgccttgcggattctagcaattcccctgcctcagcctctcagatagctgggattacaggcacacgccaccatgcctggctaattttttttttttttttttttttttgtattttagtagaaacgaggtttcgctatgttggccaggatggtctcgatctcctgacctcatgatcctcttgcctcatcctcccaaagtgctgggattacaggtgtgagccaccgcacccagcacggatttgctataaaacaaaaattgatgttctttttataatatacttctgcttctgtttttcttttaatgtacctataccccacatctacctccagagtgtatgggtgtttgcccacacgccagcacacacacagggccactgggaagcgcgtttgtccatttggggtatttgcagctcattcgtgtttgctcacttgagttaaaaagcccctgcatgatgtcacctgcctgtgataccaactgtattttgggcacggttgggtagatgagctgtgtcctcggccctgaccagcgctgactcagtgtttctgttgctcctcattgtatgaaaggagaggaagaggccagcagtgcccttgaacccactgctggtttgccagtcatggtgggttgggatgcacacctgtgattccggtctccactttgaccctgtgtttgtgctttctgctttcatcactgtatgatgaagcagctaggagcacaggaatttctcttaacgtctaactttataccacatgctgacagttagtgcctaaagtacagtgcgtgtattatttttaccctcttc

SEQ ID NO: 89978 - DNA, 1162 bp, Homo sapiens
taggtggagcaggaaacattgcattagtaacatatttcttgagcattctgcacagaattacattagaatgtaattaaagaagtcaaatgagtttgtattttggggaaaaaatgctgaattttcactcctgtgtcattctgtaggatagtgaatattacaactctttgaaatggatcctggagaatgaccctactgagctggacctcatgttctgcatagacgaagaaaactttggacaggtacatgtgggtaaccctgggaactcttctttagctttcaaggggcatttttcttcttgacgggctgtaacacaactttgctggaccatcagaaacaaccagcaggagctgcaggtgttaattttcatctcattgtagcagcacctttttgtcatgccaagacgccacactccaattacaaccatttctctcttccagcaaagttacagaaattccaagaggccttggggcatgaaccagcacctcttctaatccaaagcaaatgtgaatgtttcatttgtgcctcggttttagaatttaggtacttgaaaaaatagtgagattgttgacttagcgatgtaaatacatgaccaggagtgggtgatgttggaagggccattggtttttctctctgttttatggttctgttgtcatggcgacatttgtcttgtgaggctcagcatggcaggctccggtttttctaccattccctctgctttgcccccacgctgttattcaggctggactaatcctcaaagtcagtttcagactggtcagcagggatttggatgggccactgaaagtggatttcaaaggtaaagttgcctgcttggaataattctcatcatgctaaggatctatgcgatgtatttgtctcaattctgaagcctttgcttcatctgccactcagtaataatgatgcagcttgggaggtgttctcaatgtattctctgaccctggtacctgtccttccgcaaaagcccagaggtatttcccatccttcagactaaatctccacggctatgaaattaattagaccatagaactcattgtaatggttgccctctgaaaaatgaaatagacgtgttctttattgctagatgtcaaagattgctagagaatctttgagaaaagaagctgatgccactagaggatttaatgac

SEQ ID NO: 89979 - DNA, 1065 bp, Homo sapiens
agataaatctgtctcttcagcctggatccttaagcttctttcttgtctttaagtttctgtttgcatttttgaaagaaataccatgcatcctttttttatgactagaaaatataattttcagaaacagaatgcattagaatttggatttctggagtcttgatgggtgtaccctgttcttttctctgttaaacataattagtttcctgataaatgaatagcagaggaaaaaatgttgctcttcattattgctaatatatgaagaataattaaaagtcataaataaccataaaacaatttgcctttaatgatagcatctttaactgtgtaacatcctagcaaaaaagcctcattggacattctcttgtgcacagagcccatttgccgggaaatatttctgaatacatgttgtcttccctttatagtaagacattgtcactcaataataatatgcaagataacttcgtgatagtaattgttgttttgtctttgtaattacagacatatcaagtggatttgaagcccaatgggtcagaaataatggtcacaaatgaaaacaaaagggaatatatcgagtatgtatacacatatttactgccttttctttgaataattgaaatgcatgtttggtcactgtcccttgctgaaacagctcatgcatttattatgggcatgagtttattggtcagttttcaacaaggtaagttcttttctggcttgggctaatgggaagttgaatatgggatggaaagtctgtcttgtatcatgactccattgagctgccctataaaggagcagaggagggagaaaaggtctatattattgagtaatacggcaaatactcttttggaatatgtggatatcaactaagatttagaattgcaacggagaaccacggtgtcagtgaccagcagggcaaaattaggaaccaacaaagaaaaaatattttgtctctctcccaacttcttttccataatagaaatgtatagaaatagttaaaatggataggaagaattcagcatgtgcaaccctaaggaattctttctggtatttgtaatattcttaact

SEQ ID NO: 89980 - DNA, 1025 bp, Homo sapiens
gaattccccgtgatgaaagaggaggaaaggatactcgcattcattatgtgaatagtttgtcaccacccacccactcacttgtgatttattccatacagcaccaccgtggtccagatatatagcaggtgtatcatgtggaagaaagctgttgacttgaattctttctgttgctttcagttgcctagacctggagcagtgttctcttaaggtactggagcctgaaggaagccccagcctgtgtctgctgaagttaatgggtgaaaaaggttgcacagtcacagaattgagtgatttcctgcaggctatggaacacactgaagttcttcagcttctcagccccccaggtaggttttgttcttaggattattctccaggagttcatggagccaaacttagaagaaattatctcttttgaccaggtgaactgtgttaagtatttttggaaaatgtaaatgtgtagtgccttgtttgctttcccaggttgaagcaaatgcaatgcatgaatattggttggattgtggttgaagaaaccagctacatgagacatttttgagatagttggaaaaatttgaatgtaactacatatttgatatattaagtaattatcatatgataatgatactataggagaatgtcctttttttaaaaggagatgcattttaaagtatttagggagaagattcctatgacatacattggaatagtgcagccaaaaaaatgaacatatatttattcctatgtatttatatagatgaagtaaagcaagtatgacaaatgtttaagtttttttttgccgcagtgaggcttttgaatgttgattaactcaaccttgtactcttatgagtttttcctgaattaccgatattggatgaggctttgtacttcccacatcaggcgaggcttaggaaacagtccctcttctccattcagctgctctcctctcagctgcagatagagttggtctacagcagtggtggagggcaggagggacatgccattgaagttgcctggttgtggcagcactg

SEQ ID NO: 89981 - DNA, 1035 bp, Homo sapiens
ttcttattccacaggaagtctgatgattttcctctgtccttacagagagaagcctggtttgggttatgctgtgaactggcctttgaggtctaaatgcagggagatggggaaactttagatttattttgattaaacgagaaactatagtcttacgttgccatattctgttccaagtgacggtggaacaacagtcagaggtagctctgaaaggtaactgtaactgtcatgtggagtttctctgtcttttgagaaactgaccaagtttcttttctggatttgttttggtgcccagaaatagctagagcagtatccatgcatctctaactagagcagtttctgtgatgaggacccagcttcagcagtcactcagcatgtagtctgagtgtaaactcactctggaattataattttatatattttgtgaaggagcctcagaggatcgaggtttttactctctgttgctttctttcttgtcgagcatttccactgcacatgggttggccaacttgcccctcagtgtggtcttacttgaattatatgatagagaaatcgcttctagtttttatttgtggatggtgttcatcccattttccagcgctagtaaattgtttccctacttttattcctttgctcatctcagtgggaattgtagaagggggttaaatggatgtgttgaaagggttttgaaccaaaggtctgtaatgatttttttttttagatcttatttaagtttcaaagactgattccaaagcaaccaatattgacatctgtatagatagacttagatgtgtagttcaaggtgcttttgtttcttttgttgttgttgttgtttgtttgctttttgagtctcactctgtcacccaggctggagtgcagtggcgcgatcttggctcactgcaacctcatctcccaggttcaagcgattcttctgcctcagtctcctgagtagctgggattacaggcacgcgccaccacacccagctaatttttatatttttagtagcgacgaggtttcaccatgttggccaggctggt

SEQ ID NO: 89982 - DNA, 1599 bp, Homo sapiens
cttcagtggcatgtatttgaccagtagtacaaagttatctcccgacagtagtggacacacaactgatgaactacatctttccctacatggtgcttcaggtgcggggcgggattttattttatgtatactagagggtgaaagcatagaatccagaaggagactccctaagttagtatccagatttgctacttactagcttcataactttgggcaagtgactttaatctctctctgccttaatttccttatctatataatggggttaataatagtaggcacctcatagggtagagtgaggtttcattagatctgttatatataaagcatatagaacggtgccagctgaggcatcaggaaatggtaactactgctacttcctattgtgaacaccaccatcgtttttttccattcaagagtgtttttattaaaaatctgaagagtagaaactatattctgtaagtgatgctgctgatgttatatacttttcatgtatctttaactctggaaatataccatggatcttacatgttttgcttttttatctttgtatagataataaagagcaaacaactgaccagcctttgggtgagtagaactttaaaatgcattatcaaagtataattattgtgtataactccagaaggaatttaagacattttaatttggttttttaaagaaatgtgaataacattgggaccaaatgttttatttttttgtatctgtaaaagaaggtttagaagaggaggcttaaaaatgattacaaattcagtttctagggtcaagtcaacttctgtggagtgatttgtgtgtttctcacgatatgcaaacagacatgcgtacaaaaagaaacatgtacatgctgcatagttagcatagaggaggaagtggttagtgctgtctcttggtgagggatagaaatcacaaaggctgcagtagctttagcgtttgctcccctgtcttctccaatggaaagagaaaagaatttaggataaaatgtaaacgaacagttgcatttgaagaatgcctgggacaagaaaatgtaagggagaaaactttagcagataaaagtttagcagattaacatttaaagatggtaaaaatagctaacagcttgatgctggcagaagccagataaaatatgtctaaaatttgtccattggattcagctactgaagatgtgattggtggctttgagtggaatgttgaaagtgcctaatatgtgtcagttactgagttatgctgggaatttaaacatggatacaatgtataaaatagtggaaaaagaaagattcagaagtgaacaaatgaagacagtacatattaatttgttggaaagaaagagtggtttgaaattaactagatagggcatatattcaaagtgttttggtaggaggggaaaatgtgaggatatttacatttggaaaggaagtatctgttgagactgtgtagattagagtgatccatcaaagagaggacaatttatagagcaagttcctagaagagatgatagggatttgggccaaggtgaaaacaagagaaattggctttaatcagaatgttgaaacctcttttgagattaaaaagaaggagagattggtg

SEQ ID NO: 89983 - DNA, 1123 bp, Homo sapiens
actctgatgggattcttcctgtcccttttttagttatcttgtttttagcctcttccattctcagcaaaacagaacctaatttgatgggaacccaatttcaaatattccttgtttaaattttctccaaaagtctagttgaatattatatcccttttgttataatttaataaaagtaaactttaatattaattactgttatgtttcatatacagctaataaatatcctttgcctggctctcaaaagtgtgaatatgcttaatttcagtttgatgattttagcatctgtgttcctcagagaatattgatctgcttacataaatagttctaaaatgaaattaaataatgaaatcttatttgaaatgaaataatgcaatcttaaagcatactttttattataataccatctccataggttttgttttaatctttatatcttctttaaacaccccctttctttttttttcaaagcgaaggacaaggttgcccttttgataggaaatatgaattaccgggagcaccccaagctcaaagctcctttggtggatgtgtacgaattgactaacttactgagacagctggacttcaaagtggtttcactgttggatcttactgaatatgagatgcgtaatgctgtggatgagtttttactccttttagacaagggagtatatggtaagatatttataatgtttgtttttacaattatccattattcttttcattatacaagttaggttaagaattgaaaatcagataaagataaggtaaacatgttgttgaatggaagagttttatttttcttattaagatgatacatttgatcttcattccatctgaataactaattagcttcatgtctttacttttatgtttcctgttttgtcaaaacatatttttcttactagaattcttacctgtcttttgtgatttttttttaattgatagagccacagtataataaaacttgataaccacacagcaaaatttacattcatatgcgtaaaatattacagtatgtggggttttctttgaggggggtagcataaaaggttctagtagaatgtatattttgtatgtttccttttcctaactattgcatggtcttttctagtcttttagtgag

SEQ ID NO: 89984 - DNA, 1013 bp, Homo sapiens
cccgggaggtgaaggttgcagtaagccgagatcacaccactgcacttcagcctgggtgacagagcaagactccgtctcaaaaaaaaaaaaaatagaataaaataaaataaaaacacgaaaattagctgggcgtggtggtgcatgcctgtaatcccagctactcaagaggctgagacacaagaatcgcttgaacccaggaggcagaggttgcagtgaaccaagatcacaccactgtactgcagcctaggcgacagaatgagacttggaatcttggtctcaaaaaagaaaagaaaaacataaatgagtttcatgtttagacttgggtggcatccccaagataacctcattatgtatacgtaaatattccaaaatctggaaaaaaaaaatctgaaacacttctggtcccaagtctttcggataaaggatactcaacctgtattttcaatctggcatcaggggtgttgtttgtttttatattatacaattgatctcagcttttaaggtgcctacgtgacataaaaaggaaaaggcttccaaaacttcactagaagtgatgaggtgtaaggaaaaaatattgatcagtttaggtttctgtattggtgaagtatttaaagattgagggaatcatatgaagaattactaccttggttgtttattctcatttcttattgatattttcaccttggcttttaagccctttgtttgacttttaaaaccaaatcctgtggccagggcatggcggctcacacctgtaatcccagcactttgggaggccaaggcgggcagatcacctaaggtcaggagttcgagaccagcctggccaacatggtgaaaccccgtctctactaaaagtacaaaaattagcccagcgtgatggtgggcacctgtaatcccagctacttgggaagctgaggcaggagaatcacttgaacttgggagggggaggttgcagtgagccaagatcatgccactgcactccagcctgggcaacaaagcgagactccatctcaaaa

SEQ ID NO: 89985 - DNA, 1253 bp, Homo sapiens
atcactatagttattccctcaggaattaacaaaaccaacacccatggagttgggatctctgctcactagtcagtcctggtcttccagacatggaatgagtagccgaagcagatgtttggaggtttggatcccatttgtctgccattgcctttctaaggagtagaaccaatgactgttcctctagatttactatttttttgcttgctcagcatttaccaatcaaaatccaatgccagagttcaaatgcaactctagttttaaagctaacaaggagttagtgggttattttgggtagatatgtagctacctagatgaaaaattttgaatctataattttaaattatgtattctaaaaaactgttgtattttctcattatttatacccttttaagaatgctctttaacttttcatatttctatctgccctcctccgcctcccttaaatagaaatgactacgatgataccattccaatcttggatgcactaaaagtcaccgccaatattgtgtttggatatgccacgtaagaacatttgatgtttacgttgaagtttcctttattgtttgatgtctttttgtttttgctttttaggagcaggggtcttaactctgtcacccaggctggagtgcagaggcgccatcatagctcactgctcctgggctcaagcgatcctcctgcctcagccttctgagtcgctgggattacaggcatgtgccactgtgcctggcccctgagggttttttgattatagattagaggcctagaaaatacctatagacatgtaggcataaatttacctccttgatattctgcgtagaaaattttaaatgatcgactttagcattccatatcatggtatcttaattattaagcccaaattgggcatgtaattcctgcttaaagattaactctttaattatcaatgtcatgtgagaggcagaagagaaaatgaagcttattggtgtatacagaagtcccatgtggcaagtgtttgcttttctaacattttctttttaaaaaattatttttattggatattgacaagttataattgtatgtatttatgggatacaaagatatgctatgatgtacgtattcaatgtggaatgattgaatcaagataattcacatatcacctcaaatacttatcttttttcctaactgaaacattgtaccctgtgactaacagtccccacgctgtccccacccccccccagcctctggtaaccaccattctgctgggtgcttctctg

SEQ ID NO: 89986 - DNA, 1052 bp, Homo sapiens
acgtaatattctgttatgcaaacatactacagtttttttcaactactctcctgtgttggtgagcatttgagttagttgtaggtttttgctatgttaacagtgctatcattaacagtcttgtgtatgtctcctggaatatgtatgcatgaatttctttgcagtataattctacaacttggaattgctgggtcatagggtgtgacagtattccattttgagagagaatgccagacagttttgtaaagtggttgccgagtctacacttaaccctactccccacggccagcaagggataatgtgaatctgtactctctccatcacttgatagtcagacttttttatttttgccaaatgttaaatagtatctcatgtgatattgaacattgttcatatttttaatagctatatgtatatcttatgtgaaacatctttttatgtcatttgtgcattcttctgtgtgtgtgtgtgtgtgtgtgttttggcttattgatttagaggaatgttgtatgtgttcttgatataatactagcgaggaccgctaagacacaattgaataggtagttgtgggcatccttgtcttgtttctgactttaaaggaaatactgctaatgtcttcacatttagaataatattgtaagtttttttattaacactttatcaggttaaggaagttctcttaatttttttgaaaatttttattatgaataaatgaacaagattaaatggtttttctgcagctatgaagaagaaaataggatgtttcttttctttcaatttcttaatatggtgagttaaatttatagatagtctaacattaatccaacttgagataaatcactttcattgggatgtatatttttaatacactactagatttaatttgccatcattctgtttagaattttcatatctatattcatatgggaaatgggcctgtaattttactttcttatagtatttggtttaattttatgagaaaataaaattagtatttagtggtatcagtgttatcagtatcagtggcatacagagtatcagtgttatctgataga

SEQ ID NO: 89987 - DNA, 1446 bp, Homo sapiens
ccacgttggccagactggtcttgaactcctaacttcaagtgatccatctgcgtcatcctcccaaagtgctgggattataggcgtgagccaccacgccgggcccagatcattttttaattaaaagttaataccccatctctaataatagggaagggtaagtttcctaagctgcactgcttggaaaatgttttccctgttcatctagagtgtaagaaagatctctttgactttgactactaacagtagtaagaactagaaattctaaatgggttgtaagtattgcatgaaggaaaaggaagataatgatagctggcgtttctcagtttcagggagatataaaggatgccttgaggatttggaacctgggaaaggagagtgagtggatttttgggggtgggggtgtgtatgtgtgaatattttcagattgatatatattcactgttgatgccaataataaaccagatttttttccttttcaggaacatctagtcttcacagtatgtttatcatatcagtactcaggattggaagatactgtagaggacaagcaggaagtgaatgttgggaaacctctcattgctaaattagacatgcatcgaggtttgggaaggaagacttgctttcaaacttgtcttatgtctaatggtccttaccagagttctgcagccacctcaggaggagcagggcattatcactcattgcaagacccattccatggtgtttaccattcacatcctggtaatccaagtaatgttacaccagcagatagctgtcattgcagccggactccagatgcatttatttcaagtttcgctcaccatgcttcatgtcattttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattacattatttaattacagacttcctctttctaagattttgtgaattggttgaatagttctatacaaatgaagtatggaggtgtgtatgtttatatgtatataacaaaatattttcattgtgaccactctgaagtaagagcaatgggaatggcattattgtagaataagtcattgtatttttaacaccagaaagaaccttgccgatcaccaggcataacctaattttatccatggaagaaacacagaaaggcatctaagttagagctggcaccagaactgagacctccagaaatctattccagtattttttccactacacaactgccttcctgacaggttctgagataagtgttatgtttgtagatagagtg

SEQ ID NO: 89988 - DNA, 2034 bp, Homo sapiens
gtagggacagagaaaagtgggtagtttctatgagccctcccttcaggagtcaaaggagagccagaagtacggggattgggatcctggtaaagattcatctgcagaaactgggccaaaggagaaatctgtagagaactttataagatttcctaaccctttgtaacttttttatattacatctgggcttccttaaaagaaacttgtgtttgggtttgttctctgctctctaagtcctagaggaggggaagagaaagaagaagaacctagggaggtatctgagaaaggaaaaggcttaatcctttgagggcctacctgaaggagaagggaacacacaggaaatggggacccagttcctcctgagaaggaatctcactggtctcctgcagtgcagacactaccctgagcactatgcatgcgctaatattgacttcatcttcccatcctgccctcatcatccctgccatcaccaccacttggcacaatgctttgtacatcccataactgacattaattatcagtgaactaaggaatggataatgaacccagaggcacctaaaagtaaatatgtccccaattaaacctaagctcttttgctattgtagtggatacagtagtgttttgtctaggttctctcttcagagtatacaccctcatcccctagctgctaagaatattggctgccgactactcacagctgactccctcactgcaaattgctttggccaccgtcttgtgacagttcttggaaactgtcttgcccaaggctacacccacttccaagaagcagccaacatctggctgatgtagagatagaaaaacttggccctcttgcctttatttgggccaactctgaagggccatcccagccccagagctccctgtaaattggctgaggcctcaatcaccatagcactgtgggtcaactcctcctttctaatcctgccttcctcagtccttcacaattatatctccaaagattattcagggtctgtttccagcaccgcagcccgagacacccacccacaccagattcatctccacagtacctgccctctcagaaaacgaccctcattccctctcatctgctccatcaccacaggctgggagggttccacctctcaagtgtctattgatcccaatcccttctctcggctgacatcacgcacacacaacctcaggcccatcatcccagtgtggaactggtcactgagtccttgcctccaacctggccaacgttcaatgcattctgcacactaaaccttgaggaatctctccaacgataccatcttgtcactcctctgctcaaatgtttccagatgactcaattgtccttagaatgaggtccagattataactgtgacttagaagtttcttcacgattcgacccatttgcctgcccatgtccctgcccctccatcctcacatttcaagatccaggcttgcctttttgttctttgaatatcacctacttcctgtcactgtcaggctttcgcacatgccggccccgctttctggaagactctccttacccttcacaacctcctcatctaagtcctgtgtattggccaggtgtagtggctcacacctgtaatcccagcatcctgggaggccaggtcaggtggatcacttgaagtcaggagttcaagaccagcctggccaacatgatgaaaccccgtctctactaaaaatacaaaaattcgctgggtgtgagggcgggcacccgtaatcccagctactcaggaggctgaggcaggagaattgcttgaacccgggaggtggaggttgcagtgagctgagatcacgccacttgactccagcctgggcgacagagcaagactctgtctcaaaaaaaaaaaaaaatctaaaagttaagtgctcagaacaccaggattaacacctataaggtttggggttttttttccaatgacaaagataaaagatgatcaaatactttaacattttctgctaaacttaacgatgactattttgaagtctcttttgaggtttcttatttaataccaaaagactagaagt

SEQ ID NO: 89989 - DNA, 1023 bp, Homo sapiens
cctcaaaagagacttcaaaatagtcatcgttaagtttagcagaaaatgttaaagtatttgatcatcttttatctttgtcattggaaaaaaaaccccaaaccttataggtgttaatcctggtgttctgagcacttaacttttagatttttttttttttttgagacagagtcttgctctgtcgcccaggctggagtcaagtggcgtgatctcagctcactgcaacctccacctcccgggttcaagcaattctcctgcctcagcctcctgagtagctgggattacgggtgcccgccctcacacccagcgaatttttgtatttttagtagagacggggtttcatcatgttggccaggctggtcttgaactcctgacttcaagtgatccacctgacctggcctcccaggatgctgggattacaggtgtgagccactacacctggccaatacacaggacttagatgaggaggttgtgaagggtaaggagagtcttccagaaagcggggccggcatgtgcgaaagcctgacagtgacaggaagtaggtgatattcaaagaacaaaaaggcaagcctggatcttgaaatgtgaggatggaggggcagggacatgggcaggcaaatgggtcgaatcgtgaagaaacttctaagtcacagttataatctggacctcattctaaggacaattgagtcatctggaaacatttgagcagaggagtgacaagatggtatcgttggagagattcctcaaggtttagtgtgcagaatgcattgaacgttggccaggttggaggcaaggactcagtgaccagttccacactgggatgatgggcctgaggttgtgtgtgcgtgatgtcagccgagagaagggattgggatcaatagacacttgagaggtggaaccctcccagcctgtggtgatggagcagatgagagggaatgagggtcgttttctgagagggcaggtactgtggagatgaatctggtgtgggtgggtgtctcgggctgcggtgctggaaacagaccctga

SEQ ID NO: 89990 - DNA, 3286 bp, Homo sapiens
ttgtgggaggtaagtgggggaaggagaaggagggggaaacagtgtctgcggtgggctgtggggtggaggggaggggggatgggccctgaggggctctggggtgcttgcgaggtgagcatttccaaggctgtgtgctcgtggggtggggggacacacgatgaccttctcctcctcaggaagacctaagagggaagagcaaaccccagcgagatcccccctgtgctgatgattttcagggacttgttggcaactcagcgagggttgccatagcttttttatgtagggtgaccagaaccggctgaaactggtttgaggcagatcagctcctgaacacaatgcagtcactgagctactacagtaggatagcagcttcctcccttcatggcagccaaaagcagaggagcttgcaggaaggtaccatccctacacagtatgtgaatgcacacttagacaccacacagcactggtacgtgactaatggagccctaaaagattctgggtagagaagatggaaaaaaaggtgcaggtttgcagggtctgagattacttgggcttttcctgcctttttcttttgcttaagggatggacaaggagctgagatttatgacccttattagagaaaaaaatgtgccttgctagggtggggacacttggttgatgcagtctctctctctctttctcggtgtttataacaaaacaaaaccaaaatgaactgaggggtttgtaatggtagtttgtttgttgctggagaatgctactttgcatgctttttttctcttgcagggtatgttctgtcttgtgctttttcttttagaagctactaaagggtgttggggatgcttctgactattatgaaggccaaaaggtaacaatatcgttctaggaaatgaacataaatgcattccagtgatgctgttagccatacatgctgtcttttttttccttgtaggcctgttgactggggctgcttttaaccctttcctatttgctgagaatgcagccgtgtgacagtaactgaacattggtctaaagtctttccaaaaggtcaaggttcacaaggtgagatacgctgttttgagcatgaatttaaatatttatttgcagatccatttagacacagacggaccgtggattgctacccaggagataaaattgggttcagagtggagaagaaatgctcttaatgttatcccagtttaatgggattagagtgactttatgatggtattgcgatcaaggcgaaatctgaatgccttcattaaatcgcatgtgtctgggcaattgggagagtcaggcctggaaggaagcgagtgtggagaatggtaggcgtcagggccttgtggagaatgtgctgttttgcataagacgaaagcagtacacatgtggcattttcccgatgattataagaaaaggaagggcttcaccaaatcgaggcagcctagccacctttttaggatttgaggagtctgaaggtagatttgccttttgttcattcatcacctttcttttaccttgctctcttgtgttaacctgaaaggtttttcactccgactcaagtggtggaatgtcttttattgattttgggggctgttgacggtgagttcgccattggattctttgtggcatatgtttaatgtggaatactaatgcaataccagggggaagccgggtagtctggcttcatctgtgaaaagatgcctgttaactcaaagctgtactggaatgggtggtagaaaatgtctgatgcctttaaagatcgcagttaggtttgagcaggcattttaatgcaccttccaaaaccagaggttggagaggagaggagagaaggaaggagtgaggagagtagcaaagtgaagaacaaaggctgagggggcttgcaggagaacactcaacattttgccttgggttccttgtgaaaagaactgcaacttccccaaacaggaaaccagcagctccagaatgggatccagtgtgatctcaacaacagatagaactggtcctgcctttctgctggtttttggtaaaagtacagtcaagaggagcccatagaagacatgactgaaaataaaattttcccctacttcgaagtgggcattttgttcctctccgtgttcagcagaataggggcttttcagcagtgccgaggatcttggaattggttaagttgtgtgctggcagttggtgggcaggatatctgcagtgaaggacgtcaagtatgcaagggttttattgttaaaatgtttttcatttggctacagaacatccactatgtgataaaactggcaaaagggaaacaagagtgcatggttagctcaggatactttatggagtatttaatagagataaatgtaatcttggacggatataccagtaaatagcttacatgatggaacaaaattctttacaaatcactgtgctaaaattggttttcaattctccatcatttctgactgccagaggttctgtgtatgagtgtggcaggaatatgcttgcaaagcagatccgaatccacgctgcgcgtggtgtgctgcttctgcgtttctgatgtcaactaaaactcagatggctaatatgataaaccttaattagcttaatacaataagctgttttattatttagtccttcattcttgtcttttgagagtcagtgatttttgtttaactttgacagctaaccccttgccacggctatacagtgcgaatatgttttaaaaaacctcttcgtagggcattgcatgtcatggaatgttctggttttctgtcttggtggtttttagctttgttcctctccctcccccttgaagtctcctgaagatagcatttgttttgcatttagaccaatctttccagctgcaaatgctgctgagggttggagagctggttctctggggcgggagtcatgagctcatcttggattggagcttgtctcaggtgttgatctcatgctgaggtataacaatgtagcaggcccaggcctccctggagtggggagagtcttctgggctggggaatgtggatgtgagtgtgcaggatgagctagggcatgttccttcctgggagagccaggggggacccggtgcctgcagttcctgtcaccgtggagcccagagcccagcccctggtcggcagtgcctgtagcaggctctaaagacgacctgcggtccatcccctccggagcaggaatgtgtgggtttggctgaggagagcacactggaaagaaagtgtaactgggtgttgaacccttcttgtttttatcctttgcctattcaatcattttttccatgtta

SEQ ID NO: 89991 - DNA, 1051 bp, Homo sapiens
cagcgcaacctggttcaggagcacacacgctctctttttcttctgttcttttctctcagcgattccctgcccccacccaccttgactcattttaaggaaggtctaggaaggaggttgccaacttgtcagtagaatcttctgatgcctttgactgtgagttagaattttagggtttgtgttctcccatctcccatttatttcttctcttgaaatgttctcttggacttttccgtgcaatacagtcgctctccagttggctttgaacaacctttaccgtatccttggtagaactccagctggctgttaacaggtgaagcagaggttgccaacacaagggaaactgactccattccccatcatgtactcctaatcccaggaccatcagaacaagaactacagacttgataaacattatggaaacacacaccttcgtgttcattttattttagggctgatctttaactaagtcatggttaaagaattagcttaaaaaaatttaaaatttgtgtacaggaaaatttactctgtggtgtaccgttctgtgggttttggcatatgtgtagagtcacttatccaccaccacgggcgaagcagaacaggcccatcacaccagagcatttcctcttgccgcccctctgtagtcagcctctcctacccctggcatccactgtctcactatagggacatggttctctcgtcctagagtttgggctttctagaatgtcagatagcaagatgcgtttcagattcatccatgtttctctgtgtttcgatacttggttctttgtcattgctgagtagtattctgctgtatggatgtaccacagtttattcatttgctgggtgaaggacattagggttgtttccagtttttgctaattgtgagtaaagttgctgtaagcatttgtgtgaaacaggtttttgtgtgaacataagtttttatttctttttgctaaatgcagtcacgtgtcgattaatgcaggggtacattctgagaaatgtatcattagacagtcttgtcattgtgcaaagatagaatgtacttacacaa

SEQ ID NO: 89992 - DNA, 1092 bp, Homo sapiens
accatgcctggctaattttttgtatttttagtagagatggggcttcaccatgttggtcaggctggtctcgaactcctgaccttgtgatccgcccgcctcaacctcccagagtgctgggattacaggtgtgagccactgtgcccagcccaggttgttttttttttttttttttttttaaggataaaatagctttcaggattgggaagaacagacaaaggtaatggtggtacagatggaggggagcccaagaagtgggacatgatgttaacctggggattgccttgtcatttaacagatgcttactgagtgtttaagcactgggcattgtgctaagcacaggagtgcagagggaaaagggccccagggagaaaaatctagtggaaggagcccccagaagctatgataggaatgtgaataggccgcctcatgccaagcgtccacagaggagctgtgaaagactggtaagaatatgtgaggcagtcagagcctgggagagcatctaagtccatgcagcacacgtggaaaggtctggggagagcttggtgtttcgagtggggtgtgggtgtgcgaggggatggagctggaaggcagttgagggtcacctgatgaggccttttggtgcagtgccttgaggatggacttctgtgtaggcagaaaagacggacctttcgttacaaaggtcctgtggcagccccatggaggttggaatagaggctgtacaggctggaggtagggaggccaaagagggaaccggcaatccaggagagaaaggatgagggtctttcatcccaggtgttgtttgtggggatggagtggtaggtgggggctgcttcaggggccaggtagtgcctgattggaggagtaaggctgcttcttaggtggctgtctgggggttgcttggagactgggtgttctgtctttgagatagcaaattccgaaggcagaatagatttggaagagtggaggtggagggacttgatacagtgagttcagttttgggctccaattgcctctggctctgtgagtctggaatttaggagggttgcttgggctggaggtcaagattggtagtaatgaacataaaacagagag

SEQ ID NO: 89993 - DNA, 2002 bp, Homo sapiens
ggttgggtttgggtcccctaagatagtggcttacgtagtaaaaaccataaacgaagcggcaggggtggctgaagaacttagaacctgtgctttagcaagttggagggcagaagattcccaggaaggtagaaaatgtagctaaaacctgcagatgctgcagtaggtgatggcactttacgtctgttatcccatttttctgatttttaaaccttttcttagaggtggggtcctgctatgttgcccagactggactcaaactagctggacttgaactccttggctcaagggatcctcctgcctcggcttcccaagcagccaagtagctggcactataggcatgcaccaccgcagcagctattatgttacctcatttgataccgaaatgatgagaggagctgtacatgtttttccctgtggtaccagtggggaaacagacagagaccctcccagctcgtaagtggaagtggaaacaggatttgaaacatgctccttctcactgtgctgttctgccttgggggagcacagttggtggactgaggggtgagcatggaagctgtttcagggtgtggaggtgcccagagagggcacagcaggtgctaaacagcaaagacactggcgccgttcacgttggaggtgatagctgatgactgccagcgtgagaatatgcagtggagaagtttgaggtacactcagggcctttgtatttagccagattttcctgattgtagtcagcacagagagcagggcatctgtatttgcaccagagacatctctagaaatagcatgttgaaaagacttattttattgggcactggggtgaggatacagattggaggggagaagggctagaaagatgtatttgttttatgtattctttgaaaaggctgagaaaatcaaagcaaattgaaagtggtgccgagaagaatcttttgttccaacaataaataaacacagtttaaagaattctttgaatcatcttctacggcaggaagttctatattctggctgttttataatgagggagagcaaattctgtttaatctaaatctggagactgaaataagtaatttttagacagacgcagagcggcttttttagctgtctcacatattccttatgaaggatcactctttaaggatggtcttcaggggccccaaatgcagattttgtattcttctgttttcagtcagttattattacagctttacataattagagcttttagacatcttgagtgatccgtagagacctaaagataaaatcagggtgttgtggttcttgaactgttttcttaccatcagcctttgcattttgggacacaaactcctcctttccccaaggctgactcccggggctagtaatgggtattgattttatcattttcttttgtgaggaacaaattctttctagggatttcaatagtaagaattagatagttgaaaaacctaaaaaggttagaaaattcaaagccctctgttttaaaggaccccatagctggaagtacttcacacatttgtagttatctcattttctacagtgagcccacattggagggtggggccatcaggtaaccaatagcaggtttagaactggaacccagcactatagtcctagcccaagaccgcattcatcattaccttctctctgccttccaacatttatctttttttttttttttttttgagaccgagttttgctgtgtcgctcaggctggagtacagtggcgtgatctcggctcactgcaacctccgccttccgggttcaagcgatcctcctgcctcagcctcctgagtagctgggattacaggcatgtgccaccacgcccggctaatttttgtatttttagtagagatggggtttcaccatgttagccaggatggtctcaatctcctgaccctgtggtctgcccaccttggcctcccaaagtgttgggattacaggcgtgagccaacacacccggcctaaaatttatcttatgttttatttttttgaggcagggtct

SEQ ID NO: 89994 - DNA, 1286 bp, Homo sapiens
gatttgattaagttaagctttaccgaggtacttgttgagaagctggtctttgatgattttgctgatttttttttttgttttttctgggatgaagtcttgctctgtcgcccatactggagtgcaatggcgcaatcttggctcactgcaacctctgcctcctgggttcaagcagttctcctgcctcagcctcccaaatagctggtattaaaggcgcctgccaccatgcctggctcattaattttttgtagttttagtagagacggggtaacaccatgtctctatctcctgacctcaggtgatccacccacctcggcctcctaaattacaggggtgagccactgcacctggccagttttgctgatttaacctagcaagaatgggagaggtaatttgaaaactgattttactttgtgttctggtgaaatctgagtgataaaggccacggagattttcacttgcctttgcccagctctcaatgatataaacctgattgcctgtcagtgatgtaaacctgtgttttgccacttactagctgcgggaccttgaacaggttatgtaaattctaaaccatacgtttcctgagggttgttaggaggattaaatgcatatataaagtgtttagcagaatatgtggtgagcccttcctacaatcttagctgttgttttgtggtctttggtctctgttttgggagagtagccttagtcccaggactttttttttctttcttggagggtattgtctcctgtcctgccttacctcattggcaagtatatttgtttttgaccatgaaaacagactgtgtgtctcctccttgtcgctagagttttagttacagctgccctatatcaggttaaaagtgggtgaagtagacacaagggtagtgtatttgttcctacttggctctactttcatttgtggttggagaatcttgtctgaattttgtatttatttatttatattttattctattattttttttgagagatagttttgctcttgttgcccaggttggagtgcaatggcgcgatctcgcctcatcgcaacccctgcctcccaggttcaagcgattcttctgcctcagcctcctgtgtagctggggttacaggcgcccaccaccatgcacaactaatttttgtttttttagtagagactgggtttcaccatgtcaggctggtcttgaactcctgacctcaggcgatccacccgccttggcctcctacagtgctgggattacaggcgtgagccactgcgtctggcctgaattttgtatttgtaatctagtact

SEQ ID NO: 89995 - DNA, 2404 bp, Homo sapiens
actccacctttgatattgtgatccctttgacacttgtagtcggatcagatggaaaagaattttaatattgtgattgcatccaggagatggggcaaaggtgcctgttatgacttcatgaagactgtcaggccttaggtcagcacagacaagtgactttgggcctagtgcaatggctcacgcctgtaatcccagcacttcgggaggctgaggctgaggtgggaagatcacttgaggccaagagtttgagaccagcctgggcaacatggtaaaccccgtctctacaagaaataaaattagctggctgtggtggtgtgcacccgtagtcctagctacttaggagactgaggcaagaggatcacttgagcccaggagttagaggctgcagtgagctaggatcacactactgcacttcagcctgggcaacagagtgagaccttgtctcgagaaaaaaaaaaagcagaaaagaaaagtgactgtgtttggttcacggattcagtatccagtgagagatgcggactgaaggcagttagcttgccaccgtttctgcccccttgcctgatgaggaatagaggtgacttgggagttttccttagaatgggggttagaagagccacttcatgtagcagtgttggaaaacggctagtcacatcacctctccagcacgtgatggagacagcctccattgggtccttgggtgaagctgtcctggggaaggttgccttggggcctggaccaaacaggagattgagttgcaggaaggagttcactgtgttatatgtttaaactcttatgtaagagactggagaattttacttagtgggtttattttactttgggaaggcacattgattaaatcagctatagcaataaataaatgtctgttgcatgagttcagttttaacttccccatctctctacaagaaagtctgccatttcacagaaattctagttgaaatttagatcttactggacatctgggcactgagagttctgtgttatatgaatctggcacattgaattggatttattaatcgttggctaagtctgtcaactccctgtgctgtgcagaatcctgtgcctggcatggtgacagtatcggctctgggcctgtgagtgtggcccttatggaatcacagattgttggaaggggagtggagtggggtttggaagaatagggacaaggttgggtgtgtcctaaggatggtcaaggctgtggggccagccctggattaaggaagtggaactatggaagttagtcacagttggggggtgagtttagaatgtagctagggcagaatgttgccatagcatgccaagagtcagggtaagttaaagagtcagagactgggcaggttggctgggcatggtggctcacacctgtaatcccagcactttgggaggctgaggtgggcagatcaatagaggtcaggagttcgagaccagtctggccaacatggtgaaacccagtctctactaaaatgacaaaaagtagctaggtgtggtggcatgcacctgtattcccagctactcgggaggctgagtcaggagaatcacttgaacctgggaggcaggagttgcagtgagctgagattgagccactgcactccagcctgggcgacagagcaagactccatctcaaaaaacaaaaaaaacaaaacgaaaaaaaaccactgggcaggtagaccttcagaggacatcagaaggccaaagatgatgggcacaagtccggtgaaataggcaaggacgggaacacatacagatgcaggacagatggccatgcacaagtgcatgatggcaggagtcggcagtccgaaagatctgtgatctgtggtgctgataggagaggcccccctgaaggactaccatggaatgaatgagtgagttggtgaatgaatgaagaccatatgagctaccagttccagtgatcactggataactgcagcctgaagtggagccaacttcacccagccttcacgtggagtggtgactaagggcccccgtggcccaggtggctgaggtgaggggtgtgcattgggagaggcagtagctccttgcctggcaaagttcatacgagaaggctctgaaagactagattgtttagagtttgcatgatttgtaggacatgatcaagctatgcagtaagaaaggcagctcattctgaggcccagggttagcagctgtcaggaggacctgacatcaagaactcaagcgtcatcttgcactaagcttactccgcattcttttgaggaccacatgcccttggttgtctcttttgcttcccccttagtagaacttctttcctatacacatgggcaaacaatgctgttccacagctcctgtgtctccatgtcctcattttaaatactagtggacatcacctgtagtcctctgtcctacttgcagt

SEQ ID NO: 89996 - DNA, 1072 bp, Homo sapiens
aacctgagggcagtcttgccctttaaatgtacattttgttttctgaagagaaacatggggcaggtatttttggaggctttatatattcagtaagtagatattccactgttcaagaaccttcacgctcacagcaagtcagcacaattctgtttttgacttttgagcaagaaaaggaaaacactggtcatgtgaattggctggagttgcttaatttggttattgttcgatgcatatttatttccggggtgatgcagccctctgcctctcatgtgtttggggtcagttgggtggtctggtgggagaagaggggaagaaagaaaatgggtagtctgctgcatcattgtgtgacctgtcatcttccacctgggcttaacacaaaaccacaaaccaaaacagaacccccacgctcacaggagggaccgtcatgcaggactaggcagtattgctggttgtggttagtgtcctcttcccaatcctagggcctatctgaaggctggagaccacaccgagtcggggcgagctgcggtcagtgccacttcctgaggaagtgactgaggcagccgggctttgtgaaagctgctttatccctgcgtcccccggggcagaggggagcagaaataatatgccaatggcttttcctgcggaattaaaggagccctccccaaacatctttttattagattagagctttgcgttcataaattatttctaactactctcctattctagttctcagaaaatggaaggagcagaacttcatatctttaaggattttctgggattatgctctaatctaaattatgaaaacttgatatattttaaaggaatttactcagttgaataataaaccacaatcatcatgagtattttattttatataggcagacagtataaaacttttagatagttcattaataaaggaaaattgaacattttggaactttcatgtgattttagcaaactgcaaatcagtcaaatattaaatccgttaactccatgtgaaagtaaagaatcacttagaatgtacaatgtcacgttttctaattttataaatataaaatcagatattttt

SEQ ID NO: 89997 - DNA, 1734 bp, Homo sapiens
cttcttcttcctcctcccccactccacctcttcctcttcctcagacctctttacctcttcttcccggtaggtaaatggttcctctccttcctttttttttttccttcttaaactatttttttagatatggggcctctgtcatccaggctggggtgcagtgatgctatcatagctcactgcagccttgacctcccgggttcaagtgatcctcccacctcagcctcctgagtagcaggaactacacgcatgccaccgtatcgggctaactgggttcaagcgattctcctgcctcagcctcccgagtagctaggactacacacgtgcgccaccatgcctggctaattttttgtaatttttagtagagacgggatttcaccatgttagccaggatggtctcgatcccttgatcttgtgatctgcctgcctcggcctcccaaagtgctgggatcacaggcatgagccactgcgcccggcctctctctttcctcttaaaaggaacctggaggcctggcctggtggctcacgcctgtaatcccagcactttcggaggctgaggtgggtagatcacttgaggccaggagtttgagacaagcttggccaacatggcgaaaccctatctctactaaaaatacaaaaattagctgggcatcatggcgcatgcctgtcatcccagctacttgggtggctgaggcatgagaatcacctgaacccaggaggcagaggttgcagtgagccgagatcatgtcactgcactccagtctgggtgacacagagaaactgtctcaaaaatgaatgaatgaaacctgggacgcttgtacttacgaacatttaaaaaaatcaggtaaaatggatcatgctttgtaagtgtgattaaaaagactttttactgttagtgttggtctgtgttcttgcatgtgttttaagctttttacctaaaataggaatttatttataatgagtttgactgaggatctcttagaaagttggttaaccttctctgttctgaccagtcctcgttttgttgttgaacgtgccatcctctttcccaccctggtgtgatactaagtgccagcctatgccagtctgccctccctcctaaagctggataaactcctgggttcacatttaccttgagttgggggaagtagtttattatttggaatagaacatttccttcaggccaagatcctttaggaaaatgaaagtaaaagtgctaaaataccagcccccactcacccataagcaaggctggtttactgtgaaatcaagaatatatagtatcttgatggatagagtgacagaaggtattcttggagacattttaaacataaaaattatgatttaagcgcatgagtaaattattttaatgtctccatttctctcatctttcattttatcgtgagttaaacatatatcttcaggattttaaagcaaaagagtgaaacacaacactgtgtctcaaagggttttttcttttttgtttaagagttatttttgtaagaatttatgaagaaaggttgttcttgtggttacttgctttggctttaaactctctttggagaatatcacaatctaaatttaaagggtactcttgaaaacactgttgaattgacatggagtgtctgatttgatggaagccccgtagacctggaacggtatctgggatatgttactgagtgtgaaaatgcctatatatgtgtatgtatatttatgcttatgtatgcatttagaaat

SEQ ID NO: 89998 - DNA, 2222 bp, Homo sapiens
actgcagtggcatgatcatagctcactggcagccttgagctcctggcctcaaacggtcctcctaccttagcctcccaagtagctgagaccacaggtacatgccaccacacctcactaactttaaatttttaaaatagaaatgaggtctcactctgttgcccaggctggtcttaaactcttggcctcaagcgatcttcccacctcagcctcccaaagtgttgaaattatgggcgtcacccagccagatccttgcttttcagtgcagtgtaactttcttccctgttaaatctagcagtgtttgttttttgttgttgttgtttgttttttaagtaaaatatacataatatttgtcatcttaaccataagtgtacagttcagtgagatgaaatatgttacccatggtaaaagttttccatcaccttcaaaaaaagctctgaaccaaataaataactctcccttctcaccttcctcctgcttgtggtaacttctcttctacttcctgtctcttaatttgcctattctaggcacttcaagtaagtgcagcagtttttatctggccaatctactgtgacccagtcaagccaccacccatgtctgggctgggaaggtggggaaagaggctgctgcacatgcttgggatgtcttcagccatatgcatctgtccatctgttcatccacccatccgtctgtccatccgcccactcagctatctgtttatcaaggtataacaatacagcttttttattcctctccctctgtaacctatttgggccttatttatgtttctcttcttataaaccacctcagatctttctgtagaggtatttattaagtaaaacaacaccaccacatgacggacataaatattgaaaagaccaatcgattggaaggattaatcagtagagggaggtgttttcaggggatttagacaggaggaagatagcctaggctgacaaatggagcagatgaagataaatcggcaaaataagtagggagacaagatccctgtcccatgtgaccatgcatttgaaagcaggcagcccagcgaggtagaggcatgaaaggctgtatggactgcgctcttcaaagggctgtggttttgttctggggtctagtcttaggttgtaagcttttttctcttctctttctgttttttcccccggggcttgaacagactcaaaatactcttagggttggaatttctctttgattctggtcttggttagcaggggtgggggggattgttatgaacatttcattagatgtgtgtgctcttagatatggtcagtttgactgaacagttgctctgtttctgcattaagcacgtaattttgtaagttttgtagctttttggaatataaagtagttgaatacttaaagctccccctgctgccttccctttatttttaacttggactgagcaaggttcttctaaatgcattgaggttggggggaaaaagacctaaaaaagaaaaatacactgaataatactttcacatatacacgaaacctgattttgcaatctaaaatgactgtttttgggttttcaattatggaacattttctgacaaataatagaatttgctgtatttcactgtaaacagttttgagaatgcactaaatgcaacaacaaccttaggattagttatcatgacagattggcattaggaaaaatgatgagtatattttatgttctggaggaatgagacttgaagagcagagcaatttttaagttgtttacatcgagggaagagatgtaaagttaagattggctgggcgcggtggctcacacctgtaatcccagcacttagggagcccgaggcaggcagatcacctgagatcaggagtttgagaccagcctggccaacatggcgaatccccatctttactaaaaatatgaaaattagccaggagtagtggcaggtgcctgtaatcccagctacttaggaggctgaggcaggagaattgcttgaattcagaggcggaggttgcagtgagccgagaccatgctactgcactccaccctgggtgacaaagcagtgggactctgtctcaaaaataaataagtaagtaaataaataaatgaataaagattattacttaactcctttcaacaatttaaaattttttgtcaaagtaatacatgtacatagatcaaaaaaatagtactttacatcataattcccttaggcagtgaatttgaattttttggtttgttctgt

SEQ ID NO: 89999 - DNA, 1068 bp, Homo sapiens
tgcgatctcggctcactgcaacctctgcctcctgggttcaagcaattctcctgcatcagcctcctgagtagctgggattacaggcatgcactaccacgcctggctaattttgtatttttagtagagacagggtttctccatgttggtcaggctggtctcaaactcccaacctcaggtgatccgcccacctcagcctcccaaagtgttgggattataggcgtgagccaccgcgcccagcctgcctgaagatttttaatgttttcctagagcaggtgaaggtcattgacaaaacataggatttagaggaacatgttgggagggaatatgagggctttagttttaagtttgacctcgtgtagggagagccaagcagaatatcatcccagcaatggaaagacgactcttaaggcagaattaggactaaagatagaaacccgtttgttctgactgttgtgaccatgggagttgctgaggttgcctttcaacaaaggtagataacaaaagagaatctgaagggactcatgaaaggagagaagaggaagagccagtgagtcaggaaaagccaggtgagcttgaggcagtgctgtggggtccacgagaggaaaggatgaccagaaaatgaaattctgcagaggtcacaggcaacatgaaagatgattagcagcaaaaacaggcacgcgggaacacggattgggaatggatcgttgctggagtgttttctggctgtgagactacactattcagcgacggcatgcactttcatttggacccaggaggaagggccactcagggaggcgctatggccacctcaggtcactagctaatagtagtaaatagggcagcaaggatttcatctccaaagctgtctcctttgtattatgtcacatagcctgggttttccctttttaacttttaggttgaaataattttaacttaaagttttggctgggtacagtggctcacatgtttgtaatccctgtgttttgggaggccaaggtggaaggatcactggagcccaggagtaaccagcctagacaacatagcaagaccctgtctctacaaaaaaaa

SEQ ID NO: 90000 - DNA, 1069 bp, Homo sapiens
catgcaccaccaagcccagctaatttttgtatttgtagtagagagagagagagggggtttcatcatgttggccaggctggtctcaaactcctggtctcaagtgatccacccgcctcagcctcccaaagtgctgggattacgagcatgagccgccgcacctggcctgaaattctcaagggtttgacagatgcacagaaacatgtctccactaccacatttgtgatacagaactattccatgagccctaaaattctctccttcagcctggtttgttttttttttttaagagacagggtcttactctgttgcctaagctagattgcagtggcgtgattgtagctcactgtagcctcgacttactgggctcaaccaatcatcctgccttggcctcccaaagtgttggaatcacagtcatgagctaccacgcccagccctgcctggatttcaatggtggttttgagagagtggattgtcagagtgctggggagatactgggaggagcaggatatgtcccagtactggagaacttgagccatgaaggctgcgtggcaagaggacagagcaccaagggttccagggtaaggctggaggagatctctctatgccactaggcaaatgggataggaattacccaaaatagaagggacagaccaagctcactgtggaggatcggcttggcaaagccagcatgaaggtacaggcaagatttgaaggaatgaagctgtgggagacctcttgactggtgactatgattttttaagttaacctcagaaagaaaaggggggatggagtttagaagagggagagattagtaacatctgcaggccacagccttaggccaggcagggttgctcaagcctttaatcccagcacttgggaggggaggctggaggatcactcgaggccagtttgagaccagtctgggtgagagcaagaccccatttctacagcaaataagaattagctgagtgtggcggtgcttgtaaggatcacttgagcccagaagttcgaggctgcagtgagctatgatcatggcactgcactccagcctggacagcagagccaggtc

SEQ ID NO: 90001 - DNA, 1036 bp, Homo sapiens
tgtaatcccggctactcgggaggctgaggcaggagaattgcttgaacccaggaggcggaggttgcagtgagccgagatcacactgctgtactccagcctgggtgacagagcaagactccgtctcggaaaaaataaataaataaaataaaagactattattgcctttgaagggagatgtattttatagggcataagtgaaagacattgttaaaataactaaagctaattctgtttgaaaatcaaactgttgagggaaagggaagctaaaatgagatcgttctattttatcttttaaaagagaggactgagatttatttttgtaatgtttttaagcaaaagaatctatttttaagacagtagtacttaggaattggggtggaaagcgaagaaaactttcagacataaacattcctctttgtattcagtataactgagaaatgaagtgggagttatacatttttttcccctccaagtggaatggaacacttgctcttgccttccagaatgtgggaagggaaagggtaataggacaatgtgattgtgggtatgaaaaacattcctataaaccaaaaaagaagtgtgaagttacagagtggtatccattccattagttatacaaccccagagaggggagtccaggcaccacagtgatctcgggtttcagacgacacgatgcgctttcggttggccactgcactcagaaatgcccattatgcattttcagcttctagtcggccttcctgcaggtgaactaggatgactgactcactttttaaaactaccatcagttcactctgacctcttaccacgtcccactgcttcacgctggactcccccacgtcccccatgagaagagtataaaccttaggtggagtagagggatggggacagggtgaggctggatcactgtggagaaagagttgcttctcaaccccttgaggggtttgcaggcatgggagttcctctctggggccttctagatcctaactctgctttagctgggcaggtaggaaaagatggggtgatgtggaggtca

SEQ ID NO: 90002 - DNA, 2395 bp, Homo sapiens
taagagagaaacagaagccagttctataaacctgagtgtttatgaaccttttaaagtcagaaaagcagaggataaattgaaggaaagctctgacaaggtgctggaaaacagagtcctagatgggaagctgagctccgagaagaatgacaccagcctccccagcgttgcgccatcaaagacaaagtcgtcctccaagctctcgtcctgcatcgctgccatcgcggctctcagcgctaaaaaggcggcttcagactcctgcaaagaaccagtggccaattcgagggaatcctccccgttaccaaaagaagtaaatgacagtccgagagccgctgacaagtctcctgaatcccagaatctcatcgacgggaccaaaaaaccatccctgaagcaaccggatagtcccagaagcatctcaagtgagaacagcagcaaaggatccccgtcctctcccgcagggtccacaccagcaatccccaaagtccgcataaaaaccattaagacatcttctggggaaatcaagagaacagtgaccagggtattgccagaagtggatcttgactctggaaagaaaccttccgagcagacagcgtccgtgatggcctctgtgacatcccttctgtcgtctccagcatcagccgccgtcctttcctctccccccagggcgcctctccagtctgcggtcgtgaccaatgcagtttcccctgcagagctcacccccaaacaggtcacaatcaagcctgtggctactgctttcctcccagtgtctgctgtgaagacggcaggatcccaagtcattaatttgaagctcgctaacaacaccacggtgaaagccacggtcatatctgctgcctctgtccagagtgccagcagcgccatcattaaagctgccaacgccatccagcagcaaactgtcgtggtgccggcatccagcctggccaatgccaaactcgtgccaaagactgtgcaccttgccaaccttaaccttttgcctcagggtgcccaggccacctctgaactccgccaagtgctaaccaaacctcagcaacaaataaagcaggcaataatcaatgcagcagcctcgcaaccccccaaaaaggtgtctcgagtccaggtggtgtcgtccttgcagagttctgtggtggaagctttcaacaaggtgctgagcagtgtcaatccagtccctgtttacatcccaaacctcagtcctcccgccaatgcagggatcacgttaccgacgcgtgggtacaagtgcttggagtgtggggactcctttgcacttgaaaagagtctgacccagcactacgacagacggagcgtgcgcatcgaagtaacgtgcaaccattgtacaaagaacctcgttttttacaacaaatgcagcctcctttcccatgcccgtgggcataaggagaaaggggtggtaatgcaatgctcccacttaattttaaagccagtcccagcagatcaaatgatagtttctccgtcaagcaatacttccacttcaacttccactcttcagagccctgtgggagctggcacacacactgtcacaaaaattcagtctggcataactgggacagtcatatcggctccttcaagcactcccatcaccccagccatgcccctagatgaagacccctccaaactgtgtagacatagtctaaaatgtttggagtgtaatgaagtcttccaggacgagacatcactggctacacatttccagcaggctgcagatacgagtggacaagtagagtatcatttaaatttttgtgtttcagtgatgagtctgtaggcatgagtgcttgataagatgcccttgattttagggtgggaatgcagtgaaatggacgtgtgtgtgtgtgtgtgtgtgtgtgtgtgtgtgtgtgtgtgtgtgtgtgtgtgtgtttggggaggggagggggaatgcctgtgcagccgggcacatgatccagtaaggattgttttcatagaatagaaacaattagctggggatgtggtggtggcagtggtgttggaggtggtagcaggagtggtagtggcagtggtggttgtggttgtggcagcagtggcgtgtgcctgttgcgccagctatattcgggaggctgaggtgggaagattgcttgagcccaggagtttgaagctgcagtgagctgtgattgagccactgcactgtagcctagcattggggcgagatcatatctctttaaaaaaaaaagaacagaaacaatgttgaaacatgaatcttattttagtaaaacgagttttttgaggggaggataatatatatatactagttgagttgtggaactttagattttggtaatcgtttggtcattggaatgtatattgaaagtctgagatttagcggattatagtgtcatcccattgtattaagtat

SEQ ID NO: 90003 - DNA, 1475 bp, Homo sapiens
actgggcacagtggcttatgcctgtaatcccagcactttaggaggccgagacaggtgaattgcctgagctcaggagttcgagaccagcctgggcaacatggtgaaacctcatctctaacaaaaataccaaacattagccgggcttggtggtgcatgctgttggtcccagctacttgggaggctgaggtgggaagatcagttgagcctgagaggtggaggttgcagtgagctgagatcataccacggcactccagcctcaggtgacagagcaagaccctgtctccaaaaaaaaaaaggaaaaaacttgtgaaattcaaagggagcactagtttgagctaatatactctgctcctcaaacatctctataaagatttaacagtaaactgggctttcctttttttctccctccaatattttgttaattaattaggatgtttatgccgcaattcagaagtttggtgctatcttggtgattagttcctcagggtaattactggtttaagttctttgtagcattttcagtttggggaacaaaagatcaagaataccccggtaatttttttatctggtttttcagttcagtggaaatggaagcaataaagagttttgacagcattcttgcaggtttgaatgttaaatgtttcattggctctggcagtaaaatgctcaaaaaataggaaagcagcaacttagttcaagaaggctatgatggctccagctgttaacctagcccggtgacaatgcctgggttctgtctacatggatgtcctcccatcttgacaccgcttcatcaaaggataatatttcttttcatcctaacaggatgcagtaaaaaaggggaaaaagccaaaaagctctttcttcatttctgttgtcttcgtgtctgtgtctgctggtgggctgtgtagagcggtcgactgtgtcctggcttaggagggttctcactatgagctgtgtgctctgtatctggcctttggagctaccctcagatgtgtctgtctgagacctccttctctgagagcaaggaagggcatgagcaggcgggtaggaatgtccttattccctgcgtttccctagtttttgttctttattaaccttttaggctcaacagccaaactagggtgaaacgggtgaaactctgtccccaggaggagagatgaacatcttttcttttgtgtgtggttgctttggcatcacttttgtatcttgctgggacgagtacgcaggtcacccgtttgacgcggaatcccaaggagtgaatcagggcagaatgtatatttaactctcagaccagatacacacaagcaaaacactcacctcctgatctgtttccgttttgcagccatccactcacctatgtaggccactcagctcaccagcgaagggcgttggtttgtagtgagcttcaacccactgcatagccaagcactgcaggaccagcagtgtgaaaaggccccatagcacgctctcctcct

SEQ ID NO: 90004 - DNA, 1010 bp, Homo sapiens
ggttcaagtgattcccctgcctcagcctccagagcagctgggattacaggcacacatcaccgcatccagctaatttttgtatttttagtagagacggggtttcaccatgttggccgggctggtcttgaactcctaacctcaagtgatccacccgccttggcctcccaaagtgctgggattataggtgtgatccacccccgcccggctagcattccatgtattttaacactttaactccatttccccattgacctccacattcttggtagctcatgggtgaattggaagagtataccagtctacactgtaacttttttctggtgctcacaccctgacctgtgctttctggggtaggaacccagtgcagtttaagcctgtgcctgtggctctggggcaggatgccctgggtctgcacattagtgtctagttagtctagtctcatcacccgaagtggattcctgaaccaaccttgctgccactgttcatggttcagaaggtgtaaagggtatggcctctggggtccttgctagactggcaggtccatcgccctttactcagtgcctttcagctccttggtttactgggtctggagaaaggtatgacttcattagcggagggacctccttccctttttcttttgagataattgtagattcatgtaacaaataatacagagagaacttgtatacccttcatccagttccccacaatggtaacatctcacaaaactatagaacagtatcacagctgggacatgagcgttgactcagtcaagatacagagcttttccagcactacaaagatctcatattgctcatttatagccacccacagcctctcctcactccttaacccctggcaaccactaagctgtttttcatttctataattttttcatttcaggaatgttacatagatggaatcatatagtgtataactccttaggattggctttttttcactcagcataattccctggttgttgcgtatatcaatagtatattcctttt

SEQ ID NO: 90005 - DNA, 3808 bp, Homo sapiens
tccatgttggtcaggctggtctcgaactcctgagctcaggtgatccgcctgcctcagcctcccaaagtgctgggattataggcgtgagccactgtacccggccttgtagttttcatcatataagtcctgtgcatgttttgttagatttcttttttcaaacaatcataagtggtatatatttttggtgaggacacgttcatcactaataatttttatatattttttgtgtatcctttgactctgttgaactcagttattggtttcagggcttttttttggatagattatactgatttttcagatatcaaaatagccttgcatttctggaatgaatcccacttggtcaagctgcatatttctttttatatgttttgaattataattgctgctattttgttaaggagttttgcatctatatgcatgtagatatccttttttgttctgttcttgtttggtttgagataggttgatactcactttttaaagaattgagaagtattccctccttcaatttttctggaagagagtgtgtataattggtgttagtttttctttggtagaattctccaatgaaaccatctgggcctagagatttcttttctagggtttaaaaaaatacctgttgggctggtggtgggggaattggcagagatcaaaatttacctttgctactgggcttctctgacacccaccatctgggtagggacgttgggacagacagctcattacagtctcaagagggctgaagtcttggctgcacctctactttgcacaggttggggtggggccgtagtgttttctgtgggatttggctggagtagacagtgttcctttaaaagttttctgttttcctaggcactcgtttcttggtggtcggctacagagcacaggcttttcttgggaatttttttttgtctctacccattggcattttgggttgctagcttcttcagctccaaatctgggatatatgaggcgaagagaaacccagggaactgactaccctgtcattcctagggtcttgagatccctagctaacctttcactccacctttcagagtccttttatgtttgttttatatataatgttcagggttttgacttgtacttaatgggaagaatagggaaagttactcttattccattttcctcaaagtggacgttttactccatgtttaaaaaagatcctaatatacctgtcctgtcttcaaggagagattgtgtaattgcattattgtgctctgccggagactttcagaccccaatctctgtttttgcaattaggcttcctgggagggtcactttccatttgacttcctgggatttctgttgtctctgaatggaagacattttctccacccagtgtaaacttcctttcttagccccgtctttaaaagcagttaggagtgagaattgcgtcttttacctttcacatctggtgggctgagcctcttttaagaccttaagaacgtacttttcttgatttagctcagtcactatccccttttttatctttctttttatattttatttttcccttgttatcattttctattttgacctctgtttatgttttgaacagagcctgtctcagtttccccagggtgcttctctgcacccagcagagggtctgtctgcctgtgagcaccagctggggctgttcctcccacgcctctcaccacctccccttacgcatgcctttagccttctgagactgccagtatgccatgggttaaaggaaggtttgggtggcatttggtgcattctctctgccagttgctgctgcccctccaagtgttctgtagacaatctatgcagaagtaacaattgccagagagactcagaagcaccacttccttatgaactggtctatgctcagtgacccccaagagcaggtctctggtaagagctgtgttggaatatatggttttagctcgaggctctctgccatacattcccaaagctgtcttgggatttgatcacactctggtacacgatctgggccaggaaccgaaagcctgctaggctgaggttagactgcctgcgtgcatctgcttaccccttggaggagacagtggcagagggagagagcctagaggactgaggaccttgtggggatcactaccttccagggagcatggaatcaagcagtaaataaaaacagttctgagcagttgactctttagccattaaatctgccccagttaggggtttgtattctgatctatctgcttaataatctctgctttgggttacgttgagaaaagggagtgggcaagagaccagaggagctttccttttctccatgaagtatttaagagctgaggactgtcgtttgaataattgatattttaatgtgttgggatgtcattgcttcacctcctcttaaaaccatgtctaaatttaaccaactacagactggaaatgctttctgtaaccccttaattttaaaaacctgttttcttcttgtggcatttatatcagctgtagaatcacagaatgctataggtcttttggccagcccttttattttacaattgaaaaaacaaatgcccaattggtggcagagctgggactcaaggcaaaatttctgtattgctggttcattctttctgcttctctaagatgttgaagcataggctcttacagccggagggaccttaggaatcacataaggatggattcttggggttacttccgagtcaccttcaagagtgtggataaaggtgacatttgcagtggtcctcatttttggggattgctggttcactttagtttcaggaactttctgggcatcgttaatacaacatactaactgtattctcgtgagcagcctctgctggttctcatttctagatcccgctctgctcagacagcttcctctggaaaccagggagctcatctgaattcctcccctccgccgtctcccaaaatacccttattagctgaagacttgtgacccttggcttttggtcctgctcttctaagtgtttaatttaaattttggtcaagactagtcctgtcctagtttatattttagtgttaccaaccttcagtttacccgtattcttcagtaataagcatgtaagtagatgatatgtgttggccatatagctttctgtaaatttgttcatttaactgtcaactcttattagggatttttttgcgtagcagaatgatttgaggacaaaaccagcacaaccaactagctctgtgagcaaaaggcatataaagccatttctgctgtatttgcttggtatgacttccatttaagtgagatctgaaatgaaatgctttctttgtgttctcagtgtgaaattggacaaaagtgaaagccacaaaacaaactggtatactttattatttttgtataattatactttaggcagaagattgtggaacttcttttaatgaggtgagagtaatttgcttagcatctgggctgactgttaagctggtattgtttctgcctttagctccaatgtttcatgttggtgtaggcttttggtctgtttgaaatttaaacataaatatacagccatacgtttctctagcctctctcactctcatgtacctctcccaggctacttttctgcctaaaatatgagcaaaaacacgtagaattatttttcttattactcagctaattcctcatctatagaaagaggatgtcaagcttgaacactctctgattccttaactggccagaatgtacctggttcccccttccctgtagcctgcatttgcatgctattgatcaatttcagtgacaggattggatagaaaaggctcagtaagagtaccgggc

SEQ ID NO: 90006 - DNA, 2763 bp, Homo sapiens
tgggtacttttcggctttattttcctatagctttctagtattacctattgaaaagtaatgtttactttaaaaagtaacagtttaaccgagcaaataaggctgccctagaatagaaattaactttattacctaagtaccgaaaacatttatccatttttagatgacataagtaaaatgtcaagacacacataaaaccacttaggtgccctttattatgcttttttctattgaaaaggcagttactgtcacattaaactgctttatcctctactaagtagcttcagcttgtgtagtagagtgttagaattttaagatatattttaatttacttgattaaaaaaagtaaggaaagtcagtcattacaggccacaaagagatccttgtgtgccctcatgctcaaatacatcccccaaacccagaggatgttcattattttcatgaattcaaagcattagaaaagctaatggaagatactcctttgtgctgtgaaaatgcatcaccactatcatgggaaacaggggatgacaagttttctgtaacaggaacagtgaatacaacttgagggagtacagctaagcaaatgatgtcatgtgagtttaaaactattgataccatgcaagcatcaaggaggaggatgtctccaaccaaaacagcgtgttttttttctcagaatggaatggagccagcacggtggctcacacctgtagtcccagcactttgagaggccaaggcaggaggatggcttgaggccaggagtttgagagcagccttgacaatatggtgagaccctgtctgtacaaaaaaaaaaaagaacattggctgagtgtggtggcgtgtgcctgtggtctcagttattggggaggctgaggagtgaggattgcttgaggccaggaggtggagtctgcagtgagctgtgatcacgccactgtactccagcctgggcaacaaagtgagacactatctcaaaacaacaacaataataaaaaacccaaaccaaatggagtcaaggagtagaggaggcaggtgaataaagatagaaatgtgggagtaactaagtgtctgtacgtggatatgcatgcatctacagaaactaaaggcaaggtctctagtgtccagcgtgattccccagtgaccattttctcccacttcaggaattgcaaagtatgaaagcattttgatttgaggctgtagtccctatgcctccctctttctccttgtgcttctgtatcgaaagtgggtgaggagcctcagctgatgggaacgagtgagtgcagagtcctacagttggggtggggagacatgatgatgatacattccaatgaatttaagtaattccttgtgcatcttatatgtattgtgaaggataaccatttgtagtatatcttgatgaaaatgtgcaaatttttttcaggaacactgtctgctttttagattttctttccattttctaccgttctaaagtagtgcaatcacattactttagataaaagagaagcagcaggggaggggactcacctctactctgacatgccgtggtcattgttggcattcaggtatatttgctaatggttttccctgtgtgtttttgtttattcattcattatatccccaccccactcctcgattccagttcaaatcctggttcttccacttaataggtatggagccttgggcgagtttcttaactttactgagccttcgtttccttatctgtaaagtggagatgttatctgcttcataggttatgagaattaaatgagatgatgtacttcaatttacttaatgtatttaaaatacctagcttaccatttgactcatggtaggatgggaccaatctatatattttaatataatatgtatatacacacacatgcatgtacgtgtgtatgtatatatgtatgtatgtatataaatgtgtgtgtgtatatatatatataaatgttttttgacttcttttagtatagaaaatgctaactttattcccaagtaagtgcaagacattttaagatgcctgtggaagttcagacatcataattccctgcctgggactgtgtgaaggtagatagaagactttagttcacagaaacaaatggttacctgtggtaatgtagatgttaacaggatctgttattaatgaatctgttgactggttttccttgctgtggcttgttctaacctttgaaatatgtgttatgagaaaaggggtgctatttttttaatgatgctaacttcattaaagctacctgtaatgttcttattttgtgattataataaacattttttgggataaaatttgtattttagtcctttcaggagaaaatcaagaaagaattttcaagtgagtttcctatttttcttagtctaagtcactcggaagtttaaaccttaatttttgggcgtgcttcaaaaacaagaagaataaaaaaagtctttttaaaatttcttaactgttgtcaatataaacaaatgctttaaatcttagcaagaatctatattttgagactttctttggctttaatacaaattgtacattttagaagatggtagataatttgtgtttgcacgaatgtctgaaagtatttaaacacagtttatgtcatatgctatgtgaggtttatttttggggtggaagtaataagtcctcagtttatgtttactttaagtttttttggttttgtgtttttaaaaatataccatgtttagtgcctatatcttaagaggatgaaaaacagtgttttgggttttcctggatagttactgata

SEQ ID NO: 90007 - DNA, 3981 bp, Homo sapiens
tgtcaagatgtgtatgcctataaacttgttactatatattaaagtcttttgctcacataaatttgtaagaatacctctttgccctaagcaaaatgcaaaagtaatggaattggaactctgctgaaacaggtgtttttagctcatactttgagacgagcctgactagatagcacatactgtgattttacaggatagagaattgtacgctggacatgtaactttcaagttggcttttcccttgggcttagaatcaattactgtagtgtttgaaatgaaggatgtataattatctggaggtttaaccaaggttctttgcatattagaaagtacttagtaggaccaaccctgtttccccctttggtttgtttagaagacttgcactatctgccagatgctgcttcctaaccagtgcagttatgcatcacaccagagaatccatcagcacaaatctccctacacctgccctgagtgtggggccatctgcaggtcggtgcacttccagacccacgtcaccaagaactgtctgcactacacgaggagagttggttttcggtcagtatatcattcacttatgtgcaagtaaaactcgttcacttacaaccgcacagcattttgagtggtttgcacacacagttttctgggtcatacggtgatacctcgattaacagatcctctgggaacctagctcgtttgtagagtccatctgtttgaatcctcttaatgtaatattggccctgctggtccgcacaaagtggagggtcatggggcctgtccttttaggcacactcttgcatgtgtgcaggtgtggctttgactgtcagctttgactgtaccctttgtagcagacttttgttatcatactctttgcattttaacccctgcaagaaaactatacattccgcacctcttaatatttccccttctctaatgaaaacagaaatagtgcgatggtcttttacttttatttggtccacattgaaagatggggtgtatgttccagccttgcactccaaataaccttctcctcctccccactcctcctcctccccactcctcctcctccccactcctcctcctccccactcctcctcctccccactcctcctcctccccactcctcctcctcccctctcctcctcctcccctctccttctcctcccctctccttctctccctcctccctttctcctcctccctctccccctcccttctctccccttctccttccctctccctcctcccccttactcctcctcccttcctcctccctctccctcctctcccctctccctcctctccctctccctcctctcccctctccctcctctcccctctccctcctcccccctctccctcctcccccactcctcctccctctccccttctccctcctccccatttcctccttctcccttctcccccctcttccccccttcctcctcctccctctcccccttcgagttctctcattcctcccttgtctcttctgcatatcttcactgtagtcccttttactgtccctcaggattctcagatgtgcattgtacaacatctggcaaatctaatgttagctagtgttgaatgattatatatatgaacttttctctccatcttatgaccttcctgtgccttttatattttcactaagaagattccaccaaggaaaacatgtcactgatacacagtgtctttgttaatagaggtattactgtattatatgtttatcttaacattaagtatttgcttacctggtaactttgttagattgttaatatgcagtgattttttttttcacctgtaataaattatgttgaataaaaatgaagtccagttggcatgatttgatggttttatttaagtttaggttctggtatcatcagttcctaggtggttctgcccagttttgcattaaacaacactaagctatgagacttaacttcacattttatctcatgcctccaaacttgtaatgcacaaatgttttatggattgagatctagcctggtggaaacctttggcttggaaatcaagaaaccagttttcttgtacgacttctgccagtaactaattatgtggtaattcacgtattctttctgtgccatggtgcctctgtcagtaaaattggtgcattgtctgcctccagctccactgggatgttactgagcaaaacaggataatcaaaggtgccccagatctgcaaagtccatgcagaataatactttcgttcttgccatcacgttttgaaactattattaatggattatgtgtttaataatagaaagcagctctgcagcacttcccaagtgctcttctttgcactaatgtcaaatttttctcaaatgtttagtttttctaatagaatgaaagttgatatgattaaaggaaatatgacttcttcaattttagctattgctgatatctttcctaaattaaaacagaagctccacatgcaggctgaaagtaatcaactcacttgggaaaagaccatccttgctcttctgttcttttgccctactcacagagttgttcaaattcggtatttcaaattgtagatttcaagttgttaaccaaaaattttgtgttaagtgtagatttttttctccctggacttgaggctatatggggctggtaaacaacgatgtgttgtgaagtttagttcatgttgactgctcctttagaagagaggagcaattttaaacgtaattcttttcctctgctgcttcatatgagggtccaggttcatgtttaagtggggcttagtagccccgtggccttgtcatgttttttgctccctttggctctatagttactcattttcaatgtgtcttttctttagccagatgagtctaatgtagcagcatggttcccacgccttactttgtctcgtcttggtgcagtgtgccttgctgtctctcctcttgctcatattacatctcccaaatactgatgggtcatccctggctcctggttaacttggtaaaagttatatattgataaaagtcaaatattttttctgaattttcctgcctcttgatacactggactgtatatctagaaaggggaatggttataggattttatactgtaaatattttttttaattcaaaaaataaagaaactttattgctatccagaataggacttcaggatattacgtatttcttagtagacaggatttttcatagcattaagatactgcatgagccgtttgaagtctgcctttctttgtcttatttacatcccccattggcctctgttgccccctgaaatgcctcttcttcctgtaagcagatgttttatgactttttaaaataccctgctttcgtttcttacattaaggagggtttcccttggtctccatggtgttctctggattgagtcatagccacttcctcttgcttcaaaaaattccatctttattttagatacttcctttttatttgctgtacattaaaccttcctctcactccaagtgactttaggtaattattgcttttctctgtattcctttttgtccttcctggttcttttgctctttaaacaccatctttctatccttcatgggaaaatcttctgtttatagtttatggtgtggtaggtccttcagtttcattaattacccatctacttttgttttacataatcttcctctttcatgggagttgtaggcttctaggtttgggaagagctaaaaatgatctattttaattcttctcattttacaaatgagtaactggcccagagaggagcattaacctgttcaagacaactcagtaagttaacccaaaatagtttcaatatgcttaggtggctctattgcctgaaataccagttcaagtagataggctagagaggctgtccttttattctctattgttatttagtgtttaaacatagctgttgctgaacataatgccttcagtcactggaaatgctaatgcgttagttatgattttaacagaatgcttgcaaagcttaaat

SEQ ID NO: 90008 - DNA, 1971 bp, Homo sapiens
cctgtgtaacttcggaagcatctccatgattcagaagggaggttctaagaatagaagcatcttagattgtcatagaagtctttggacactgccccccggaaaccaggccctgtctgcagtcttccttccctgggtagctcacatctgggagcacatatgttcagttgtattagaggtaaatttctggagacttttgtacctgcagagagaccactcttaaatagttttcaggtgtgaacaaggaagacttggtcatcaagtggaggtgtaagtgttgcttagagtctttgtgtgaaaaagatgagatagaggagaaatgtatcttagatttaaagtttgtctttgttggattatatttgagcagggaatgagctaattgtgagattactagaaattcataaagtaaggaggttagctagacaattttttttagagatgctgaattttcagaggtttgtaattcatgcaatttcttaaacaaatgcaagtgtacttaaatttattttctaggagacaaaacacctaggtggttgaccttctctatcctgtggaccaccatgaaccccacatacattgaccacatcagtgtgtaccaggaaacagtgggccgaggccttggagccagaacttctttgttcctctctgcccctctgttcttggcatgcaggtttagacactgaagatttcttccattagaaatgctatttgggtcctggagatgggtaggaaactcagggccctggtgccagaatccagcatatgtaacctctccaaaaacagtggtctggagatttgacatccattcttaaaaatgttaaagatgctccaaaaatagaccatttgagttttatttttcttcttcatgatcttttctcttaaacatataaaaataggctgggcatggtggtttacacctataatcccagcattttgggaagctgaggtgggcgaatcacttgaggctaggagtttgagaccagcttggccaacatggcgaaaccccatctctactaaaaatacaaaaagtaattgggcatggtggtacacacctgtaatcccagctacttgggaggctgaggcacgagaattgcttgaacctgggaggtggaggttgcaatgagccgggatcacaccactgcactccagcctgggcgacagagcgagacgttgtctcaaaaaaaaaaaaaaaaaaaaaaaaaaaaacccataaacaattaagttgatttataataggaaaaaaactaaaatatacttccgaagggccattaaaaacctaaaagggctatgaaagtgtgttcatctcacccagtttttgcagttacacgtgtgttatggtcttgtgctaatgaccgtgtgtttatttttctaacagatgtgtgcattgcaatgttgtgtactctgatgtggctgctctgaagtctcacattcaaggttctcactgtgaagtcttctacaagtgtcctatttgtccaatggcgtttaagtctgccccaagcacacattcccacgcctacacacagcatcctggcatcaagataggagaaccaaagtaagtcataccgactttcaagttttactccactgctttattagcaatttagaagcaaggtagtagtcgttctattgaataacatttaccaagatctgaaaaattatgcagctatgccaattttgatgctttatgaaatacagctcatagctcatccaaatctttctgttctttccaggtaaagaccttgtccaaaaacgttacctattatttatgctcttgtcacgaatttttgctcaacaagtaaatatttatatttttttcttaagatgaatttttttttttttttgagacaagagtctcgctctgtcgcccaggctagagtgcagtggtgcgatcttggctcactgcaacctccgtctcctgggttcaagcgattctcctgcttcagcctcctgagtagctgggactacaggtgcatg

SEQ ID NO: 90009 - DNA, 1027 bp, Homo sapiens
cttcgctccctccttgtgcacacagcactggattaatgctcctggttgtgctccttttattcctggattagttatcgcaacatagagtttgatcattacaagaagctagatttgctgtccaaatctgttgctgtgtttttgcccataactccataattaaggaagtattagggggaagatacacagctatgccatattttacacacacacacacacacacacacacacacacacactctttctctctctctctctctctctctctctcctggcttttgttgaaacatttagttttggggaaatgtgattgaatactacagaagtgactgttttatcaaaaaaaaaaacatgttgaagttaaattttattttagtaggaccttcattctgatctttgtaggttgatcccaaaatgaaacacattacaaattaaggaatccatacatgtcttgatgtcttgactctgaagatggggattagtgaattttagtgtcttcagttttcaggactgttagacttgtgggtactaatgtagcctttccccctgggatgaatacagtttttatttggttctttattaaaataaataaaatttgattgtcagaaatgtgtgtgacatctggaacagtagttgttacctcagaatgtaaggaagcaaatgattaaaataggctaaaacagttttcttcaaatttgggtattgtatagaaaacaattattccagtggtttcttttctctctctctcttttttttttttttttttttatgagacagagtctcattctgatccaaactggagtgtgatcacacctcactgcagccttgacctcctgggctcaggtgatcctcctgcctcagcctttctagtagctgggaccacaggtgcacacgcataccaccacgcctggctgatttttaagttttctgtaaagatgggattttgccgtgttgccaaggcttgtcttgaattcttgggctcaagcagtcctctcaaagtgctgggattgcaggtgcgagccactgcacc

SEQ ID NO: 90010 - DNA, 2377 bp, Homo sapiens
ccaggctggcgtacagtggcgtgatctcagctcactgcaacctctgcctcctgggcccaagcgattcttgtgcctcagccacctgtagctcccacacccagctaattttttgtatttttagtagagatagggtttcgccctgttgcccaagctagtctcaaacccctgagctcaggcaatccacctgcctcagcttcccaaagtgctgggattacaggcatgagccaccatgctggcctagttttctatttaaccacttatttatactcttggacatttgggccgttcacaacactaagcagtttcaaacagggaggaagtgaacatctttgtcacacctgctacggttaatgatgacaaatgattagtatacaacattgtgctgcattgtacggccccgaaaaccttgtctgcttctcaacaccccctcccccaagggtacttgtgctctgcagtaaagtaactaacatctcaagaccttgtaaaaacaggccaatccagttaaacttataaatcttacggggaaaaagagaaaaaagttacatctgtaactttggacagagaattgcacagtgaggtttgaagctacatgggaagtcctctctcagggccctgagagagggaaggcaggtggttttaggaggcattccgttcttcaactttgccgtaggaatgccaggtaaaacctcaacttctctcttttcatttctgaccctcacatccagtcagcttttctctgaccttttcctaagcggctccttagaattctttgtgcccattctcacagttctccagaggaaatacagatgcccataggccctctcctatgtgccagggtgacccagagcagtgactaaaaaatggtgacctgctgccatcagagctgttctcaaatgaccgaacacacatccattggaggcagaggccggcagcagggtagacgcagccctttaccctctcaagacatctcgtgccctcgtttcagtagagagtgtggatgggcaggagggattatgttcagaaggttcaggtctgctgaattcatttgaggaggctgcttgttagtaacatattagtcatggaaatagtttgtaggagacaagtgaatattttaagtcatttaaagcgtaagaaacattcaagcattgttgaaataacagtggtatcgattttattttctgtttcttgattttactgtatatttgtttactggtgtagggcttcctgtgttaagaacaggtatagaaatattgacattcaaatgtaaaattgctactgactctaaatgaaaactttggagttgagtaggcctatttagtttattaatcagattaacattcttttccaagttagggtatcatcattgccttgtctgatcttaaaaaaaaaaatctttaaaaaaaaaggatgcttttgctctgtgttaaagtaacatgaagactttgtacaaacatgtgccagttatagatttgtgaatagtaaaatggtcattaatttagatttctaagtaaatgtagctgaatgcatctttactgaaaatgttaaggttgatctatggttgagtaatgccagttgtcttcaaaagtttgtttcagagctaatcgttgttctatttattgtgtttgtgtgttctcaatgtgcctctgcctcccaagttcttcagctataaagtagcagatcctttgacttaaagaggctgactgacatgatctcgctgcactcttctattttagaataatatataagtgttccatgtgcgacactgtgttcaccctgcaaaccttgctgtatcgccactttgaccaacacattgaaaaccagaaggtgtctgttttcaagtgtccagactgttctcttttatatgcacagaagcaacttatgatggaccatatcaaggtgtgtgtgcatctatcctctactttaaatgaattgcagatccattcattggtcataaatcaaggctgagctgcaggtgactctaaagcatgcctcactgtcgagggaagggatggatgctggtcgttgtcagtgagcaacttacatgctgtcatcatgtgttcacttgactgtggtgcttttcattcaggagtcctgatctgcctactaaagattagtgaaaaggaaccaatgtctgccctgattttaaaagagtaaaaaagtactaagttttttgttttttgttttttttaatatgtgaaaatgatgactgtgaagttttcctttcctttccttttttttttttttttctttttgagacagagtctccctctgtctcccaggctagaatgcagtggcacgatctcagctcactgcaacctccgcctcccaggttcaagtgattctcctgcctcagcctcccgagtagctgggattacag

SEQ ID NO: 90011 - DNA, 1075 bp, Homo sapiens
agtaaaccaaggttaaagacatttgaatttacctctatccttgtgccagctaaggaagaaaggagcagagaaagacagtggaaatgttgaacattgccagtagcatttgtgtgacttacatgattcttccttgagtttggtagtgggaagaggaaccacatcctttaacttccagtagaagctctgtaactccaagtcactgaaaaatctgagtcacatatgtatatcctttctcttttaaatagtaagtatatgtctccaactgataaggaatttaaaaaatacttattagacctaataatattagcaaaattatttttcagtattatctaatactgtattaaatacaatattaggctgtattcacatttcctgattgtctcaaagttggtttgttatggtcaggacccaaaaagtccatatattacatttggttgttgtgtaattctttattttacgtagtcctcctttcattttattttttaatgtatggttgatttcttagaaaaattggattgtttgtcctatatataggttgtccctcactttactagatttaggtaattgatacttttttttttttaacttgttgacactaggaaccaacatggaatttgctactttttttttttttttttttgagaaagagtctcactctgttgtccaggctgaaatgcagtggcatgatctcggcttgctgcaatctctacctcctgggttcaagcaattctcatgcgtcagtctcccaagtagctgggattacagatgtgcaccaccacgctcagctaatttttaaatatttttagtaaagatgggattttaccaggttggccaggctggtctcgaactcctggcctcaggcagtccacccactttggcctcccaaagtgctggattacaggcgtgagccactgtgcccagctggaatttgatactttttgacaccgtttaacttgttcctctttatctcatattcctggaatattgattagatttgaattttttaggtaagccttgtcagctgggcatggtggctcatgcctataatcccagcacattgggaggcggaggcagg

SEQ ID NO: 90012 - DNA, 1394 bp, Homo sapiens
cccatttaccctgggcttgccaccttatcactgaacccagttctctggtgacccctttgttgttaagtcgttggatgtgttcctgtctttacctccactcaccccacagcggtgtttcacatgattagcagttctttctaaaagcattttctacccttattgtggaataccactctctcctgggttctctcaccattaccggaacacccatcaggtttctgtcctagaaacatttaactttctcttgggaaaattcaaccactcttataactttgcttctcgtgtacagtatatatacagatagcacccaaatctgtgtctccagttagttgaaaagtatttcttgaattaatagaccaagaatgagttctgatttggaagacatctaactcctcttagacttaacctcctcttctttaaaatgggtacatatttagtgatcttccagtgtcctgtgttgtaaatacctagagaactgtatatgaagtgataagtattctctaattcctatgggtttaagatgagatatcaatatgaaatacgctatacacatataagggttcaaaaattgtatttggctaaaggtctcaggagagaatacagtttaacttccaccagcccagaagtcattggaaagatccaaatttattggattacccaatgaaatattatgcattaggataaatatgtcagcgttctgaaccagtgaactttgtatacttgattttagtatcataattatgacttaaaatacatatatatatatatatatatatatatatagaaataaaataacttggggaataatctaaacgtattctgccaaccacagtacagtcattaccttagtgttactgcttctagtatgattattattttgataagatttggagtaaatatttcaggttaggagtaaatttaactggcataagttaaaaatttatgtcaaaacattagaattcactgctactcattttagatggccattttggtttcattaattgtttttgacctttcttccccttctcagttcccatccagaagaactttactaaaaagaaatattctgtatacagttcaatttattgagtaaagatattcagtagctttgtttttaagattcagaactggccgggcatggtggctcatgcctgtaatcccagcactttgggaggccaatgcaggtggatcacttgaggtcaggagttcgagaccccccctggccaacatgacgaaaccccatctctactaaaagtacaaaaatgagctgggcatagtggcaggtgccttgtaatcccagctatttgggaggctgaggcacgagaattgcttaaatccaggaggcggaggttgcagtgagccaagattgtgccactgcattccagcctaggcaa

SEQ ID NO: 90013 - DNA, 1059 bp, Homo sapiens
gtaaaaaacttaccaatttctctttttaaagttttttctcaaatgcttatgtattatctaatttttattgtgctttctaaagttggtattattgttttgttatggccaaattttagctgtccttgtaaatggtaaagtctttgagggcaagttgtatgtccattttattattacagtcttctatggtttacagcattgtgccttgcagagtatctctggagtccctgattgaagcagttctctttggattgttacttgcacatatgggaaggggctttgtgttagtcacagatacacacaagttgcagtctaggttcaggtacctaactagctttctaaccacagaaatcccaccacctttgtagtctctatattctcaactataaaatcaggaggacgggcgtgtcagtgtcacattaacctgatgatctcatcccagccgtgagcctttcctcagatccatgtacaaatgcacagagttttacatacaattttaggtgggttgtggatctcctgctcttcttttttgttgttctagaaggccttttaggaaccaaactaagatcctttgaatgagataatatctgaggtcattcttagagatcaaacattctgtaattatgtgagccagtattaaaattaaaaagaagttacatgttatatgtacctgttcaaatctagaaaattacaacacaatctgtgataattgtaatcattctctcatttgctgcctggttctcctacacatcaaggaaccttaacttattaattgaaatatcctaaagcagaggcatatgtgctgaattacggaactctggtgccatcaaaatgaaccttagatcttttcagttttttgttttttgtttttttttgtttttttttggtttttttttttgacaaggtctcactctgttgcccaagctaaagtgcagtagggtaatcttggctcactgcaacctccgcctcccaggcttaagcagtcctcccgagtagctaggactacaggtgtgtaccaccacacccagctaatttttgtgtttttatagagacggtgtttca

SEQ ID NO: 90014 - DNA, 1128 bp, Homo sapiens
gccaggatggtctcgatcttctgacctcgtgatctgcccgcctcggcctcccaaagtgctgggattacaggcgtgagccaccgcacccagccggccctggcattcttaaagcttccaggtgattccagtgttgtggcagggctgggaacactcataccacctgggatctgccgcacacctgcccttgctgctgatgctcattgctgtggccctcactgtgtgactgctatagcaccaacacacctttgttgagtttatgttttggggaaggttgatctcaagtgtatttgtttaaagactccacccaacgttcactcttggtggtgaaggcaggggacacaactctctggatgttggatttacagcattagtaagtctgttcaatataatttaaagcctgattataaatgattttaggatgtcttaatgtttctgttcctaaagcctttaagaaaagtccatagatttcatctgcattttccatacagggtgcaggtgataggtgatttgaatacttgctattttgtagcctttcccattctgaaattcactttcagttcactcagagatgtaggtgaaagacagcagtggcagtgaaggaaagtgggagaatgaaaggatcagagtgtggagagatgaccacagccactgaggcaggtgtgctgttgttacttttgaaaagaatggcaaggcaatcagcttgcatttcctagtttgggaccaccatgcttagaatcagattgactgaggagctttacagagactctcacttgcacagtatttaaaagaaaaaaatgtgtgtgtgtgtgtgtgtgtgtgtgtgtgtgtgtgtgtgtgtatgtatataaatttttaaagtgcccacttggccgggtgcagtggctcacgcctgtaatcctaacactttcagaggctgaggcaggaggattgctagagcccagagcttgaggctgcagtgagccgcagtcgtgtcactgcactccagtgtgggcaacagagtgagaccctgtctcaaaaaaaaaaaaaaaaaaaaatttaaaaggtgctcacccacacaacctggaacctagccatgtgtatgaaatgtgtggtagggcataattgccccccttaatctccctgaaactt

SEQ ID NO: 90015 - DNA, 1053 bp, Homo sapiens
cattttcatttcatttaggtgttcaatcttggttaaagttggttatgccatcattaactggacgtgtgtgtagttttggaagactgtgaatgtcctggttttatattccttagctggggtctgatgctttctggaattacttgcagttgctgttaacagcatcatggtgtcgttaattaattgggcaaatcttcctgcagaattatgaaatgttttagagtggcttgaatttagcagttgcctgggatgtatctgggggctgcatggattgtagcagggcctgagccttatgagggacagagcctcttcctgcagtgtctcggaaatctggagaaatgcacaagagagaggccctttcttgactccaggagttatcttaaagcagaggctctcgaggcagagagcacagttagaatcagggtttttttgagtctggttatgggggtttgggatgtggagaagtgggtaggacctgggtaggagtgaagtctatttttaaatttctctagataattgtgttaccttcacacttacatacgttccctcctactctcctaccctctctcttctccttgagtagttctgctgtaaagggattaagctgagagataagctatttagaggattttgctcttaatgctggagagtttataaaagctgcctaacaggaagatgagattggagaataatttcagtttaggagttatatatttttaagaatagctagaaaaaccatgagtttttactttgggaattatctttcatttaaaatgtttatctaaaattacttgccttggtgtttataatttgtttctaaattatattttataactattatgtgttttagcaaacctgtttatttttggatcatgaacaagaatctggaaagccccaagcttgccccagtaccaggcaatttcactgaactgaaacaaagtgaaagatacaaagaaggaaccataaggtttgccctctaaattgaaagaaaatgaaatgacaaacgaccagattccatttctaaaatttactgattatttttccattagggacaga

SEQ ID NO: 90016 - DNA, 1077 bp, Homo sapiens
ggcagcttgttagaaagttaggtagccttccttcagccctttctttttttctctgcccaagtgtctgacattgccctaagctcagaaactacggtgcgacacgtttctttgccatctgctccggatttggccttctgttcttgtgcatttgttactgttctgcgtcattactttttcagttgtacagtgtcatcagcagaccagacagtcttataaccagaaacttcggagacttggttttgtttttgttgttttaaataagcatagtggtaagcacacgttggtttaaccctctttatttcaaagttgtcacctcggtaatctaggcacgtgacagtgatagtgctggttctcagaacctgtttagagcatggcatatgaaaaaaaagcattcttttcactttatagttatgactggctttagattatctacataaatttacataaatttggttctgaatgattgagacttgtctctattttctattgaatgtgaaacagtggtctcaatcagggatcagcaaactgcgtttcatgggcctgccacctgtttttgtaaataatttatgagaacacagccacgcccattcatttaattattatcgtctattcttggttttaaggtacaagggcagagttgagtagttgcaacagaaaccttatggtttctggcctaacatactgtctggccatttagagaaaaagttggtcgactgttttacctatcactttggtagagttgaagactagagctggtgtgggaaactcccttggtgaacgtgctagtggtggtagaatgaatcttttttagggcagtttggcatttaaagaggcttatttttcacaacctttatattggaaagactgccttcaatagtttatacaaaggaaataattgattatggaaatttgtgtctgtagttactaagaagttgagacaacctgaatctttaatagaagataaacaattcatggttcatttgtgcaacagaatacaatacacttgttaagaatgcagaactagctgggcatggtggctcacgcctgtaattccagcactttgggaggctgaggcgg

SEQ ID NO: 90017 - DNA, 1005 bp, Homo sapiens
ttttcccgagacggagtctcactctgttgcccaggctggagtgcagtgatgcaattttggctcactgcaacctctgcctcccaggttcaagtgattctcctacctcaacctcctgagtaactgggattacaggcacatgccaccacacccagctaatttttgtatttttagtagagacggggtttcaccgtgttagccaggctggtctcaaactcctgaccttgggtgacccacctgctacctcccaatgtgctgggattacaggcatgagccctggcacccagcctgatccctgagtgtcttgggggagcgattgattggcagtacagggtctctctgcacatgtcgagttggccacattggcgaggtgatttggctagcttgtttactcagggctggtcacagattcagtcctcggctgggccctttgccccttggctgcagtcaccactgaaggtggggcagcctgtgaccaaatgcaagggactgggtgggccaacatcaacccagactccagtggacagtcataagctgctgcttcatacgtgaacaccagaacgtatctcatcattagtgaaaggctgtcactcagctggaatatacctggagtgggttgataagaagaaagcatgtctcatgagagagagagagacaaaggaccctgaggctaaagcactgaaatgttacatggatgtcagtgcaggccagatggaccctatggatcaggagacttatgaaggttggctgtcagattcgcagggggttatgataaccgggtaggaatcatctgattcagtgaaattgaagctgtttagtgagataagaatgattatgaataaagtatgtgttgagaccaaatcaaaagaatcagaatttagaaggatgctctgggccaagaagacgatgggagatctggcccataatgcttcactgataggttttgtttatttccccatgaactcactgtaaagcagtaaaatgctgggattgttctgctaacttacg

SEQ ID NO: 90018 - DNA, 1038 bp, Homo sapiens
gtcaaggagggaccttatactaatgtgttcagcatggtgctcattctgagagaatactgagtcattgtgaaaacttcttttgaaatgcaatattttccctttaaaattaaagccatctagacctgtaaattaagggccactcctagcaaaattgctgattgcgtgttgaaccatggtgtgaactcagcttattggacctgtctgtgtgaactgacggctaaggaggaccttcgaccgtgagttcttccacaggagcttattttgtcagcaagtgcgttatctccttgcctttcaccccacaggcactgcccagactccagacgtacctttaccaaacgtttgatgctggagaagcacgtccagctgatgcatggcatcaaggaccctgacctgaaagaaatgacagatgccaccaatgaggaggaaacagaaataaaagaagacactaaggtctaacattgcagatgtttgctttacagtgaaattgtgttgacttgcttttcccattcatttttttcctttcaagtttttgttgcatagttacagttttaaaaattcagactggctgggtgcggtggctcatgcccaccactttgggaggccgaggcgggtaaatcacgagttcaggagttcaagaccagcctggccgacatggtgtaacctcatctctactaaaaatataaaaaattagcttggcgtggtggcgggctcctgtaatcccagctactcaggaggctgaggcaggagaatcgcttgaacttgggaggtggaggttgcagtgagctgagatcatgccactgcactctagcccaggcgacagtgcgagactctcccaaaaaaaaaaaaaaaaaaaatcagaccacactgaaagtataaaataatgattaatctccccatagacccattctgacctcatcatcaggagttcgagaccagcctggccaacatggtgaaaccccatctctactaaaaaaatacaatacaaaaattagccaggcatgatggcaggcgccttaatcccagctacttgggaggctg

SEQ ID NO: 90019 - DNA, 2053 bp, Homo sapiens
aggagaacaaacccagccacgaggatgaatcccctgatggcgccgtgtcagacagaaagtgcaaagtgtgcgcaaaaacttttgaaactgaagctgccttaaatactcacatgcggacacacggcatggccttcatcaaatccaaaaggatgagctcagccgagaaatagccacagatgctccatgaggaaaatccctgtccacattggaataaaaaagacatttttgttacaaagtttgcagtataatagagttaacagtactgtctaggctgttgcaatatattctctttcaatgtaccttccttcacctcgtcgtatatatcctcgataagtattaaaacagtatttgagtttaaaagagtttgtatatatttaaatgaataactttttatactctttgttacatgtttgtatcagtatttagtggaaaaccatttgagttgttttgggttagaatttttctttttgtactgtttctttaaaacagagttcttagtaacaggggcagttcctgaattcaaataaaccattttgtatgtttggattttgaatgggttaactaattacaggctaaaataatgccttttttagtgtttttaatttttagaattcactacataaattgtaagtaattgtgggtctcaaaaacactaggaacttttaagtgtcttagcacttcctcgatgtgcctgccctgagggagtgagttcacatttgagacaactgcactccagtgtggacgtgcctttgtcttcaggccatgccgaagggtgtttaaagcagtcttgcaggtcgctcctttcccagccgtggataaaaactgaagctaggaatctaataaggaatgctgatttcctcagttccattttgaggaatggggaaggctattctaaagaaaaaaatgggatttgttttctcggcagatctgcaaggctggctttaagagcacaaggagggaaagtaacgaaagggctggactactataaaagttacaaatacgtagttagaccaatagatttatatagtcaggtttttgtcatgtaatttattaactaactattacagaaacacagctaagaatatcaagtatttctctggctcttgacagaaaaaaatcagttgacttaaccctttgctgtcaaaagagttggcgtttcctgttctgggtgctactgccaaacgttatggtacttagagtcgggatgcacaacttcaaccaccgacttatcaatgcagccgcctgtgtattgcaattggccgttaccttaagcactgagccacccgggtttagttcagccatttcaagaagtatatttaacgtcggtagttctgctttattaaaatgcagcagaggtactcttctgtcccttccgtttatagttctctgagagagttctattttttggttttgttttgtgttttcttttgcattttgtatcttgtatttatccctgaacatgttttgtaccttttttttttttttttttaagaaaaggaattcttttgtgtatatatagatacttgcatgatatactgtagtcaatgttcggttcctcaaaaggtcttgctgctgtcaggtgttatgcactccatccatcataactgtatgaaacacatttcatatgtaaataaacgtgggacatttggcccttgtgcttctgtgagagaattattgatggtgggtctctgacatctttgtgaagtttgggaagtaattaattgcagcgacaagctacagggtgttgcagaattcttcccactcagaagaatggcatattcgttctcattagtaatcagctattttgtcactttcttgttgactccatcagtacatgggtacaatccgagggtgtgaatttcagcttgaaattccattgctgttccttgttttgtttgtattgctctaagttgtattcataatagcactttcatatgtttctgcatttgaaccttgcaataagcctgtgtggtaggccacataggtccgaataacctagttttacagttgagggagctgagctcagattcagttctttgccgaagccctcata

SEQ ID NO: 90020 - DNA, 1053 bp, Homo sapiens
agcttatgtgattccttacattttttctcaaggtttaggttacttaaaaatatggaagtaggccgggaatggtggctcacacctataatcccagcactttgggaggccaaggcaggtggatcacctgagatcaggagttcgagaccagcctgcccaacatggtgaaatcctgtctctactgaaaatgcaaatgagccaggcatggtggcacccacctctagtcccagctactcaggaggcttaaacccaggaggcagaggttgcagtgagctgagatggtgccactgcacttcagcctggatgacagagcaaggctctatctccaaaaaagaaaattttatatatatataatatatagtacatatatatataatacatatgtaatatataatacatatataaaatatataatacatacataaaatatataatacatatataatacatactttatatatatgtaaaaattaagagttgattaccaggaagatgatcttaagtttcaggtatacatacaaattatgcttttgtttttatgtgtttgggtgatatatcaatagctgagtaacaaatgcatacaaaagaatgccagcaaaacgttacttgcaaaatgagaaaaaggaaaatgtaggcttacactgcatggcaaagaccacttccttcctcccaagcacgttttctgcaaattccttactcctaccacagcaagtagtccaaagaacagctgttctaccctgaagctctggtgggcatgcctcaccagtgtcagcaggctagtgagtttccatcctaggatctttgaccaacagtgaaatttcctcttgaaatttttgggcagccaagaaatttataaaatatgactcagaggaacccttcatctatcccaaaggatagtctgaaaataaaaagtaatgtgccaaatgtaggatgctatttgtgcaatttacacacacacgcatgcacacacacgcacacacacacgctttgcaaatatcagatgctgtaaggattccagattgtagctcttaattttaacatacatcttctaaacaa

SEQ ID NO: 90021 - DNA, 1159 bp, Homo sapiens
aattcatcaagaggatacaataattataaatgtatccaacattgaatgaagcacctaaatatataaagcaaatattaatagatctgaagggagatagaaactataatacaataatagtaggggacatcaataccccactttcaataatggattaccatccagacagaaaattaataaggaaacattggacttgaactacactttatgacctgacagacatatacagaacatcccatccaacagcaacaggatacacatttttctcaagtacacacagaactttctccaggatggatcatatgtttggctgcaatacaaatctaaacaaatttcaggggatcaaaattaccttaagtatcttttctgaccacaatggtgtgaaacttgaaatcagtaacaggagaaatcttggaaaattcacaaataagtagaaattaaacaacatgggtcaaagaagaaataaaaaagaaaatcaaaaaaatcttgagacaaatagcaactatgtaccaaacacctatgggatgcagcagaagccattccaagagggaaatttatagcaagaaatgcccatatttctgtgaaaagtctctcttcatgctactagaagtttctggagtagccagttgtcattctatagtcactgttacccccaatcaacccattctgaacagcccagcctcagttcacatggtttgagtataaggctgaatttgagactaggctactctcagtcttttcagagtattttcttttcacatccattttttcttcacagtcccaatggattttgaatgttttagtaacgattcaatacattggataaaactttaatgatcttagcctacatttttctaggcatttgctcatttatatttgctgccttctttggaaatctagatttgggggtaccctagatcctgtttcaattaaggtcccagcagaatgcagtgcagcacactgcaaaaggtttaactttcaagaaattaaggaagggactatacacagagctgtgtgctggaacaaggcctgagaagcctgagtaggggtggaagctggagctgtgggaaaagggcactcaggaagagccactgccagagccacagtgaagccaggaaggtgtggggagcggaatcaccaggaggccctctcatcacactca

SEQ ID NO: 90022 - DNA, 1034 bp, Homo sapiens
cccttgtgttgtaagccactgagatttggccttcggtattagcttcaatctccgattgggcatgagatggctacaacgattccagaatcacctcctggcatgacaacacccagaacaagaagagagacctactcttcccaagggtttctctaaaaacaagggatgctgcaaggagacccacacagactttcccttatcttatttgctgcatggggcaggtagaaagacatctaggttctattggtgctagtaggggtggtggcggggattcaccccaggcaggcggttgttctgcccgatgcctgcccagggctaaggcttgtggccagcacactcccccatcagggctcccttgagtaacctgaaggtcccctgtgctcaggaggattgctcaaccactgaacttctactattatcattaacagtaacaaaacataatcaataatccacaaaactgcactcctaactcctttctttctgaaatcacattcctatctaggtttagggaaaaaaagacaggaaagtgtgtgtgaagttaaatatttgtgtatccacgtatgcattccggtcactgaagaaataaaggatagtataaaacatagatccaaccctcagaagcaatttcagagtggtgagggagagaaaagaatcacaaagggcaaagcaagcctgtgtgaccatctccagagtaatgtagacagaggatgtaggaactctgagcacaagtggcttttttctcccatccccaagagggcgaggagggacgaaggagccaggagggagtctgctcagctgcaccgttcctagcatgtggcaggtgcacagcaagtgtttctccaagggaagtaacagggcatccaggaaactcttacgctccctcactctgagccatgttgcttatttccatactgattgaccttaaaatggatttgtgtgcatgtgaaatttgtcatgcttacaagagggtgtataatgtacttttatagctcaaagaaaaataaataaccatggacctgccacccattttaagaaat

SEQ ID NO: 90023 - DNA, 1047 bp, Homo sapiens
ttccaagccccgcccaccgcagtccatctttaggccccgccccaattcggctcagcccgccccagcgtagaggcaccacctttcctcgctgcagtcatccaatagccaagatacacggctaggtgatttgcgagcgggagttaggtgtcctcttggcgcctgaccagagtcgggaaattcagctcctcttgagtagtcccttccccgagttgccccccgaggtatgcggggtcactcgctgctcgatgttccctccgaagggtcggacaaggctccggagccctgtagctgccctccctaggagccccgggtcttcactggccgaggtgcccaccccgcagcattctgggagtggtagttttcttccttcaggttcattcctggctggccagtgcccaagactggcgagactacgattcccagacgcccaagcgagtcgccggtcacgtggccgcaaggacgctgggccggtgggcgggggccggcaggtgctccgcagccgtctgtgccacccagagccggcgggccgctaggtccccggagaccctgctatggtgcgtgcgggcgccgtgggggctcatctccccgcgtccggcttggatatcttcggggacctgaagaagatgaacaagcgccaggtgacggaggagggtggtgagcgcgccgtggccgggaccgcctgtgctagcggggagtcggggcttcccagtcagggctccggctcccagtgaatgcggccgggcggccacccgaagctcccgcgctgggctctcaggccctgggttctacgcctacgtgtgggcatgggtgtgcacttccttgccctgacaagagcacaattaggggagggtgcaggaaaggggagaatagaaaccccgtgccatggaatgtcaaatgtggttgagaatgccacagccacgcttgtgggagagatgactcggtgaacgacagctctctgagcgtatttgaagggccacccggtgaagagggaaccgatttctctgtggggcttcagaggcctgactgccggcaggtggaagaggcaga

SEQ ID NO: 90024 - DNA, 1019 bp, Homo sapiens
ccaacccgctttctcctccactcccattaagttctttatgcattgttttaaatagtggagtaatctgccattttcttttttttttttttgagatggagtcttgctctgtcacccaggctggagtgcagtggtgcaatctcggctcattgcaacctccgcctcccgggttcaagcgattcttgtgcctcagcctcccgagtagctgggattacaggcacatgcaccaccatgcctggctaatttttgcatctttagtagagatcgggtttcaccatgttggccaggctggtcttgaactcctgagctcaggttatccgcccacctcggcctctcaaagtgctgggattacaggcatgagccacactgcacctggccccactttctactcagttatttccatattgttgctcatttatttccttttccacattattagaattaagactgtaataaatgtcttcgggccataattctcaacctgcctttagtttatactgaattcctagaagtaggattatgggccaagagtaacctcttaatactaatgccaaatagctttcagaatggtttatcaatttgtatccccatcacagtgtattcttgctagcactaagtattagtattaacaacaacaataaaaaaaccagacactttaaatttcttaggcaaaggctaggtgtggtggcttacgcctatagtcccagcactttgggaggattgcttgaggctagtatgttcaagaccagcctgagcaacataaaaagaccccatttctaccaaagaaaaaaatttagaactacccaggcatgccagcacatgcctgtagtccagccacttgggaggctgaggtgggaggatccattgagcccaggagtttgaggctgtggtgagctatggttgcaccactgcactctagcctaggccacagactgaaaccttgtatcttaaaaaaaaaaaaaaaaaaaaaaagttgctagaaacaaaaaaaaaggaaggggttgcaaggagggtagaggcag

SEQ ID NO: 90025 - DNA, 1029 bp, Homo sapiens
gctgtaaagaactgtccggacactgagaagtcagaaccacgtagaaccacctggcaaagtctccatttggacttcccgagtgtctttcactccgacttttccaggccttgtgtattttaaactgtatttaaactgtgtttaaaactgtattttaagttgtactcaatgctcaaaaagagttcataccaccacattccatctcagttaatattaaatttggatagttgaggaaaatgatgttgcccagagccacgtgatccaggtcctcactccaaactcaattcaaaagtatgttctggaaagctggtagggagctaaggtgggatctaacctgtctaacatcactgcctccaaaacactaaaactatattaatagcaaggagagtttagaagttatcagttactccaggatacgcccgggaaaaggaaacaagatcagccaaatactagaagctggaaaacagatggaagaatgggaactggcacagccagagaaagccaggatgtgagcggcactgggggaggctgtggctcttcaggtttgtgaggcagagagagtcctcagagacccaggaattggtgtccccagaactgaaggtgaaggggaccgtagggctgaaatcagtttgattgggtagaaaagcagagaagcagtgagacccctcgctctccttgtcttccacccagaggcctcaccctcctcagcagaggtctgggagttcattccctggagaggggaacagaaatctctggaggaaaagctgccaggcctggtgggggttatggctcccaccctataagtgactgtgcacactgcatgctgagggtataaaaacagaagtgaggggtgaaggacctcagatgtacacagaacacggtcctcaggtgtacacagaagtgagcacagatgccaggagaataggcacctgtggcccggtggaagggggtcattgaagcagagacccacgtggggatagagccattttggttctagggtgtgttgctgagagtgagtggtcccagtggagg

SEQ ID NO: 90026 - DNA, 1065 bp, Homo sapiens
aggactccaaagcttccatttgaggctaaaggtagttctaggtgaatccacagtgtgtggatctgggttagacctgtgctccccatgctgcgctgtgtctgggactggtctgcatcgggaggctctggtggcaggccttgagtagtggaactctctagggtataaggtgctgggaaatcccaaagaggtgattagggcctccttgaggctttaacaagacaaacctcacagattgctctttttttcctcccttctctctcacttaaggagagatgatatttgcaagtctctttccagggacagaagttgaaatactgcagaattttgtaccttgtgttagtttcctgtcctaaaatcatgtctttgaaaaagtttgataactgcatctccagcttcacaggttggtggatcttctgctattggttttcatcgtggtttcctctttttcattccagctctattaccaggttttaaacttcgccatgatcgtgtcttctgcactcatgatatggaaaggcttgatcgtgctcacaggcagtgagagccccatcgtggtggtgctgaggtaggtcccccaggctggcctccagcctccaacctccatcacaaggctgccttgggcctgaggagcggggcagccttaagtgaaaacctgcgtgacagctaaaattcaagattttaattggataaattattagtctttattgatatctattttgaaaatgtttcgttttttttctggcttttgaaaaatctcatctttcttagtagacattttagagctttaaccatgttgatgctcgtgtacctaatccatttcaaatgacaatttaataatatgtggtattcctgcattatttctatacaaattgatttttaaacataactaaaaatgttacttcattttctttgtaccaaacaggcagagagagcctgtatccccagtgcgtagcattgtgtctagtatttttttcaagcttcttcagtaatactcgtgtattgatggctactatcttcttgagactatgatgcttataaaagtacagcatgtttattttagaaaag

SEQ ID NO: 90027 - DNA, 3800 bp, Homo sapiens
ggaggcaaaagacttgggttccggttttgtcccagccctcagtttggcatcagggcgggtcctgctccccaagtgcatccatgtgttcctcatttcttaagtaagtattgcagtatcctaagtgctggaggcctgctctaaagtgaagggattgccctagatgattaactagctgtcagcctgcagttctggaggaaaacactactatatttgtagatgcaggactttttttaaagctaaaaattggtagcttttacttcagagttgacaattatcctggtttcttttctacctgatacaaactgcagagggtcctgtcagtgctcatgacatgttaatctcagtagaagtcatttcctttcgcacatgttaccaccttgagcagttaagaaggaagccacattggctcgttttatagctcctgagacctacttgactattgagtttcacctctgacatgtctattctgatcgccttttggacacagggtaatgctgatactgactttgtgcttctttccagtggcagtatggagccggcctttcacagaggagacctcctgttcctcacaaatttccgggaagacccaatcagagctggtgaaatagttgtttttaaagttgaaggacgagacattccaatagttcacagagtaatcaaagttcatgaaaagtaaagaggctttatttccttttggttttgttatgtaaatttttggtagattcatggctaattagaaactagtaaaagcactggattatgttctgagttctgccattgactcactgggtgactttggaccaaatgcttaactctttctgtaggatgggagttgtagtagttaaacccatagtaactcacaaagtgattatgagaattaaatgaactaatgtttactaaagcaattcataaacttaaattgctgcacaaatataaggtatgatgtattatgacatgttagttatttgaaggagctcaaagaaaatcaagtcacattgcaacagaggatggttttgatatgaaaattattttctgaaatgcaaaaaaagctagctgtttttctatgttacttgggccaaagtggcattttcagcagtaatattagtcctggatggataaaaattcattttccaactcatctcatgatttggccgttgcatattctgcattacttttccaccgccccatcccctactccccaaacagccttgctgttaataccagctgtgacttacttatgaagacccttttctggaaccggaaacatttacttcttgctcaaatatataaagttgccatgagagagtacttcacatgattagtaaaaatgttacatttcatatacttggttattcatttacctttatgcagcttagtgtggatttttatctgtgtgagtcatagaattaaatttaggtatgcataggtatgtttttaaataatggagcatttctcactgtgtatgtgtgtgtgtgtgtttgagtttgagagagagcggtaactacttgtacatatctggtattagattcccattccattcactgcttctttttttgagatggagtctcacgctgtcacctacgctggagtgccatggtgcgatctctgctcactgcaacttccgcctcccgggttcaagcgattcttctgccccagcctctcgagtagctgggactacaagcatgcaccatcatgcctggctaatttttttttttttttttgaggctctgtctcctaggctggagtgcaatggcatgatctcagctcactgcagcctccacctcctgggttcaagcaattctcctccctcagcctctcaagtagctggaattacaggcatgtgccaccacacccggctaatttttgtatttttagtagagatggggtttcaccatgttggccaggctgatctcgaactcctgacctcaggtgatccatccgccttggcctcccaaagtgctaggattacaggtgtgagcaactgtgcccggcccatttactgcttcttcacaggtgtaccccacagatattgatacttattcacttcacattactctaaacatgagaacaatccagtttcaacctgtggtgatacactggtcctgtactaacggttacttgatgcctacctgttagattcctgaggaagaagcatcctcagtcatgatgtgacagtactcgcactgacttacaattaatttctaaagatgatcaattgttccaagttgaggaagtgttgattatttgctctaatttgcatgaattatgagagactgtcaggatttttatcccgatttcctttataaccgtggctgcaaatcagcttgctctttttgatatggtttcaaatctttgggggcttttggcattttatctcattataatagtgcattcttttttcatctgtcttactgaaagaagaccctctttacagctccataatactacaatattatgtttctagagtcaaggctatctgagtaccagtttagaatgcttaaaatgagtcccacatgtctctttaacacactggtgttatgccatttgtgattcttgtttccttgcaaatttgactttatactaccgtggtcagtggtgaaggaaataatgcagtaacaaattctgcatttggcaaggaaaaggaaatctgaggacagcctagagcacacttggatttaaattactttgtgctcaaatctgtgtgatctaggatcaagtttatgtctagagtgaagaggaatagcatccatgttaacaaattggtctatgaggctgggcgcggtggcttatgcctgtaatcccagcactttgggaggccaaggcgggtggatcacttgaggtcaggagttctagaccagcctggccaacgtggtgaaaccccatctctactaaaaatacaaaaattacctcggtgtggtggctgacacctgtaatcccagctactcagagacggaggcaggataatcgcttgaacctgggaggcagaggttgcagtgagctgagatcgcaccaaggcactccagcttgggtgacagagcaagactccatctcaaacaaacaaacaaataaataaacaaaaaaccaaattgttccatgaggcctaagaatgaaaacagttcaagtccaacacaggttgttaaaccagcttcatgacctgacttctgacctattctgacttgaggtgaatgaagtgagtctggaaaagctccttgtcagcagcgtttttgtgtgttatgaatctggacttgaaagaattgcacagaggtgattcacatgattttgcccactgatgaatgacactaatacacttgtttacaggttaaaaaatgtcaggtcctagtttattcgtcattcccagaagccatgtggtaagaaggaattcttcattgtgtgctgtgctggaagcaaattgttgcccttgtgcttggtcatgctttttgttgtcaaggatacttgagtgttttggaatttaagtctacaaaactgtcattagatttgtgcttcagttgaatggttgtcttaagcagtcatcttagactaaaggaaggtcaggttatctttgactgtttttctaaatgctcctgtctgacagtaaagtcttgagtaaactaatatttttgttaatgatgctgtgctgaaaataatttttgagaagacattattttgctttccagagataatggagacatcaaatttctgactaaaggagataataatgaagttgatgatagaggcttgtacaaagaaggccagaactggctggaaaagaaggacgtggtgggaagagcaagagggtgagg

SEQ ID NO: 90028 - DNA, 1052 bp, Homo sapiens
acaaatatgaagaagtgctactttgtgtcaaaggtagcaaacaagaatgctgtcttctaaaaacaggaacttccactagtgttcaccagaaataaaataaaatctgtagatccacaaggatttactcaaatagtttgcagactcactatcaaaacattcttgtagggcctgtgtgttaaaaaaaaaatcccatcaatgcgtaatggcaaatagacaaaattgctgaaaaaaactcctaaattggagtttggaatcaatatccttttgactatatgtcaaaaagaagagaatgtagaaattgtctgtcaatgtgcttagcatgtgttagcctaatgtagtgactgtgaaggtttatatcataagcaattctattcttcctcctttgaacttgccctctttccacctctccccagatacctcccaccccatcttgcatgtatgtttcttttacctttgccttttgaacctacatctttgaagttgctgctatcctctgaatcccacgaaggctgctgattgcccagggccttgggttgaggtggctggtggtttctgttctcctttgcttctatgagacccagcaaattccttgcagcttcttcccacctgatgtactctctcagctgctgcttcaggctccctctctcagaaacagaagaagactcccctgtgctctttttccccattaagtgccctgtaaaaacaaaaacaaaaacactcagaatgccacaaatttaaccaaagggaatgaatgagaaatttaaaagaaatttaaagctaattgtgtttgtgctgcttcctcctaaatgcagaataaatcatgttttattaagagttagttcataaacgacagatagattttgctctctgttcaaaatgtgcaatgagctagacagcattcagaactgcaacccaggaaccctgggtttggttccagcacctctcctaactagttaggtcacctctgccaagtcgtttagcacccctagtcttcaattttctcaactataaaatgaacagggtagactagattaaatctaaggaggcttcca

SEQ ID NO: 90029 - DNA, 1016 bp, Homo sapiens
cgagactctctaacctccccaactcgctccacactcgccaacccagagttcggtaaaaggcgcgtctggtgaggtgccgcgctcggagagtgtcctggagcgccctacgccaccgccccgagagctagttcttgcgggcgtgccctggacagtatctgcagttctttggcgccggctctagggcgaggaaggaatctcgaaatctcagcccgcttcacaatctcctgagactctctgaagaaggagagtcccggactcccgcctgagcgtgctcgatatccaccgttgacactggaagctgggcgaccgccagcagaacctggatgcccgccaacaggtcctggcacggggggggggggggcgtccaccccacaacccccgtccctaagcgtgctttcaggatgatgcccccagagccttaattagcatcaactggctactgtctgtcggtcctgagcaaattagtgaagctcccagtcccctttcctcgtctaaataaactctgtctctctggaaggtgggaaagatggaataagatcacctgtaaaggctttgtggaaagtaccaagaccctggcatgacgcaatatggattgtaatcatcgtccccatttccccgaaattccctggctgttctccggttcctgaaaccgacttgggaaaaggatgaccacgctggagctgggaatatgggaagcctcatcatagtttccagtcctttctctgcgggtctaagaggctattgcataaccagggctgtgtacccctagacctccagatggtgccttgcacacagtaggctgatcagtaaaaatgtactgaataaattattcccccccaagaggtagggagtaatatctgcacttttcctcacaaggatgtctccttgggggaggaggatggagcagcccgtgtgttatcaccttttagcaagaaaacaaaacaaaacaaaaccagaatgaatgtgtgtttggcctatcatttgtttcattctttcattccctagggatgatttat

SEQ ID NO: 90030 - DNA, 4278 bp, Homo sapiens
ctgtttgtcaagtagttcattggtagggtaaccatgtaatttattgtctgacctgggacacttttgagaatgaaggggtgctaataatcacaccactacagcaagcgtgaactgggagtatccagaggagttgtctgtggtgacgctagtctcagtgacctcagggacagcaacatcatcatatactgtaatgcagacaggagccaggaggcagtgagttagtgactgggtagtaaaaaggtggaggccttccagtgtcaactactccttcaaaaacagttgtcagtaaaagttaaggggatagaaggttttctgggggatgaaaaaatgaaaatacttgtttatatagcaaacagttttataaagatttcacatttatttctttttccaaactgctattttgactaactgtaatagaaagtcatttgccttacagccatcaaatgaaaagccgaaatgcccagaactaccaccatttccatcatgtttgtctacggtccacttcattatatttgttgtggtgcaaactgtattattcattggttatatcatgtataggtaagtctcttgataaaatgtgacccaatatttttctgcatctgtttaattagaaatattcaactaagttatctatgttcataatacaattttcaccacctataaaattaagtttattgtgatttctgttcatttcagttcacataaagtgcacgtgtagaatatatgtttatcttaatgcgttgtatacttcaaaaggcattgatattttaattttaaatagtcctgtttctttccaaagttaagcgtatagaacttctttaagtgtttgtttctttttttcattaggtctcagcaagaagcagctgccaaaaaattcttttgactaccattttcctgtgtacttcatctatttgtgtacaaaatgatgtcgttttgagggaatttaagtatttaaattgcttcatagtctaaattattaattttcttaataaaataactgtttaaacattgatttgcagttaagaataaaccttaaagcaaagacaaccacattttaatttgttcacagtatgtaaatctgtctaaatttcagtgaatttctggtcagtatgatgcagcctctgagcagaatattgaccagtaagagggtaaataaagtgggggcaacccctggatatgaatgttaccccctaagtctccaatattgcaggtttccctgtataacgtaaacacacttgccctcatgcctcccagaatatgaggtctaattaagaagtcccatcaggtttattttgtaaccaaagtcttttttagaggtcagacttcctaatcaaaggcctgggcctgcagtcctttcatcttaatgcaacttcctttgaaatcaaagaatattttgtctgagagctttaaggatctggtaatagacttcaaaatgttaagtgaaatttttttttcctctatttatcaatgatatatttcacttttaaaggaaattttagaggaaaattaatagctgctttttgcctaaaaaaccttgtgggtggaaacattcctctgagaatggcttttataggtattttgcctggtaatgtattcattcatgattgcccatattcttgaatgtcttcattccaatggggtcaggtcaatattatgaaaataatttttatatttatatttgtaacttaaggaatttatttctccctttactacagcatgtaaattcagctcaaattgcatgatctgaggatttaaattcacaaaacctgccactacattctggtttacattagttacttcatgctggctggggttagtgaccatttgcatactcttttaaatcaaggaggctgtagtagaagcagttttaagattcttgaaggcaaaatttgaaaaacagtgaatacttctaattgtttccttttagtgccagaactaaggacattgtgaagcacttgttagtaaacttaaccttgaaatgtcagactggaaggagtttttatagtctttgtgcatacttctaggtattacagaaacagtctgtaaatgacattttaagatgcaaatttaattctgttcacagctgatttatactgatttttgctgccttcaaaatactcttttacttcttttagctaaaatggttgtctttcatttgccatagaattccaaacaatactatcttataaaatagtactgttgaattattccaagcctccctaggtttgctctcaaatgtcatttacagattgggctaacgacctaaaatctatatataaagactttctgaagaactctgtattatagcaataccaaacgagtgctgtgtgtgcaaacagtctggcgttgctttttatgttgatatttatcctagaacactgaaagagaatatgccagtgataactcactttacttcagtcatttcaacacagaaaatgcttctctagcatttttcttttgtagtgttaacattttgaaattcatgtttcagaggcttcatcatcacagaatttactcttgctccatgaaaaaaaattaaataccttcagaggaatatttaagttgtaaactatgaaacttgagaaatcctcttgagataaaaggctgccaaatccagtattataaagtccatggtcatatgtgcctgtgcattaaaggaataccagatctatgcagtatacatttttcaggctgaaattcaaggggaatcattctgattattcttactacaaatggagatggctattatgaaacagcatgagcatgagccttttatcttttatacttagtgatatactttgcttgaaaatcactcagcaaagtagttcacatgatgtgtatcatatttgaagtgtggtttttctcaaaatcattgactttaaggagctcatttctgaacaaaaaggtttgctctgtggaaaaatcaatcactgccaggattctttcatttctgtactattttgtataattgaatttgttcacttctctcacaccagcaagtgttttacaggtgccttggattaaaacaaaattgattttaaaatttttatgtaagtcattgtgtctatgatgccacttttaaaaggaaaatgcaattgcgtaatggcttatatccttatttaatgtacctatttgtgttctaataattgtttgaatgttttattcagcttaaaactttaccatgaagtcataaacagtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgttccttttattaaaacgcgtggttcatgagcaactacagactgaatccagattattacctgttgctttcagtattttcgtgatggcttttaatcttatgaaatcatcttgagatcattcatggtcaagccatgaaaactcccatcttcaagcctgcctgctaaagcttctttgccttcctgattgtgattatggtaacaatttatatcagacagttgtactttttgataacttagggaaaacagaaatgacttgaacaagggattgcctgcctcactgcattgcagagatacaatttttgtaaagaacacaaatagcagttgtgaatattaaggtgtgattatctttccctgtccatgtgcttattgaaagaagatagtgaacaaatgattatattgaggatttttttaatttataagatctaatgtgaaatccacacttggaactttttagatctgtctgttgcttgtttaatatatttcttttatgacattacttaaagtttaaaagggttttctatccactgtcaatttcaattggataacattttgtcaagttttttttttcctgattatttgatgctagctggaattcaagaaatggcattgaccttattcaaataaagaaatattttagtaaatttgctttttccttcattgatcttggataataagttgccatttgtttttcagacacaacctgtattgtgatagcatttcatttatcacatgctttaggctctgcccgaggtggcctgctgcatgc

SEQ ID NO: 90031 - DNA, 1197 bp, Homo sapiens
atatgtgcagctacaaagcggacaagtctgtgtgtgtgtgagtgtgcctataggaaatgattgcgtttggcactagtcctttactgtacagctgaacacctagaaagatttattataacttcattaaaaatatcatccattatattcaatatccacttatactattggttttaacacagattacctagtagtattttctacatggtatttttagatgacctttagtaaaatataaaggcataatgtcgttttataaattattttccaattttgaacacaactcgatttttaaagatactttacctgtttttttttttaaatgatgtaatatattagacttgaaaagtaaaagtattggagatctgtgactgaaaaaaaaaaactttatagtgattttattgtatcaagagactttctgtttcagaaattccatgagtgaaaccgtcagactggtcagtggaatgcagcaccctggctctgctggaggcgtctatgagacaacacagcacttcattgacatcaaagagcacctgcacatagtaaagagggacatagataacttagtgcagcgaaatatggtaactttgtttccttttccttttataattataatctttaggaaaggaagaactcatactctactgcaagtattttaaccctttagttaatgctaatgcttatttttaatgtttaaggtagaattgtcccatttattgcagatctccatgtgtcctggttttctagttattgaaggtggaagaacagttcccatagcagtcatggttttttaatatgtaatatttatattatcatttcgtgaaaatattttctgatttccatgttaatgtcttctctgacccatggattgcttaaagtgtatttctttggcctatttttccgtcaaggttctaatctggtaatttcttgctatcttgttagcttcatttaccttcacccaggtttcgtgtgcttggattggattagatatgtttttgactctgctggttgtcttctataagacatatttgggatatggttggcccatatttcctagtctgctttaccagaagcagaaatcccaatcccttatattttatatcgcgttttatctttttaaaagctttttaaaacgtttgatgacctttagaaaatatactaatagattaataataatgttacattaaactgactctccca

SEQ ID NO: 90032 - DNA, 1060 bp, Homo sapiens
tgaagtccctttctttcttatgtgacgggtagcatattctagatactcttttgtgctttgcatgttttacttaacagtagtactaggacatctaaagatgtaactagttgtcaggacgtcctagctgtccagttgtattatccatagaatccctttcttagaggagttaacaatccttgcaaactcccacttactgagaataaatgtcatgcatacagtaagttaatataaaaactgagctcaagtttctgaactagtgctctggaactttttctttaggatttagcttcaaaaaaaaaatgtaaagagatagaaaatatttgcctttaatggaaagggtagtttgtttctttgtggatttttatattcttaaggaatcaaagaaattttttttagcagaaagagatcttagaaagcatgtagcttttctgtagcagttgatgcctcttcccacttctccatctcaaaacttcccttttaagatttctgatacaccattcactcctggtattctttggcctctgcttccatttagttatcttcacttgctctccttccatcgtcccttaaaaggtattcttttcaagcgttctgtccagccctcttttcacttgacctgtttcctaaaccaactatgacctccttcaaccacaattctatccccataggctcctcttcattttttgacactcagctaaatgcatctttctttgtagagctctagtcgtgcttctgtcacgttgctttcctgctagacaattcatctccacagggcagatatttcattcttcttgcaaagtttatatccctaatattccctggctcacagcacttatgaaataaatgttagcagaatgaacaggcaaatgaatgaatgactgagtaggagcaaattaagtgactcaatctttggtatattaaaaagacatttatacctaagcaagttcatgcttctgggaagcagaatttcttaaatacaaatatgtgacaacgttacatactctgtgaggttttggtcttggtattattttagttatattaaaatgttatgcttaatttg

SEQ ID NO: 90033 - DNA, 1054 bp, Homo sapiens
gttttctctcttactgtttcccatcatctaggagcccttctggtgctcagtcagctcctggctgggcaagctgcctcaaactctctccttattttggtgcttcccatttcttctctgatgaatcctagcattctctcctaggcaatctatttgaaatgcaagtatctacttactactctggtttttctccgtggaggaggtacatactacttgcatctggttagccattttgatccctcctgagattatccaagaaaaattgtttttaaataaaaaaatttaaacccagtttataataagtgttcaatcacctgaaatggcagaaaacaaataatttaatcattattgaattaattatttgcatattttctgtttgggagattgtaccactgtgatggtgatgtcctaattttgctgaatgttggcactttggtcacttacgttatttcaaaaactacatatgtgtaggtgactctgatcatttttatttatttccttttcagcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcaggtgggcttgcagaatatgcagatgtgccccatttaccctttgctggaagggaagtaaagaagaagggcaactgtactatgtgctcatagaatgtggattattcagcttgctcgtcattgtttcttcctccagattactcaacaagaactggatactgttgtgaaaactcagcatgagattctgagacaagtaaatgaaatgaagtaagtatggaaaagtagcgtttgtgtgttatgtgattttttttatcctaaatttgtgacttcaggtgtgcaagcactgtattgcaagatttctgcatgagggtaagaatcccgttctagattcattttacaaataggggaccataaatacagc

SEQ ID NO: 90034 - DNA, 1010 bp, Homo sapiens
ctggacaacacagtgaaactccatctctactaaaaaatacaaaaaaaattagctgggcatggcagcaggtgcctgttgtcccagctactcgggaggctgaggcaggagaattgcttgaacctgggaggcagaggttgcagtgagccgagatcacgctactgcactccagcctgggtgacagagcgcgactcttgtctctaaaaaaaaaaaaaaaaaaaaaaaaaaagagtaatttgctatcgtttaagtaaagaaggaatacatttttatgttaacctttccgctagtggtagaagagttaaaatgagaaaaataacatgtatagagatatcttaatgattttcttatctttttaatgatctattccaaaactccaaaaaaaagcccacaccagataaagaaatttcggaaaaggaaaaagaaaagtatcaggaggaatttgagcactttcaacaagaattggataaaaaaaaagaggaattccagaagggccaccccgacctccaagggcagcctggtgagttgtagcaaagctgacatgggtgccgcagcagggcttgaggctgttgatcatggacgcttgagtctctgtgttgcctagctcatccctgctctctgaacaggcacattccaagtgatttctggaaacaatttaggagcaaatctttagtctttaagagtcaagagattggcatttttaccagtgagaatgtggcttagtcatgtatgaaataaagagtaccatggttatttggaggaatgggaccgctagagtgaaagctccatgaggacagggattttgttaatattcattgctgtgaccactaagcctaaaaataaatccaaaacaatgctaacctagtagttcaggttcagtaaatattttttgactgaaatcatcaaaagtgtatatttttggttttagtgacacataattaccttatagtgtggagataatccttaaaatctatcaaaactgttgtgaaagtaatgtgacatatctgcttctc

SEQ ID NO: 90035 - DNA, 1050 bp, Homo sapiens
aggagctcactacttgttgagacaatctgtttaattctcaaccagctgcagataaaattgtaaatttaacctcttggttttagctgtcactgggatctgagaacaagtctgatccctctgctgcatgaaccattccaagggagtaatgatgactccctaggtcttcttgagagaaggcaaaccatattccattttagaaaggttttcatagaaagttatcagatttttctctctttaaacttttgacacatagtggggcaaaactcatttttttaagtaaaatatattgtatattgacaccaagtaggaaacgttatttaaaattactctttataataatgaaacaaaactgaatagtagtcataaaatggatcgattgaaatttattttctaatgtcttttgcaaaagctatagctatgatatgtctttctaggtaatgatcaataatggctttacaccagataaaaatgattatgaattttgtgccaaagtggaaaatatgattatccctgcacaagggcattttggaatatctgctgcaactggaggtcttgcaggtaaatcttgcagtctgatgatattaaaagtttgtgaggtgtgttttattgggaatagtatattagggatatgtagacttgtttatactaataactttttaagactgtttggaactttcccatcacctcttgtgccagtcttttggtctgttgagattgctaattttctacttacattgttcggtaggtgtacagttaactggggctgtatacaagtgtgtcaattacagcatcagtttgggtgctattttatagtgaaggagacatatttaaagtagaggctatcaaagtcagcaggcttaaaggctggagatcaaaccacatgacaattaactaaaatagcagtcttggctagtcacatccacagaaaggttaattgccaagtgttttaggatcctgatcattgtcacatcacatgtaaatgaatttggcaacctaaggaaaggttatttggtgactaaactttaaacaaaaccatagttaccatttttt

SEQ ID NO: 90036 - DNA, 1073 bp, Homo sapiens
ccagagggacttccgcaacaaaccctatcctgtccgagcaaagattacctattaccagaacacactgacagtaagtaacatctatttagagagaatcaaataaacaatgttacagtatcacttttcattttgaatttttgatagaaattaaatgcacttaaatttggatatgcttacatactcttcattgttactctaagagaacggaggtggcttcacagctcagtgtaagtggtcatctgttgtaaacccctgatggtatgtttccatttagtcagtaaatgtttaagccccctactgtatagcacatgtgagagatatatatatctatagatagatagatagataggtagatagatagatagacggataatctccaagccttcaggatacaaatatgagtaagacagatggactttctccccagagagcttatagcctaacagaggacacacaaatgtatcattcctatgctgtgtgataaatgctgcgttgcagacactatcaagcggtcctgtggttagaatcctgtaactgccaggtggaggtggggaagggcaggaacattttctcagagttgagctgtgccctacagggagatcaggaagttcctgggagttgggggaagagggtgtgtgtgtgtgcgagtgagtgggtgtactccaagcacagaaagcaggcataggcccttgagagagcttgaaatattttggaaaggcatgtagtttggtgtggctgggagatagaagagatcagtgagcagtgaggttgaaagggcagtaacaggccttgcacagcttcctgtagtttaacccataagaagcttttaaaaatgtttaaagggttttaagcaggaagtgaaattatcagatttgcaatttagaaagatgacttaggtcccagtattcttagtaccagttttcttggggttaggggtgaacacagttgttgagtcaaggagagttcctgaatatagccaattggacagctaattggtactatttactagcaaagaagcagcacatttgtttgtgttttatctgtttgggggaggaatgggaaatcagagggtt

SEQ ID NO: 90037 - DNA, 1001 bp, Homo sapiens
tgtagctttaattttttttatttgataagggaggtgttagccctaaacttttaaagttaaaactgtcaacatgaaattttttccaaatcattattgtacaggttactaagtctctgtaggtatatttagcagtttggaaatgatcattgagttttacctaattataacttaaagcttttttcccctgatttctgttctagatgctattccaagttcagatcaaattcgagtagcaccatctttaaaaagccaaagaggctcagtgtggacaaagacaaaagcggcctttgagaactgggaagttgaggtgacatttcgagtgactggaagaggtcgaattggagctgatggcctagtatgatcatttctttaacttagaaaatgtgcataaatgcatataccactagcctctaactgttccctattacatattttcaggcaatttggtatgcagaaaatcaaggcttggagggccctgtgtttggatcagctgatctgtggaatggtgttggaatattttttgattcttttgacaatgatggaaaggtatatttattgtcaggactgttatccactttaatacatctatcaacagagttaggctgtgagaaataatagcttattcaatgctttcatcagtttgatagtacagaactccccaagctatatggtaaatgtgataattagtctttatatagctaggaatgtatcagtttaatttacatgtgcatgattttttgtacatcagcttgagggcatagtagagccctgactctcagaactttgcagtgacccctgctcccatggccctatttaatggataaatacaaatccttagacgtaggtggtgaaaacagtagtgtttaggagactctactaaacacttacataagcacatccaagtccatgactaatgctagctcacatattcatgtctggtcatatgttaatcattctttttgatcgggccaatttttctgatgatctctcctaaaacagtt

SEQ ID NO: 90038 - DNA, 1658 bp, Homo sapiens
gcaccgccccagacccgccccctgcgcgtggccccgcccacagctgctcctggccgtgcggccgcgcggaaagcggaggccgggggcggggctcaccccttgcccttgggggtcccccgggctctgccaatcagcgagcgccctgttggccatccgcagccatccgcgcccctccctctcccgccctcctccgcgttccagaatccaagatggcgggatccaggcaaaggggtctccgggccagagttcggccgctgttctgcgccttgctgctgtcactcggtcgcttcgtccggggcgacggcgtgggaggagaccccgcggtcgcgttgccacatcgccgtttcgagtacaaatacagcttcaaggggccgcacctggtgcagagcgacgggaccgtgcccttctgggcccacgcggggagtaagccggagcagagggctgggggccgggttcctctcccccttctgctgcctcttcgcctttcatccgcggctaccctggtgtgctgaggttcccgttccagcagctgcacaccatatgcgctgtggaggggaccctcctggcagcccctccgccgggtccctcctggttcgcacggttccctccgcttgtccccgagtctttccctcacccattctgttctctctcacccgcctgctgtcttcccttctttgatctcgtcggtactttccgttggatctagaggtgtttggttacctcctacacttcctagcactcaaacttgcttctaggtatcatgtttcacaacgccacgtctctaggagaaatgtgccctacccccagccatcccaacctgagacatgttctagaagcccccttacttcctttcccgcttccaccccccacccccgatccccgatttctttgctccggtgttagcaatggttaatgcttcgcttgaaccccatgcccactgacggctcctgagatggcatatagtagtattagagtaattttttaagtctttgtatgtcagaagacattcttatactgttggaactacacattttcctctcagtgacttggtgtggtctttgatcttttctctcgtagtaacacattatgtaactttttaggagaagggatatatttttagggattgattgtttctgaacctgagactaagaatagcattacatttttagccctttaaaaaaattggaagcattgaaataatcttgggttcatattttattcactctctgtgtttggcacttttgtagataagagagccttgctagagcatttacttacgtgaaagaaaacatatctgcactttttagtgctgatgtgtcactgctgactaaggagtcaatcgtagcacttggcatgacataagctctgttcagtgaccatcagatatacccgttgaacaagtggcaaatgcctttatatgagatgaggagctctggcagtttgaattctatctttgtgtgtgattaatctttttttttttttttttttttactataaggtttagggtacatgtgcacaacgtgcaggttggttagtatgtatacatttgccatgttggtgtgctgcacccattaactagtcatttaacattaggtatatctcctaatgctatccctcccacctcccccataagtaatcttttatataaggtttttata

SEQ ID NO: 90039 - DNA, 1066 bp, Homo sapiens
gagtgaatgaaatggagggctgaatcctggatggtttaggggaatgagatgagcaattgcaaggaggatgttggttttggaaagaagatatggttgattttcagatgttttgactttgaacagtgtgaggtatcttggtgaatatttccaggggtcattggaaaatgggacttgggctggagtaagaggttaggctacagtagatgtgggaactggcacttacagtaaatgccaccatgaaggctgagcatggagacagaaggaaagagtagaggggctgaaagagaggcttaagattggaggaaaagaagacccagtacaggacagagaatgggacttcaacatcttctatatctggggagactaatagtcactttatgggaagcaaaaatttaggttgatactttccagttttattgtcccagaggtgatagttgtaaatttaatcttttgtttgctccatccagatagaaacacactttccactcttctatctgctcctctccaccccaggaggctggtctgggtgcaccatgtcagtagggctcccctgcccctggcttcctgttgggagtagccagtgagggacccataggtggagactggagagaggaaggaaagagattgaggttgggacacaggtatatcaggctccatttttacaaggttcttacagatgggctctatcctttgaccgaaggtctttgctcatctgaaagtggtctgcccagcacagtgttttcttctgctggggttggttacctctccctcccttcattcctttagcaagtgaagtggtgtcttagttttcttgggcttctataacaaatggccacaaactgagtgacttaaaataacaaaagcctgctctctcttacaggccaggagaccacaaatctgaaacctaggtatcctcagggttggttccttctggaggctccagagggagaaactggtccatgcctctgtcctagcttgccatggttgtgacaatccttggcatttctttgcttgcagatgtgtcactccaatctctgcctccatctttacgtgaccaccttctcca

SEQ ID NO: 90040 - DNA, 1051 bp, Homo sapiens
attcagagaatatcattccaataaatagctttatagttattttgtgactgatgaaaaccaacaaaaatgtattaactttttaaaaatcactgtatcaacacagcacccaattacatccactgctgcaggtaggaggcattgtgccaaattgggttaatttgtgtctgtctttagtgtcaggatcttatgattttgaaaaaacatgtttcagagaagaaaacaatgctcattttggcaatcagccaaattcagctcaactcaaaatcattatggaaattggatatacatggttcagatggatgatatactgtcaggaaacatgacttcagatattctgaatcttagagtcaactttgttgccttctgtaggttttgtcagctaattggcatgtgtgtgtgcaggcgcacatgagcatgtaaaactgcaacacgtttccttttcctgtatgcataccttgacattcatttgaaaagttcaccatgcaagaagttgcttagcaaacatctgaacagatgggtttttttcttaaaaactaccattgcttcattgtcaaatcaaagaggtcaacataacctatgctgaattcaacttaacccaagaactcatctctgttgacggaccaagggatgcaaaggaacgtcttcaagaagaactacaaaccaatgcttaaggaaataagaacacaaacaaatggaaaaacattccatcctcatggataggaagaatcaatatcatgaaaatggccatattgcccaaagtaatttatacattcaatgctatccctaccaagctaccattgactttcttcacagaattagaaaaaaactactttaaatttcatacggaaccaaaaaagagcctgtatagccaagacaatcctaagcaaaaagaacaaagctggaggcatcatgctgcctgacttcaaactatactacaaggctacagtaaccaaaacagcatggtactggtaccaaaacagatatatagacaaatggaacagagcagaggcctcagaaataacaccacacatctacaaccatccgatctttg

SEQ ID NO: 90041 - DNA, 1058 bp, Homo sapiens
aggatttagggactttattaatatgttcagataagattagcagcatttgcaaacatgatctttggcaatctacaccagaacagaacagctcagttcctttctcaagacagttgagtacttctttcctactttatcagtgccttttccaaacaaatgcctgaaaaccatgtattaaggataaatctggcgatttaaagttacagttgtttcatgtcatggtacttccatcatcttaggttgacttttaattttttttttatttttgcttccattttatagcttttctaaaggtagttttaattagggtgagtggtagattatgcatatgagcctattaagcaagcctgctccatattgtttccttgctggaaattttctctcaaagatggtcacaagagacaagtgactgacccagggactttatttaaataatgaaaatggttatgttatgaatggccctggaagagacattgtgtgtcaccctgtgggtggaaagaaaatgatactgtggtagaatgatgtggaaaccatgcatctgattgatttcctgacctgctgcctgcggggcaccctggtagccacggttgctgttgcagtgtgtgtcctgggtatttcactctcagttaccagatatggctttttcttattcactgttctcttatgcaagataatagagcctactgcagtgagctttaacactgccttttgggtctccaaggtcagaggtagtgactcggggtctttggcaatgcatttgggggatgggggagttcaggagccctgacgtaacagcctgagaagatgcacctgagactattttatgcattaggttgagttttgcattcgattttctttggggagaaaaaagcttgaaaacccagcagtgtgtttcagaagagaacaggctgtttatctgtactgttcttaaaaaaagaaaaaaaaaaaatctagtgacaacccgtcttcccctcttagctacagggtctgggtttttgcacagggcctgatgcttacttaaaagggccctatgcttagtttaatgctttgctgtcgccatc

SEQ ID NO: 90042 - DNA, 1988 bp, Homo sapiens
acattgaaacaaatgcctattgaagcaatcacataccatggaaatttccttctttactaaatctcccatatctgcttgtttaattcacgtttttctgttacagaagtagatgatcagctctccttttaaatacaggtgactgtagccacttacttagtatgttggcttatatcaagggagtagtaatttgactttattatatctgatcagtaacatggactatagagagggccagtttgagaccctcatctgcttttttttcctggataggtatctctgttctatgtgtcctcctacccctagccctgtgaaaatggaagatgatgcagcctaatggttaagaactcaggtgtgaagtcagacagacttgggatcagactccagcttcacatgcacaggctctgcacccttggacaactggccaaacctctgtgtcttgtcttgaacctatgaagagggtagcatgctgcttcctggctctctccataactgttttggccttatgtgaccctccgtcagcgaagctcttatggggtgaagaggggccctccttagataagttttccagtttcttctgcctactttctccattggatccttccttatttgcctgcataagaggagataaagtaccagagagaaacaacagataccttttccaacttctcattttttaaaaaaagtagaagattctatcagtggtcacatgtattttgtgtcaggcttcccacttcatttttacaacagcactacaaaggcatcccttttggatatggaaacagagtcatcgagaggttgaggacctttcggcctgaggaggtcaggacagagcttcagatgtccacctccaacacttggcacttcctcagatctccttcctagctgctttgtatcttcctcttctaatgtacttgcctggtctccagtattttaaaaaggataagaggtactgtttctcctaaaataaaattggtgtgtctctttatagaaagataagggaaggttttctggggtgggagaaagaaagagcaacaactttgtagtaggaagataatgctaatttcattttgtgttcttgctggatttaataacaacacaggaacatataattagtagataattctgtaattacttaaagatgagcaaaaccttgaaaatgacccaggatgtgaaaggtcttgaagcagggaggtatcttccctggaggaggccagagactatatttaaatcagatgttttacagagagatgagccatctttatctttaaaggccaaattctgcctcctcacaggggtagaggtgagtgattgttttagaaataataataaaaactttacaagaaccttatgaccaaggacccgagtggtctagatgaaattaattcatgaatcctcacaacacttagcttctctcattccttcaactacttaagaatttcagccccaggggccaaattctatgctctaatatttgaggcggtggaagtcacagcttcttttcttctcatggtcattccagaatcttctgagcaaatgattagcatttggctatggcggatacacacactggatttttttcagggacagtttaagaaatattgtcctattagtgctctatgtgtaacaactaacaaatggagttttctcttcctgggagcatgtgagtgtgattccagcttacctcctttagtttccatgacagccctcggaggttggtattgtcactgcattttatgattcgagacaaggcacagaggcttagcaagttatccaagggtgcagagcctgtgcatgtgaagctggagtctgatcccaagtctgtctgacctcacacctgagttcttaaccattaggctgcgccatctttagttttgtcagagcgcatagcagctttgatcactctgtagtcttctggcacttaacccttgttcaggccttgcttctctctgtggggtcctcttccctatgcctcttgccttccaagtcct

SEQ ID NO: 90043 - DNA, 1077 bp, Homo sapiens
tggcactgcctgtctctagcttgggagacctgtttcctccttggggaggcatgttctctgagaagggaaaggggcggctttttagttggtcatgtgcttaatatctatacttgaagctgatccaactttttaaatatgttagacaatgccatttaacctgaaatttcttactttggaacttgagttaatcacatctggggtctcccatgaatcacttagccatcatttttcagggccgcctctggctcctctttgttttctttttccattttgccaactttttgtttaagatgagcattccctaaagcggtcatctcttgatctctctcccccactctgcccactatgaccccacagcagccctcactggtttgacagggctgccctgcactctgcagctctggagggttcttgagagcccatttccctctaacccagatcctcaggttgggatgccccaagaatatgctaagcaggaggaggccagagcgcccatcacataggatctgtaacttgttataggaccacagccgagctcagctactagagattctgtgatgcctttagactttcctcttgatcccaatatggccatggtagtaggattttttaaagtaacctaggtttaataatagtccccttggtaagtgtcctctttgctctatgagtgcttgcttactttcaaccttcttattctttccttctcttctgcaaatattaaatgcctaccatgtgcactgttctagctatgtccgtgaacaaaacaaaggtcccttgtaaatcttgccttctaaagtgactgggagtaggggggattagtggagagcagacaaaagaaataacctcataccttatggaacgaggcagctggttaaataaactatatgccaagtatcatattgataaagaataaagccactcctggccctgtgctcaaaaccaatttaggagaaacaaacttataattaactgtagtatagtgtgatcaaaatatataccaaatacagtgaaaacaccttaaagatctcttctgtctttttttttttctccgacagttggtcaggacaggcttgacca

SEQ ID NO: 90044 - DNA, 1051 bp, Homo sapiens
agaggcctcacaatcatgacagaagaagaaggaagagcaaagggatgtcttatatggcatcaggcaggagagcttgtgcaggggaactcccctttataaaaccatcagatcttgtgagacttattcactattatgagaatggcatgggaaagacttgcccccgtgattcaattacctcccatcaggtccctttcacaacacatgggaattgtgggagctatgattcaagatggaatttgggtggggacacaaccaaaccatattagcacctgtcctgggatcctgctacatatagtattaggataaacaatctcatgtaggtcaaaaataactcattctaagataatgagggtctcagctttctctcttgagggcttcagggcagtggccacattctagccctgcaaatttccccttttctacctcctccaaccaaattcttctcctccaaccaggtaaatgctcctagaaagtcctagaaacagcagggttgtcttgtttagccagggtaatctctccccccactggaagacagcgagaatgaagaagcactgaggtcagaggtgaagggagaaacttctaggctacctaggagggtgctctaaggggcctggagtcaaggctctcacgtggggaaaactgtgtctctttttctgcatgtgcatgttccttctcccctctctccctcctcttcccttcccaactctttcctttcctattcccctccctcttttgacttggcttacaatggtgaagatcaaaagctgtggaagtgttgaatgggactgggaataccgccctctcttgtccagctttctgccgtgaattccctacctgcttgtctggcttgtgttggaagaattgaggtcccttttcttcagtgatgtggaccactaggagtttataaaaatggtttcatcaaaaatgaagttagatataaattcagctggaatagtttaagacctctttacctcatcaaaacaagaggagtttaaaaaaaatcactgagtttaaaacacatttaaaactcacttggaaccataagccaatg

SEQ ID NO: 90045 - DNA, 1030 bp, Homo sapiens
atacatcctaggggaaaagggtataaatgggatcccttaggaggctgtggcagtgataatgatgagagggtgctggctgaactcagaggtagcagaggagaggtgacaaatggttggattttgagtgttttaaaagtggtactaataggacttgctaatttggggtgaggacagaagtcaaggatggctctgagtttttggttatagctaggcaggttggtggcctagaaagcagatttggggagctcagtagttcagcatggattttgttccacttgagaggaaggactggcacttggacatacaggtctgggtcctcgggtgaggagctgacttgaatgaagaagccctttcccaaggctacttgattgtctcaggttagattagaaggcctgatcccaggttttggaacgtgttctatcccgtcatatcttatgactcccatccatcccacgaagccatggacatcgcggtggttacagggaatgtccatggcagccctgttggtctggagcatgaattggactattgacatgatcaggtaaaaagctgccatctttaggctggaagagcattaagatagattttttccatcacctcatgtctcttggagtaggggcagtaagactggaagagaaaagttaggaaaaaataccattttgtcccaagagaatccaatataagaaaaagcatattctccttattatttttaatgaaaaatagtagcttccacttagtggatccttgtgtaatatttactaattaaaaataaagaatatccaaaaagatggaagtctgaatctggatttcttttttgaggctggatatcactctgttgcccaggctggagtgcagtggcacgatcaaaattcactgcagtctcagcttgcccccaggctcaggtgattctcccacctcagcctcccgagtagctgggactacaggcatgcaccaccacactcggataattttttgtattttttgtagagacggggtgtcgttatgttgcccaggctggtcttgaactctt

SEQ ID NO: 90046 - DNA, 1048 bp, Homo sapiens
aactgtgtgttaaatgctttttaaaaactcgctgtgattttggctttggggttcatggaactccacgtggaggctaagtggtagggatgccccaggtgcctctctgccctgccggtattcatctgtccagcccgtgctgtctcatgaggcagtgttcttgcttagggcagctcaatgttcccatgggaaatagtgacatgggggatgtaaaacacccacttttctttgagataatacaactgtgttgccaagtcttgtgagaatgtgaaaattaatgtgatgtttttgcaaatgtgtttacttggagtgctttgaagagcaaggtccttttaattagaatagtactaccagattgatagcattgggctctaggtaaggacacatttgaggaaagactgtataatgcacttctctggcaagtcaccaagttcccatggcgggggagtgggcttcgataatgtcaaaacacatataaaataatataaactctttgctccagtgtgaatcccagctctactacttggtggttttgtgaccttgagcagttttaatatctgtgctttaattttctcatctgtaaaatgagcatccaattggtacttaaactatagggctgctgtgaggattgtgccttaatacatgtaaaatgctttgaaaaattcacgacacataggaagtgctatgttagtaatacctcccatcgtcatcactacatcttgccaagtctgcatgttgaatgttttagatgctcaatggatgtttgttgaattttgtgagtcgtatgaacttcatctttttgaaagagcaatttgagaccacagccagaaacatcactcgtttgcagatgctattttcaaatgtaggagagcccagaaacctagtgccctggggaaattagagtatctttgtttcctgctacctccctgactaacaagctactctactcatgaccataagagccagtggaaggcatagcctgaactagaacttgaagttacaccactttcatcccttccccaggattatgaagggtcttactggcagaagg

SEQ ID NO: 90047 - DNA, 1096 bp, Homo sapiens
caaacgcccctgctctccggcgccccctgccgggaagagggaaggcggcggcggccgcggaggagcaggacgcttggtccggacggagctcggcgctgggaagaagccgggagcttccctgatggtgccgccgcctccgagccggggaggagctgccaggggccagctgggcaggagcctgggtccgctgctgctgctcctggcgttgggacacacgtggacctacagagaggagccggaggacggcgacaggtaagcgctgcaagccccagcggagggcgagctcctgcttgatgcgcgcccggctcgcggggtgcgggcggtcctccccggcgcccactcccacagcgatccgcacgccctcacttctccggggataaggagagtgctcagctgtcctgggcgacacttccctccgctcccgggtatcagcctttgcgccctgccatccgtgggtcgcgtcagggatacccttcgccccgcgttcctgcctccccccgggtgccacactggctggcacagctcgtgaaccccgcttcctttctcctggagctggttcgcttcgtcgtgaccctcgcgtggctcgtccctgtggccggagtctgccccgcgtacgcgtttggggaccagcccctgcccagagcgccgggacggggagcctggcgatccccacgcgccagggattccccagcgcgcgctgcccgcctccgctctcccgctgagaatcgaacatttcctctgcactttttcatagagaaatctgctcagagagcaaaatcgcgacgactaaatacccgtgtctgaagtcttcaggcgagctcaccacatgctacaggtaagcctgggggctctgcgggctgttcgccactgcgcaccggggctggctggggaggcggcgctgtaaaggaggggtttggagacgcgcttgggaccggagcagcttttacgctggaacctgctgggtgcgtgccgcgcggtgcgaatctttgagggttggttggatcggagtcagagcaacactgagcaactgactttgcgtctagggtgtgtgccctgagatcctgaggatggttgccgctccctgaaatacttgtgt

SEQ ID NO: 90048 - DNA, 1066 bp, Homo sapiens
gaaaagtttccttttccaatctcttttctgggcttgtttacccaagtctctaattgccaaggcctctggtctctccccacccacaacgttcctcctggttaaacccttcccctcccgccactcccagctcccgccactcccagctcccgccaccactgccgctgacgacgtccagcgtttgcagatggtcaaagccgacccccttctcctcccacctcgttttgtaaggaagtaatttcggggccgagcgctctgcgccccccgccgcgggtcggcgccgccgcgggtcgggagcgtgtccgggcaggtcgcgctcagcggggtacttccccgcccgcgtcccgcgtccgctcccataacgccgtctgcggggcggggacaggggcggggacaggggcgggccgggcgtctagtttccctacgtcaccagggaagttctcactggacaaaagcgtggtctctggcgcggggatctcagagtttcccgggcactcaccgtgtgtagttggcatctccgcgcgtccggacacccgatcccagcatccctgcctgcaggactgttcgtgttcagctcgcgtcctgcagctgtccgaggtgctccagttggaggctgaggttcccgggctctgtagctgagtgggcggcggcaccggcggagatgcctgggaagaaggcgcgcaagaacgctcaaccgagccccgcgcgggctccagcaggtaccgacccgctggggccagcgaagacccaggccgggcggggtcggggccggggtcgaggtctcggctggggcgggctcagctcgccggggctcaagcacagactgcacgggggtcaaggtcgggccaggtctgtgccctggcgcgagccttaggggcgcctccagaaagttcttcggggtttttccccaggaccggcgggtacggcgggtacggcgagggaccaagccggatttgcgattgggatgcagctgcgtttcaccaggggcaaaaagctcctttcctcctctctttcctcctcgccacttgcccttccccggggccacgaggaacaagtgcaagtgtaggcg

SEQ ID NO: 90049 - DNA, 2331 bp, Homo sapiens
tttgtagcattgcttttaaaataaacaaagtggttttacaatgttctcacatcccaaagaatgataatgctactctttgtggtatttgacatatttgaaagtaaggtaacacttgcctcatccaggatgcgttttttaaaaactcaaagtaaatgtctttattcttaccttaacgattgctttcggtgagtcacaatgtgtgtaagtgtgtgtgtgtgtcacatttggaaaacaggtgcacataaagccaaagttaagagaaatgcttcctgggatactcaatttgtcactagtgtgggcgtattaggttttgctggttacagtctgtaatatcatcaatgttcatgtccatgttttgctttccttctcagagctggaagtcgagtgtgctactcaactcaggagatttggagacaaactgaacttccggcagaaacttctgaatctgatatccaaactcttctgctcaggaacctgactgcatcaaaaacttgcatgaggggactccttcaaaagagttttctcaggaggtgcacgtttcatcaatttgaagaaagactgcattgtaattgagaggaatgtgaaggtgcattcatgggtgcccttggaaacggaagatggaatacatcaaagtgaatttctgttcaagttttcccagattatcattctttgggatgagagaacattataaaaccactttgtttattttaaagcaagaatggaagacccttgaaaataaagaagtaattattgacacatttcttttttacttagagaatcgttctagtgtttttgccgaagattaccgctggcctactgtgaagggagatgacctgtgattagactgggcggctggggagaaacagttcagtgcattgttgttgttgctgtttttggtgttttgcttttcagtgccaactcagcacattgtatatgattcggtttatacatattaccttgttataatgaaaaaactcattctgagaacactgaaatgttatactcagtgttgatttcttcggtcactacacaacgtaaaatcatttgtttcttttgactcaaattgtattgcttctgttcagatgatctttcattcaatgtgttcctgttgggcgttactagaaactatggaaaactggaaaataactttgaaaaaattggataaagtataggagggttacttggggccagtaaatcagtagactgaacattcaatataataaaagaacatggggattttgtataaccagggataataaaaagaaaaaagaagttaatttttaattgatgtttttgaaacttagtagaacaaatattcagaagtaacttgataagatatgaatgtttctaaagaagtttctaaaggttcggaaaatgctccttgtcacattagtgtgcatcctacaaaaagtgatctcttaatgtaaattaagaatattttcataattggaatatacttttcttaaaaaaaaggaacagttagttctcatctagaatgaaagttccatatatgcattggtgaatatatatgtatacacatacttacatacttatatgggtatctgtatagataatttgtattagagtattatatagcttcttagtagggtctcaagtaagtttcattttttttatctgggctatatacagtcctcaaataaataatgtcttgattttatttcagcaggaataattttatttattttgcctatttataattaaagtatttttctttagtttgaaaatgtgtattaaagttacatttttgagttacaagagtcttataactacttgaatttttagttaaaatgtcttaatgtaggttgtagtcactttagatggaaaattacctcacatctgttttcttcagtattacttaagattgtttatttagtggtagagagttttttttttcagcctagaggcagctattttaccatctggtatttatggtctaatttgtatttaaacatatgcacacatataaaagttgatactgtggcagtaaactattaaaagttttcactgttcttttctgtgtgttaattttgtcttcatcttgtaagctactaattactaagtgttcattatcaagccaaagtattttaactgatttccatcagcagacatcctctgaccttctgaccacactgtctcctcccagtagttggagtagaaaatataggggagtttgcatgatttctgctctcaagggacttacactttaattgggaggggaaatagtgaaaaataggaaatgaatgcccaacataggtcctttttttttttttttctgagacagagtcttgctctgtcgcccaggctggagtg

SEQ ID NO: 90050 - DNA, 1026 bp, Homo sapiens
gagatgtcttatttaccaacaaatccaccagggagcattcttatttgctggctcggcgtctctctcagcagtcaccggagtgccggagggggaagcgcgatttacggaagactattacccagaagaaaagatgtttgtttttcacaagccaaagatgtaccgaagtatagagggctactgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaaaactggaatcatgtggtagatgcaagggttggacccagtctaaagactacattgaaaccaaagaaagtgaaaactctatctgggaacaggataaaaagcaaccagatcagtaaactgcagaaggaatttaaacgtcataattctgatgctcacaataccacctcaagtgcctccccagctccatctcctcgttacagtaaccagtcagatgacggctcagatacagagatggcttctggttctaacagaacaccagttttttcctttttagatctcacatactggaaaagacagaagatatgttgtgggatcaactataaaggccgttttggggaagtcctcattgacacacatcccttcaagccttgctgcagcaataagaaagcagctgccgagaagccagaggagcaggggccagagcctctgcccatctccactcaggagtggtgactgaggtttttatgtagaaggggaacaaaaaaaatctgaattttgaaaagaccacaaagcagcaaactgaccctctttttttttttttttttttttttttttgagacggagttttgctcttgttacccaggcaggagtgcagtggcgtgatcttggctcactgcaacttccgtctcccgggttcaagtgattctcctgccttagcctcccaagtagctgggtttatat

SEQ ID NO: 90051 - DNA, 1085 bp, Homo sapiens
gaggcacgatattgaaaatgctgcatgaaatcttggttctgtcgcccaagatacaataataatccacgggtaaaataaggatttacccagcaattttaaagattaataaaatcatatgtataactagtacatgctcaataaatgagagctgagatacagagatgggacctttaaaaatggagcatgaaaaaagagacccttttccttggcagttaaaaaaatggaacatttgtttaattaaaaaaaaattgtcaactttttttttttttttttaacaagcactggcaaattttattaaagggaaattttgcatggtttatttttcaccagtctgttctggcatgcttctaatggtgtcagaatcacctggatcaatgatagccagtgtgcatactctgtagtattttcctcatgctgcgcccagttcaatattattgccactgtagtgatggacaccagttttgaccaacattgcatagtactccatttctgatttcttcaaagttggacagttgttacagagaatgaccaattttgctttgccttgtctgatcatcttcagagtctgcttgtaccccagcacatgcttctcactttttataacaagttagagcctagaattgatcaactccagcgacttttttgtcttctttgcagccaccatctttctgccttaggtgtgggatggcccccaaccaggagctgctgctaagatggcccgggagcgagaaaggccattgtcaactcttaaaagactgatatagggttgggtttggtggctcatgcctttgatcccagcactttgcaaagccaagtgaaagatggcttgaggccaggagtctgagaccagcctgggcaatataccaagacccccatctttaaaaaataaaaataaaaataaaaccctaaaaattagctggggtaggccaagctactccagggggctgaggcaggaggattgcttcagcccaggagttcgagactgcagtgagttatgatcacaccactgcactccaggctgggtgacagagcaagaccccatctctaaataattaaataaaataaattttaaaaaactattataa

SEQ ID NO: 90052 - DNA, 1058 bp, Homo sapiens
ataaatctgaatgtcttaaaagcattcttgcttgctctctctgttatagatggtgtcttagccagtcctgagttttccaatgaacccaattttaatatatggtatttttgtatgccaaactggtgtcttgtcctttgtatatgtggtaatgttgattttatgactaccgtaaaaacacatttgctatgattaaagttcataaaatgatttcaaatagactcacgtattggttttttcccccctcctaaccccaggaaaagaaaaaaaattggctgagattttcatcatcagttattctaaggattttagtagacttgggtgataaagcagtaagaagatcctgagccaaggattttaagtggaggtgactttcaagtagctcctccgagaggccaaagaacacatctttaatgagtaagcccaagcttgtctttgcaacttgggttttcttctggtggcccttcctttatcctccagtgtttagaaattgtgctgcatgccccaggtcccaagtgaaccatatacagaacaacttgttgcaccgtatacagaacaacttcatgcagcccctgtgaagtagggtagagtgacttggcctcttggccctgagcctggaaaggtgtccttcaattaatgttctcatgaatagggtattttggagagacttttttgataaaaagcatcctgtcttttgataactggatcatatcaatgaatttcaatttagtttagcaggtaccctactcctaattaagggctatcaatgacctgatatgcatgggtgcaggtgtaagcatgctctggctttctgggaaattataaagtaatccccacagttttaaaagtgagatgtggccaggcacagtggttcatgcctgtaatcccagctttttggaaggccaaggctggaggatcacttgaggccaggagtttgagaccagcctaggcaactcagtgggacccctgtctctacaaaaattaatgaggaaattagccaggcatggtggtgcacacctgtagtcctagtttaatcatgaggctgagcctggaagtcgctt

SEQ ID NO: 90053 - DNA, 1529 bp, Homo sapiens
gagagcgtgaggtttggaataaatggaaatacttttttatggtataacaagttatatggtgacttgcctgtcttttccttcatggataaaaatcagagtcaacaagcccaacgtaaaagcctctgtcaaggaatacaaatgcttctagcaaatcctagtgacactgtttctttcatggtttcctgtccaaagtacatctgcttataaactttctcatttttgtttacatcattgttgtgccaagttcatggatgcataaaagctgaggaagttggtgggtaagtggcttgtctgagtttatgaagatgataagcttccgggtgtgtgcatgtgtgtgcgtgcgtgtgtgtgtgcccactcagttacatgagttttccttttcattcatttactggacattcatttactttgaagttccttctaaaacctgtacttattctaatgatctgtggtgtcttcctggcaccctcctggatcagctaagttcttgatgccaaactttgctacatcctttattgaaggtgtgagtgtaaagtaaacctaaacaaatggaaataacacaaaagtttgtgttcctttatcaagtgggtctctgggtgttcacctttagtgccgtctgtggtgaggtgacagggcattccacatttagttcttttccagtaacagaatctcttgtcaggtgcaggagacaatacctccatggcccatgtttatttggaagtaggggttgtttttatgtatcctaaaagatgaatcttggagaccagttttctttgaacacttgagttgcttggaagtatgattggaagaagacccctgacagcttttgaccccacctagtgattttgtggagttagcagttgaaatttgaggatagacattccctatttctttggattttactaattagggttttgtggtcagtgaaatgattaagactgggctttcctttagctcatcctacttagagagacatggtgaacttaggaaattttatataacaatcgagattacctctgagatgttagaatattctcagaatctcttctgataacctcaaatgcttataaaaacctgtgttcttacaaatggtgaatgctttttagttactctcatcatgaaactgggaaccctaagaacctcaagtataggcaatttattgtccatctgattttaagtcatctatgaagatgtgtggatgctgctggtctttttgcactgttgcctttgtaatgcctgctcctgacttgactacatgcttccctgctctgtctttctgccacataactacaaggcacactactgatttatgcttttcattcatttcctggacattcatttactttgaagttccttctaaaacctgtacttatttttttttatttttattttttgagacggagtcttgcttttgttgcccaggcaggagtgcaatgggtgatcttggctcactgcaacctctgcttcccgggttcatgagattctcctgcctcagactcctgagtagctgggattacaggtgcctgcca

SEQ ID NO: 90054 - DNA, 1005 bp, Homo sapiens
ccagtgtatatagttatgtgagagattctgtcagagtctgggagcttaggatttttcggaatacactactaaaaagctgtgcacaaaaaaaattttttttttttttttgagatggagtttcgctcttgttgccctggctggagtgcaatggcgggatctcggctcactgcaacctctgcctcctgggttcaagcgattctcctgcctcagcctcctgagtagctggggttacaggcgtgcgccaccacacctggctaattttgtattttttcagtagagatggggtttctccgtgttggtcaggctggtctcgaactcctgacctcaggtgattcgcctgcctcagcctcccaaagtgctgggattacaggtgtgagccatcgtgcctggcctcaaaaaaatgtttttacaatcctccctctctagttactgtttcttcctgaccccataccagaaagtggaataaatcatacccttttgtattcccattcctttgtgtagttccctttccccggaacacgctttctccctatccttcctctctgccctcccgcaaaacacagcatagtgatggaaagctataagtaccatatatacagtcgtcactcagtatctatggggcactgattccaggaacccccttagaaaccaagatccatgcatgctcaagtccctgatatgatatgccatagtttttgcatataacctatgcacttcctcgtgtatactttaaatcgtcactagattacttataaagcctaatacaatgtaaatgctatgcaaatgtaatgtaaacatgatgtaaatgtaaacacaatataaatgtaagttgttgttatactgtatcgtttagcaagtaatgacaaaatgaagaagtctgtgcacattcggagtggaggtaaccatttagtattatttttcctgaatatttttgatccatggttggttgaatccacagatatgcgacccagatatggagggcagactgtactttcttcgatactt

SEQ ID NO: 90055 - DNA, 1072 bp, Homo sapiens
ggtggagccgccggggagggcggtgccgcggggagcggagcccagcctctccccccaccccctttggtgccggagtctcagtgacacaaaaagctctcgctcggtgccgagcgcctggcggcggtgtccgaccgcgaacgcggagggcggccgggcaggtgggggtgccgcccgaagggccgggccgggtgctggggctgcaggcgccgccgccgcgctgtcagcgtccgccccgtggctctcggccggaggagcggcggccgccggcccggggcgcgagtctggctgaaaggagcgggcgcgccgggaccacccggcgatgctgtcgccgccgccgccgcctctgtagcgagcacccgagcccgccgcggagaaaggtcagtgagtttcggtttgtttctctgctctgccggctccggatcgggggcggacagaggggtgcgcagggatgtctgcgcccctacggcggccgcgccgaagccgtggaagcgggaaagggcagctgccgcctgctgtaactggggagatcttctggaccgcggagggggtggcggggccgcagggtcccggggaggggagcgcggggtctggcggggcacgggggaggtggtcccgggagttgcgtgtctcctgagagctggcggagttgggcgggcggccgcggcggggagcggcgctgtcggctgctcggccgagtcctcggatgccccctggagctccggtccgagggagctttcctcgtgcccgcgccgcgcgcgcccctgggtgtgcacgtgcgcgcgcgcccgccccagttgcgcccccggcccgcacacaccccggctcatcttctcccggtccccttgtctcgcgccttctccagccctagaagttgccccagggcccctcccgggattagagagcgctgtgaagggccagatgttgggggtcttttgtgcagacacacgcgcctggggcgcttgctcctggaaggacagcggcaggacaaagccagctggactcgtggggcgctgctcgggaagcggcggtccccaatcccgcctggggtcggggcatggcttggggagcgctg

SEQ ID NO: 90056 - DNA, 1048 bp, Homo sapiens
gtgagtcctctacacagagtgaccacttacagaaaacctctctcctttgtctgtttcctatgccttctgctccaggtgggtgttcctgctcatggttctttcatgccatcccttctttcccagactcctctccctccttatcttctgacccacaaccctctcttcatttctcagccctccagaaaccccctggagataagctaagaataacatgtttcttctaaagggaaggatatacattcaagaaagaaaaagagaaaatttagagtgcgagggggcagagacagaaattaaaagagggggcgtacaatagccccaaagtggaaacagcccaaacttccaacaacagataaatggataaacaaaatgtggcatatacatacaacagaatattactcagccatgaaaaggaatgaagtgctgatacatgtcataatatagacgaaccccaaaatgttatgctaagtgaaagaaaccagacacagaatgctacatattttatgattccatttataataaatatccagaatagatgtatccataaagacagaaggcaaattggggttgccagggatggggtgtggaggttggggtaggaggagataggatatgggtatgggctttactttggagtgttagaaatgttttggaactagatagagatggtggttgtacagcattgtagaggcattaaatgtcataaaattgttggctctaaaatggtgaattttatattatataaatttcatctcagtaaagttaaaaaaatttatgaaggggagaaagatgtgtcaaaacttccaattccacttcttttagatttcataaccttcacattggcctttctcctaaattgtgtctcagagaaagtttcacatttaatttagatactaagccccacggattggtcctgggttgacctccaaatcttgttaagtattgaatcagtcttcagtaaaacagccctaataacaatgggaagaataaagtcatcctgtgagtcagtgagaggactgggaatggatcccgaggagcattaccttgcagt

SEQ ID NO: 90057 - DNA, 1141 bp, Homo sapiens
gtaagcaaaattgtgatggttgctgccttcatggagcacaaacaaatgaaaaatagcaactgtggtttctgcgaccaaagagagcagtaggtgattctgtgagagactgtgatgggacatgggacacctgacctagtctggggagtcaataaaggcttccctaaggcaatgcttgacctgcaggtgggagatgagtcatttaaatggtaggagggggtgcatagttggtgttcagggcagatgggctatttgtgcagtgacccaggggctggtgggcttgcaggttcaggaactgaaagaagggcaatggagggcaatgcatctggagtacagagcatgaaggctggtgtcaagagatgggaaagaatagaaagagctgtgttttattcacgaggagaaaccctcagaaagtgggacagggcacctgatcaagagcatgctttctcctataccctctccattctgagtcacggagaacatgctgtaaggaggcagaagtgataaaaactggtgacattaaatcagtctttcatctggcgaatgtgaagagtgcctaatatgtaggaggcattgttctaggtcctaggatgtaagagatgaaccagaaatgtcctgatttctcctcataagtctaacagtctaagtaggatgtgacaattcataatcatagtcatatgaataaacagtgcattgcaaatgacacagtgctacaaaagaacagtgtaggatgctctgagatcctaacaggggtcctaactttgcgtgtgtttggcaggaggctcaaggatggttcccactgaagactaggttgactaagagttattggtataattattagaaagttactgggaacttcaattatccctcctatttctactcccaatctttatttcattaggtgaccttgaccttcatgcttcctccctcttattaaataaaaactatgcgaggccattgttttggactaaactcctgcactgggttccaacagaccagactaaaaatcaagatggaatcacccatgctcaccaaacccaccctgagttgttgttatctggccttccaagaaatcagaagagagagatagcccaatttcccaaagagacgagtttcaatcttcaatcagcatgaaaatgatatt

SEQ ID NO: 90058 - DNA, 2000 bp, Homo sapiens
gcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaagggtgctcagtttttttatctttctttattttgctctttgaggcatatctttttcttaattttgtcctttcaggtcagtgtgagtctgtagaataggttgaacttccttctgacagtatcatagagtttgtggagtttgtgttgtgtgcctgcagccacaggctcgccttgctgcaccgtaactggccccttcagactcacatgggaacaagccttttctgttgcagtttcccagatatctttaaatgttttgaaatgtatatttttatgttgcaaaacagaaaaaagaaacgagttagggaaaaagtatttctatttaaggtatttattttttcattctacctatgccatagatttctgaatcaagacttaggacatttgctgattaacaatgtttaaattaggaattgttataagaattaaaataggcagaacaagttgtgaaaatattgaaccaaaaaaaggccatgctatcatcttagagggcccatgaataaaccttagagggaatcctaaggctttaggaaaccgctgcagcttgtctgtcattttccaatatgttaattattatacttagtgtacagtatttagaatacaaaatgcttttttattttttaggaaaataatgttataaatgattgtatattttcatagtaatgtctttataattatttattaatgatagagctgaattagaaaagctcttcatccattataatatggtttctcatgaaaaacttattacaaatttcagccaactcagatattaagaacatcagtgtcaatcctcctcccctcctgcgacctttttacacttgttttggtggactaggggctccttttctcctcctttttgacatataactgtgccattaaaaacatgatttctgatgaagctggcctagagggaatgaaggagattgcgtgggtatggtctctaggacaggcgtagctgttgcagggccaccctgtccttgggagaacctggtgagctcccatattcacactagatgccatcatgtcagggggctgaagagaatggagctaatcaactctgtcatttggagaagacccccttcagaccagttctgagaactccttcttttaagagaccagagataacttgatcatttctcaccttttcgtagttgttcttttttatgttgacattccccttactgtttttaaaatgcttcaaagcattaatgattgttatgctgtgtgctttcagtactatggcaatatctttgtagcattttcccatttctgtataagcatggttttttgtttttttttttttcgtttttgttttgagacagggtctcactcttgttcaggctagaatgcagtggcaccatctcagctcactgcaacctctgcctcctgggctcaagtgatcctgccacctcagcctcctgagtagctgagactacaggcacatgcccccacacctagctaattttaaaatattttttgatggagacagggtttcactatgttttccaggcagcagcatttttttttgactgggatttctttatgatgctttgttatttaaaaaaaaaatgagaaggaaacattaataatcaaaattatctttaattggcctcacagggctaaaatctagaattattattactcttgggtaaactcatgaaaagtacttaatattcattctataaagaaacaaaaagaacctttgagatgtgtctcttattcatttccttgggtacacttaaaacgggttacagttactgct

SEQ ID NO: 90059 - DNA, 1424 bp, Homo sapiens
ttccacagagctcacaggccagggtagaggccagcaacctatgccctttagccaaatgcagcccacctcttgattttgtacagcctgtgaactaaaaaaaatttttaattaaacatttcattttaacattattatagattcacatgaggttgtaagaaataatacagagagatctcctataccctctaccttatttccccccagtggtaactttatgcagaactatagtataacatatagtaaaaccaggatgttgacattgaaactgtcaaaagacagaacatttctaccagcacaaggatccttcatgttgccctttatagcccaggcacttccctcccacccagaaaccctccttaacccctggcaacatttaatgttttccatttctgtagttgttacttcataaatatgatacaaagtaaatcatatagtatgtaactttttggagttagcatttttttcactgtcagagtaattctctggtgattcattgttgcgtatttcagtagttcgttacttcttattgctgagtaaatccatggtatggatgtgccacagtttgtttaatcattcacctgttgaaagacatcaaggttatttcaaggttttggctattatgaataaagatcctataaacattcttgtgaacagttttttccctctggcatgcatgctcagaatcatatttgctgagtcttatattatttgcatgctgagttttaaaagaaactgccaccagagtggttgtaccagagactgtcaatccagtttctctgcatccttgccagcatttggtgctgtcaatattttttattttagctattcaagtgggtgtgtagtgatatctcattttggcttcaacttgcataatagttaatgatgttgaacactttttcatctatttatttactgactttatatcctctttgatgaaacgtctgttcatgtcttttgatcattttctaattgaattgtttgtggagctttttttactgttgagttttgagaatttattctatattttattctaggaaatagtcctttgtagctgagtgcagtggctcatgcctgtaatcccaacactgtgggagggccaaagcgggcagattgcttaagcccaagagttcaagaccagcctgggtaacatggcaagaccccatctctacagaaaatacaaaaattagctggctgtggtggtgcatgcctgtggtctcagctactcaggaggctgaggtggaggatcacctgagcccagggaggtcaaagctgcagtgaactatgatcataccactgcactccagcctgggtgacagagcaagaccctgcctaaaaaaaaaaaaaaaaaaaaataggaaaaaaaaaagtattttgttgaatgtgtggcttgcaagtgttttatcccagtctgtagcttgtctttt

SEQ ID NO: 90060 - DNA, 1064 bp, Homo sapiens
aatgatggcacaatagtcatgggaggggagtgcgaacagctgaactcatttcaagttgaaatttgatgttcctttaactctgctatggcgagatgacaccaagacttgattgatgcaagataacacaagctggatgccttatggctcaattgcatgaagatgatgagcttcacaactgtttcctgccaattatgttagcttacatgagccaagagtcagtaatttcaggccactgtaaggaaatgagtgatctgtggaatgccttttatagacagactttagattaaatttgaggatgggtcacctactggttttacaaaccgtttttgtttagacatcaaatcagatttaatattttaacctgtaagtgatggcaaaattcagcaagaaaaatctgctagcatgtaatcttttctttctttgtttttattcttaacagctttattgagtataattcataccataaaatttatctattttcattttttaatgatttaataaatgttttaagtcattttgatgatttttggcaaatgtatggagttgtgcaaccatcacaatctattttttgaacatttccatcacacagaaaataccctctacctgttcacaatctgttcccattaccatcccaagcccaggcaacaacaaatctgctttctgtctctacagatttgcctattgtggacatttcatataaacagaaaaatacaatatgtagtttttttcatctaacttcttccagttagtgtaacttttttttggcattcatctatattgcagcatgtaaaagtactttattcattgctgaataatgttccattgtttggatataccacattctgtttatcctttctataatgcttataaaagattaatcttttatggtccttgttgcttttaatctacctagctccccacctccttgcctggtttcccccctggaaccaaggtcagattgagcttttctggatttgacctccaggctctatgctgaagagtttgtactccttcactcatctcatctctgactacaaactttggtccctgaagaagttgggatg

SEQ ID NO: 90061 - DNA, 1024 bp, Homo sapiens
cttttcttcctattgcaaactagcttctcatcctgttttctttatttaatacatcacacaagctgaagtccagccacccttactgccatactgcttaccaaataatcactgatatcatctctcctttctgttcaccttttaacagtcttattatttatattgctaatcattttcttacaactgttggaagcctacagttaagatgggggtggatatatatactaatgacttatttgtttattaggtctataatgccaaggacgagttcagtataacaaaccagtgaaatgattctgcttctcttccgactcactccttaaaatgtgtattgaacaaaagtgaagtagaaaagttgtattaacattgttttttttcataacttaaaatttacttttctaattattaataatttatctagtgtctcagtgttaataattgggttcatcagcaaaaccttgtaaattttgggtagagaccacaaaaaggtagtagctgtgcatgaagattacctgatagtttatctgttaagaatgcttatggatgtaagcaatgaaaatctaactaacagtagctcagagaaatagagatttatgtcctcacgtcacatggagtctggaggttggcagcccataactctgtgatgccatcagcaaccctgcttttctgcattcctaagaatggtagattcttagattgttgcttttaccctcgtgtttttctcatcatgcctccatctgccatcgtatctcatctgccatccagacaggaacaagggaaaaggactaatgaggaaaaaggcaaggagatatgtcagccgattctccttttctgtcagggtagcagtgtctttcccaaaggccccatgtagcagatttctgactatgtctctatggccagaactctgtctggcacacattcattttaaactggaaggttgttagggaaaaggaaggtgtgggggtgtgaaacaacctgccaaaagtgtcacaattgtggccagttcatttcacagtttgagatgaca

SEQ ID NO: 90062 - DNA, 1010 bp, Homo sapiens
tgttgactgatgtgtctagaagtgagggccctgctgaattctattttattcatatgtccttcacttgaaaaagaactgtatgctgccttgaacatcatttattttccatatctccccctgttttgaaacatcaagttatatatatttttcaaaattgataattggaaagcaatacctcaagatattaacagtattagctctggattatggattttcaaccagcataaattttactatagctttatttcaaatgttttataaattttttcatatttgttataatgagtgtgaattttataatcataaataaatgtatttttttaaaaaaggcaaagattaagaagctgaatcatgtttataatgttatagttttaaataaccagatgggtttaaggatctgtgaatcaaattatcaggttatataatttatttgatttgggcattctgtgcttttcacaccctcttggaatcttttgaacattgtggttaattattagaatacattaaatggaacaaaatttgtaataggcttttatttggaatatgtattgatgtttgctgtcttttacatcgtatagcttattaatgtaggtttttaagtcagtttcatcaccgttctatgtgccattggtatcatgcttttatttcagtgtttgctcttcactagtatatataaaagttacttgagaaattgaaaatatttctgtaagcagaaatagtatttttttcaaaaagtgtttcagatgcttcagttattccttgcatcatttattgttcttttacagattttaatcccctttgttcttgttatgtgtgcttttgaagcagttcagttgactactcagttatcgtcaaaaaggtaagatgaattagtttaagaaacatttgatttgcctatttttaggagatgagagtaaactttcgaagacatttcatatgattgctattaagacactgtaacatagattgtttattacaaaaatgagaaaattttcacccgtttagtcagt

SEQ ID NO: 90063 - DNA, 1001 bp, Homo sapiens
caaaaagatgttcagcattttctcatgtgtcattctctattgaattattttaaaacatggtatcttgtttcttcctgagcctttcaagtggtctagcatgtgcttagcaggtggtgggtttacggcaagcatatatagactataactgtgtctctcagctgaaaatatctatgatacacactagatccatgtttttcttttgaaaaaatcactagcagcccactacagatatggtccaccttgctcatattagggaagaggaaaataacttactaggaactgagtgaggatgacctctcaggcctcattattctcggtacacagcctcttcaatctggctgttttaaaatgcattcacaaggagttataatggaatgttcattgaaaacaattcatggtacaagtaaaagagcaaattactctcaaggtaaaattagcatatcttttctaaatgaaaaggaaatttgtatgaaatctgagttgttttgccatttccttgactccctttaggttttcttcttagtgacagcattttttggaactggaaatatagcttctattaacaggtaattttaaatgaaagtggcatatatatataactaaaaaataatgcaacctgggacttctataccttttgttctgtaccttattatttttttttctttttgagaccaagtctcactctgttgcctagactggagggcagtggtgtgatctcggctcattgcaacctctgcctcccaggttcaagcgattctcatgcctcagcctcccgagtagctgggattacaggtgcccgccaccatgcctggctaatttttgtatttttagtagagacggggtttcactatgttggtcaggctggtctcaaactgctgaccgcaggtgatccacccgcctcagcctgccaaagtgctgggattacaggcgtgagccacggcacccagcctgcaccttgctttttatactgaatgatatattttggagattggtatgtattg

SEQ ID NO: 90064 - DNA, 1033 bp, Homo sapiens
ttgttttaatattggcaaatatgatatatcaccattgttttcatttccatatgttatcaataaggtcaaacataattttcgtgtttgtgttcttgttgcgcccatttttttgaaaatttagagtgttccttttcctcttctatgtatgttaataattttacctcaagaattatctttttacctttgtcttcatgccttctttctcttttatgtatatctgtcatttgctttatgaatggcttttatatatttctattattttaaacacataattatctcaagatttcacatcactcaaaaaagatgatgttggagttaaaatttaaatattactttcctactttcttcttaagttttgtaatattgtgacttagaagtattatcaaattgttttaattttgagaaagacctcagtgtaaatttgcatttttacttattttactgtttttttcttttcatttctacctttccccacctgttaggtatgaagctctctttccactagtgttgtcttgtttgatgtttgtctggataaacatagaacaagaaactctacaacaatctggtgtttgctgtaaacaaaaggtagctggtcaaagtcatttttgtttttatttgagactattagtctctatcctataaggaagttgcaatattatttcaaaaattctttctacttaaaattttagtgttaaaagttttagttgtttggcattaataattaagttaaacttaataatagataaggaagattttttacttatcacagaaaagcacaattttgttgttgtataggttgggcttttcttagtgattacttgaggatcattgatttaaaaaagtcaatataagtgaaggaatacagaaaagaatgctttttatcttattttcttcatatttcacatccaatttttccttccgtcaatttatcttggaagaattttaatgttgtcacaagtcaatttatgaattttattataaggtgacatttacgtttctattgttgtttttcactttctggtcatcctaatcc

SEQ ID NO: 90065 - DNA, 1020 bp, Homo sapiens
ttatttgctttttatttttttatttcttaacaaccaccgtatgtccaacagattaactgacttttaaaatcagacatattgaaatgttattccttccagttaaaatatgtatcagtttattatgattggagctacacatctggaaaaaaagtcagaagctactcatctaagggtattaaaaaatgtaacttcatagtcttaaatcttgcagtgacttgactttaggtgaaattgacattacatgtaacttaatttagaagatgttgactaataataataaccacagttaacagttactaagcactatgtgctaggcactatgctcagggaacattgtataggtgaaattgtatttaatcctcacaactttttaatgttatctctatttgacaggtgggtaaatttctgcttggatcagttaatgaacttgccctatagtttaaacagttagtaagtgattcagccgggatttcatcccaacttgtctatcttcaacctctagagcactagggggattagaaagttatgcacatttccttcccagaatagagatggaggagtttatgttttgccaccccacccacttcatctgcccttcctccacttgggtagttgcttttattatcccgggggagagtcgatacatctctcatgcatggtgaagtcattcctgtttctcttttccaaggggcatactgcaactgtcagtgcatactttacggtgggaaaacttggagaaggaatgggttaggaaaaaatcagtttctgaggagtaagttgtctttgaactaagatataaatgcctaattaagcaaagagtgctaaatcttgagtaatacttttatttcattagaaaataattcatttttgggtatatacccagtaatgggatggctgggtcaaatggtatttctagttctagatccctgaggaatcgccacactgacttccacaatagttgaactagtttacagtcccaccaacagtgtaaaagtgttcctatttctccgcatcctctcc

SEQ ID NO: 90066 - DNA, 1047 bp, Homo sapiens
agctgtttttcctgctagaaataatgtgggttatatatgtagatactttttgcatgagtaagtttcataatcacaaaatacatgttgtagatactgataatatacttgtttagctatcttttatattgtaaatttttgtaaatttgcccaattcaggctaaatattatagtatttgatatgcctaaaatttttttaaattaaattatagaagcaaggtagagatacttagaaaattgtggggagaggttacaaataaccccatccagcagtatctttatcctaagattaaaagttttcttaaaatcttaaaacttaaaagttttcttaaaaatctgaaaatgtacccattttgctacttcctcttgattaagccaaatgactgagaggttctgtattagagtaagatgtctcatatttccatctgatatgtgttcgtaaatatctgaagaaaatttaaaattaattgtatttcaaaacaggatgggtgcaggcttgctggttcttctgttatccctgtgtgttgtaacatctctcatgaaaagaaaagatagctttataaaggaagagctattggtacatctgttacaggtcagttacagattttcaatactatgttatactaatgatatactgaaatgtgtcttatggttatatttaattatgttcataaaatgccattacctttatgctacttagtatctgccagctgagaagaaagctttcatttaagatgctacatggaaatgtgttctttaagaggtatgaaatagcaaaaggtccataagaggcagcccagtgatgcctgaagagcagaggttatggaaactgtattgaccaaaaagttgaactgaaaagggcttcatctggactgagattctacattgtcctcatttgggtcagggaaggtcacttccttgaagtgaaagcagcctggggtatgtttatattaagaatagccagtttaagacttcagttaatgtcccaggtgaaaataaacttcagcatggttggtggctttggtgtggtgaaaataactttgaacttga

SEQ ID NO: 90067 - DNA, 2051 bp, Homo sapiens
aatagaaccaggctatatatatatataatatatatacatatttatatatatatatgtattatatatatattttttattatgctttaagttctagggtacatgtgcacaatgtgcaggtttgttacatatgtacacatgtgccatgtagtataagaaattggcttatgtgattgtggggcctagttaggcaagtcctaaattcacaggtcaggctgtcaggaaaggcagactgaactcgccagcaggagctgaagctgcactcaacaggtagaatttctcctttagggaacccttagttttgctcttaaaggttttcaacggattgaatgaggactacccagattatctaggataatctcctgtacttaaagtccctgacctttacaccatgcagactatcactagtgaattagattgatgaattctctgttttggcaggtgattgggaatagtgcatatgactgaatgaagtttctattgggtgggcaatagagagagaagcttagatagcttgtcacattggagcttgaatagataagacattgttccaaatgataattaagtcccataccttattatggattaaataggcttttgcgagttatccagagaactcaatcaacatttataaaatattcctaaaaggaaacatgttcagaattctgaacaagttacttgcaaacaaactttaaggccatagtcacttttaagttgagaattgcttaattgcagcaattccaggttatctaggtttttcctctctaatatgctcctcaaataatagatttttttccttgtcttaatgcagctctttgattaatcatctagtagtataaccattgaaagaaagtaataggttttctttactttataaaatctcttttaaaacctatcaattaccattggtttggaagtgtttcaatgttttgtttgatttttcagaaaccaagccatctcctgccttgtagttttgtagctattggcattttagtagcattttttctgctgattcaagcctgtccctggacatattatgtatatggtttgttgccactgccaatatggtatgcggttctaagagagtaagtaatgcatcttgctgccttgttttttcacttcattgacagttaaatctgtatttaaaatgcagtagatttctgtaccataagtcatcaaatatatttataatactgtactttcaaacctccagtccctctcacttcatttataactgcataaatgttgagtaggatataaacattctttctgttgtacttttcccttttgacttcatctttatttttctgaagtggcagtgttcacttctttgtgtatcttttatagaaaaaaaatggaataaaagtaacgattaatattgatcatactatgcctagactaacttgcattttgaacttgtgtcatcatctcagattccaatatatcttcatatttgacaaagatatttgcatgttttatttccatacattttgactcctcctttcctagcgattgtgtagatctagataaattaaactttgtagttaaatctaatacggttatatttacacacagagattagtctatatttttcacatgtgctgtggttctacctgtaagtgcttcctcacaggttgtacttaaaatagagtgtattgttaacattgtagaaaacattagaagtaaggctctttggtgagtttcaaacacttttaataaaaccactagaagggagtactagttcatgctcactggcagctggagtcatgttgcagatcttattggtttctatttttacaccagtaatctataatttaaacttagtcatggatatcaaagtattttctgagcaaaccagacccctaaagtcaatgaaagaatgagagcctattataataagggtatccccaaggttggcttaacatgtgcatcgtgacactatgcataattttattctaatttttcttaactttagctttgactgcttcttccttcttttaaaacatgatgtattaaaaatatttcggagttggctgggtgcaagggctcacgcc

SEQ ID NO: 90068 - DNA, 2092 bp, Homo sapiens
attttaaaatgataagctattcttctcctgtaaaatattaagctacttaatgatgttttataactgatttgagtaatctcatatgagaaaaaatataaatatggccattatcattatttgggacctatattagagagccttcatttcttttatgagttgtctgaatatcatttccacaaacacacatatacaacacaaatagtttacatttaaaatgccctttcttattaagattaaaaagttcattttattccaaatttttctcatactttaaaagaagatcctggaacaattaaaatctgttcttaatccatcatctacagttattcactaattttaatacaacagtttggctgttaggaatttaaaattttcctttctttaaaatgtaggttttcttattatttctgttagcaagttatatatgttttttctccataggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaaggtacgtttagaaaatgtgaggattcagatgatggtataaaatcactagtactgaatccagtgtaatgagtttataggatgtgcaagtcattgttctaagctaactcttgtttatctttcatttgcttttattgtattggatttttcctcagttatctctgtttcttcagttgagaaaaagatatattgataataatgatcctataacttaagaaagctataaagatagaggtgtaagtaatttaagtgctcctatgttatcaatggtgtcgaccttctgttttattttataactagcattttataagtattccatatctttctagtacaactggtcagaaaactacttcaaaacaatatgtttaattttatttgatattaaaagtttgggagctagagaacaataaaattatttgctcataatgtttcttcttaaatgatgtatacattttttaattacttaccttcttttaactttttgaagtttctcaaaatgcagatttctagacctctccaagtattcttattttaagaatttgttcctactttactatgctttcagtgaaaaaataaaaattaaaaaaatctctttaatgatacttcatattgctgagacaatataacagtatgtatatggttttactacattaaaacactttactcttttaaaatatatttctaactatcatttaccaggggcactatgccactttcatttcctttgcttcattctctttaatgattattaccatgttcaagttctctaaaaagtaatatatcctggtggtgtatttttaataatagtctgcagatatttccagtggtaacttttccaattttatattttattattctgtaatggaagtaaggccattagtgtttattataattttgtataatgctttaatgtatcttaaataatttcccccaagtaattttaattatttgagtgtatgtgaaattggctggaatgggaattgtatctaggcattcttagaactcataacagtgctagaagtagacataatttatgtttgcaaaaaaggaagctgaagctgaggaggattaagttacttattaaaggccactcagatagcatgtgagggactgagactttaatccagagcagtcgtgggccagagagtgccttttcatgtttatcttaatattcagtttattgagaaaaaaatatgtttttatattgatatgttaacaagatttcatagctgatagttcttcattattcgttaatctgataatacagccaatatttaattgagtgtatggtacaatgctagatgctggcaagggtatccaatcttttggctaccctaagccacattggaaaaagaataattgtcctggggcacacataaaatacactatcaacagctgatgagctttaaagctcattcaaagctgtcctggaccacaggtggcctgtgggctgcagactggacaagcttgct

SEQ ID NO: 90069 - DNA, 1006 bp, Homo sapiens
tacctttggcatgtcccaagttttataaatagtgcatttaggaaaaattacaaattaccctgactcctgtttctttaccttaatacttccaatataatataacataacataatatataatgtaaatatttctccttaagaatttttttctcttattcttcataagacttcacttaacagaatgtctgttaaattagcttaagtaatttagcttcagacaagctttttttcctttctttttattttaaattttaggtacattacaaatggcaacgtatggtagtctcttatttttcttccttttttaggtctgcaatattttgatagcattgtattcaaaatttattgattcattttatgtgctttagcactttgctaagtattattgtggatattaatggaatataagacattatcttggcccacatggaggctaaaatttaattgaagagaaataaactgatcattagaccactaactgaagtgctaatgatgtgaagtgagatttggagtagaccataaaggatgatgaatatttgattttagaaagcaaagaggggaacatctttatgataccagctaggtgaagcttgaagagtttcaccattatgcagctgagggtacacatttgcgataatgggaaattaagtgaagtagcagcagagggtcatcaatagtccaggaagattagaattgatgaagtagacagtgagatgcccatatcaattgtaagtgagaggatgcaatcagtattttaggaagctgagtggatcagagcaagaggaaggaggtcaactagaaagcttttatggaaatttgggaaattcaacttagatatagccttccaaaaaatgcctatgcactttggcacagtaattgctatactaaggcttctgggaaaacacttcaaaatgtgtggtatctgaaggtacagagaactggatcaaagcaacattttaaagtaacttgtttttctttcatgtgtttttgccttgtggcaccttttc

SEQ ID NO: 90070 - DNA, 1043 bp, Homo sapiens
agggaaagactcccattaatagcctttgccaatttcattggtataaatacgctcactatgatcaatctcaagctaccaaggatgatgcgactagagaaagggaagagttgtacaccatctgctctcgggagctggtgtgagcagccctcagcacgccactgagggagggagagaagggagtaaggaattgaggcaaggggagagaaagccaggtgttgagagctaatagaaagtgctttccaatattggctttgcattgtccttggaagggaattttgcagggagtgagtggggagatctgcatttccaatgaaacatcgttgtatacttatattttaatatttctttatgatgacttcttattttgaagccaaatagaagaaacttaatagtttatttttgccttacatttttcatgttaaatatattaaagaaaatgtattttagctaagggacagtagatgcaaatgtaataataaaatattatagccctctagaaataatgggcttatagaatttaatgaatattttaaacattttattaaaatattttaatgactcaaaacccacttttgtaatgtgaaaacaaaggataattttttcctcatatcaacctaaatgaactcttctacctttttttcttttcttttttttcttgatctctgtggctgcatgtgagtatccagctgtgccctgagctaacactgttacctatgcagtgattctggagttgggtagcttttccccctgatctcttatggaccccatctgttctaaagttccttgtttaaatgtaaaataccttccgtggcctagtggttttaattatgttactagctctgtggtctgatcatttaggagtttctttggcattcctcctggctggcttccagccatttctttgtttatactttttaccacaagcaaatctcatcatctccaaagatgatatctctgaaagtcctcagtttgtcacaccagtcacaagtatctgaaaagaggggaagaaaataatcaaatccttttccccaagtttgaaattc

SEQ ID NO: 90071 - DNA, 1095 bp, Homo sapiens
gatgttcagtgtctgcctgcacatacatattcaaagccactgtgtcctctgggggtctggcgggatggctgattcccatgtactggttcacccactctagagcatagtgaccagccctgcctgtagacctgtctggctaaaaatcaccacttgctaaaagcctgcaatatggtcaaaaaaatctaagataacatgagaaatggactcttgaggtcatatgaaattcaaggaacagaaccaaacctaaaaacattaaaattctcagaaatatttaagaaactattgcatccataaaacaaaagcagcattaactttgcaaaatgtagaaaggtactagatgcattaaaaataacttctacatttaataagaaaataaatatttcataagaatgcaacaaaaaacttaaagataagttgtataagaatggtccaaatgagaggcagatcctccaaattagaataggaagtgagtggacctcaaactaaatgaaatgaattttaagtagtagatggattgagtaagaagctggaggaaattaaggacatgatgtatacatagaaagcatacatttcttcatccgcccgcccatcaaaaaaaacaatgacaatcagaaacttaagggagaaagaaacatttcaaactttacaagaaagcatgcttcaaatataaagcaccctcagatgtggcatgattttgaacagttgctaggagtgtgagaaagggaattcatttgaacattgtcatgtggatcaaggctttaaagaaatagatgagaaaatctaattgtagcataaaactttgtttttcagtggacagtatttaaatagtcatgtgatataagtattggttttcagcttttagagtcaatccttggacaaagcagggaagaatgaattatgattacagaatagaatgcaaatgttagcagccttgaaaatgtacaagtgcagttaacaggttggaaggcagagagggaaggaaatgtacatggaatagtagcggtgctattgtcttcatgaaatagaatatggagaattttatctttagttgaattcgtcagaggtttaggtattagtttttgttttgttttgttt

SEQ ID NO: 90072 - DNA, 1297 bp, Homo sapiens
gctgagattacttactgtggtggacaaaccaaggtctagggtctcattttcaggcctgtggttgtagaaacttgtttcttcccagcaaaataagaatagtcttctcctgggatagatgcatactacccaagtaaatgaacatgaacatataaagtcagaatagcagtttattaatttgccattaaaaatcactgtcaaaaagacgggaatgacttgaagatcacaaaacaagaacatcccttattcatagccagaccagatcataatcagcaattgaacatagattcagttattgctctctgaattgtcagtctgttggcaaacactcctgcttcaaatctccatcaaatgagaatctctttgtctattcattccttctactaacactgtgatgtgtctgtggtgtgtttcaactttgtgctaagtctaagtatttagtggtgagttaaggcagacataatccctgtcctgggaaatgtataccttaggggtaagaacagatactcatcagtctgttgtacaaatacatgtaaacttatagctgtggtaagtactgcaacagagatttgtgcagctgtgagactgtagagtggatgtatatgatagactgtagtcagcaaaggcttcctgagaagtcgaggaatgagctgagattgatgaataagcaggaattagcaggccaaggcagtaggaggagggcttttcaggcagaggaaatgtgtacactaagttctggtgagagggtacatggtgtattaaagggtcttgaagaaagctgttatatagcaatagaaaccatggggtggtgtgaggcagaagaagggaggcgcagccccttcagggtctcatgggccttgtgaacttaattctgaaagttcaaagaatccttgaagagtttgaagcctagagagtgacacgatgtggttttttgtgtgtgaaagaatacccctggctgcagcatggagaagagattagaggtggccgacagtggattctgagggaaaaggaaaaggtgactaggaagactttggagatttccagttttctggaggatggtacctggtaatgacaatctaaatagtagaaagtgagaaagactgagagcctgggaacaaacttgatgaattccaactttaaatgagggactagcgaacgtatctgaaaaggaggagccagtgagatagaagaaactcagctgtgtggtgttgaggccaagaaaggagtggcctatgccatactgctgaaaggcctagtaatgccagcaacaattgtagctaccattatcacaggcttatta

SEQ ID NO: 90073 - DNA, 1217 bp, Homo sapiens
gcacccatgttcatgcatatgtgaatacagggtgaatcatttgccttagaagggtttatgaatctagtttatcattatttaattagcataataatcttcaaattttattttaattaattattcccagcctcaccctgccaagtaatattttattaattggttgcttttctgttacatgatttgaagaacacattctagctggggcaaaggaagtaattaggaggctatttgcaatgttctacattagagattacggttggactaggttgatagtacacaggacaatgaaaagtggtccagttctgaaatatttaaaaaaataaattattcttaaactggtaacagtattactatattatttttgactcttgccaaaatatgtcttcaatctgctgtattttattaagttagatgtgggattaacaacattatgagatctctatgaaattatgatcccctttctaacatctttttttggccttattataacagagaaaacagctaactcattatttgaacatagatgtctgaactgatagcaaagacgttgtgttggtaggtcttgagcacagatttaaacaacgtgagataatttaattttgtacttatgcataaatttaaatgttttcatcagtattatttttaaaataaaacaaatgaactaaatatttttaactcatttgttatatgtaggacttctttcatcatgccagaaacaaccagtctttgttttctaaaataaatgaagagaaaatagtttttttcttacatttattaggaatagatacaaacggacatgctcatcgaccatcctcgaggtaatttaatattgtgtttaattgtattttttagggcaacagctattctattgaactttttattataaagttttctttggaattataacaacagagctaatattttaaacaactactgtaatgtttattaagttctcaattatatgagatttccaatatagtcgtttaaatcatatgtgctgtatccagatggcacattaatataagtaaaatatatcctgtacatattacataatcttcatttactgaagcagagaaaaaaattatctaaaatatctatatattttagaaatattttcagtgaatcttgaaaatataaagcattttatggtattaacttttatatcaccaaaagatgtaattatttattccttgtgtattccctttaattagtattgt

SEQ ID NO: 90074 - DNA, 1026 bp, Homo sapiens
tccgttattggcaatgattgtcatatgtacaaccaagagttgcacgacttatattttctttttgtaggatttgacttggctgaacgctaactctttttaggactgatttaattatttatttgttctttggtcctgtgctaatttttatgagcttattatgcagttaaattcattatagtttatttgtcccaattacttattatacttgaactttttctttttgcttagatgtactttattacatatttgatttcagtattatgtcacattattaaatagtgcttattgttaccaccacaaatgaaagtaaagttgtgagttatataataattaaaaatatatgtttcatctacttgtgatcatcaaaatatgtgaaaatacatatgaatgcattaagatttaccccaatttaattttgttctctctttcagctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggtaagcatgtaaactgatacagagacatctcttaaaatgttattctgagttaagtaaactgcaaaatatcttactatttatcatgcactgggcacaggggtgatgatgagaaagagaatagggcacttgtacatttgcctttgtcttatgggtcagcactagatgctactttatttcctcctaggtgttatttctggtattgttgaagctgataaccggtgaattgaaatggataggcttagctgcttaagctaaattgtcctaatttcccaaacttggctcaagactcactatattatttttttcttaaaaaataagtctgctggctgggcacagtggctc

SEQ ID NO: 90075 - DNA, 1051 bp, Homo sapiens
atttctgcgtgggtcccgatagggacattttaaggaacgagagtattggggtgggggcgctcttttgcggtggaagcaagaggatcaggcaatgactgttctctctgcctgcttccaacccttggctggtgttgcacttggctcctggctcccctactggtgtcagtatctataaaatatcaagagtttctagttcactggctattacgggactccagaaggttcccttttatactagtttattgctttaagcattttcctttttctccagttacctgaatcacactaccaggaaatagtgttacctgaattgcctgcagtagttctttgagtctgagccaggagagaaagaataggacacactgctgctgtctccgaaaagtcagatgtacttaagaccctttgtctttgggacgactttttcaccgccaaaattgggttttctgctgcacaaaatttgttctgttgagataaagttgatgtaattcagtttcaatgccttaatttaagtaatgtccaaaattacaggaaatccaaggagcaaggcagacaggttctaccagcagtctgtctcaccatcccaccaccttgcaggcttttctctttgcattagataggaattgacctttttaccttggaatgatttttagcagcatagagtaatcgtttaccccatatattcgtaagcatctcttatggcttgaaaacttactgtcaaagatgtagtgtactgtatgtaggattcccagtgtctcccttttgggaggtatcttaaatattcccttactaatgtatggagatgttttagtatgaggccatatattaattctatattaacaagtattcatatagaatttttaaactgcagcctaattgatttttttttaatcactatgcttttgaatagtgccagagacttaaattgccaaacgtagacgtggtggaagcttagggagtgcattttctatcaaggtgaatcttaaatatatttcccccttggatatgggattttctcagtagttataatttccttacccaatatgtaggataa

SEQ ID NO: 90076 - DNA, 1931 bp, Homo sapiens
tttctgttgatttagatcatctttaatttctttggacaatgttttgtagtttttactgtatacattttgcatgtttttgttaaatgtattcttaaaatttttttgatgtgtttggaaatgaaacttgtctttgttttaattttggattgtcattgctaatgtataaaaatccaactgatttttgtgcattggtcccatgttctgcaactttgaaaaactcatttgttacgtctaatgtttttcagtggattcctgagagtttcttatatataacatcatgtcatctgtgaatagcagtagttttgcttgttcttttccaaactggatgtttttggtttcatggttttttatgaggaatcagcagtcattcacatcattgtttccctctatgagaacattgtttttctctgtctgcttttaatattttctctaaatttttggtttttcgctatttgattaataggtgcctaagtttctcttctctttacttaccctccttgatgttctctgaccttgaacctgtacctaccccatctcttgcctcatcagttgtggattccaattctgcatatgttagaccttttttattgttccacatgtccctaaggctctgttaattttcttttcaatcttttttgtctgtattctgcagattgaataatttccattaatccatctttgagatttctgaccctttcctctctcatctccattctgtgattaggctgtacaaggcatttttaatttcagatacttgtatttcagttctagaatttctattagcattttttacattccatagtttttgctaagatattaactcctttcgtttattgtatacatatattcctttacttcactgagcatagttatactagctataataaaatcttagtctactgattttaccattatgtcctggtatcatctaggagttggtcccattgattgtgttatttcttggagtggatcacattttactggtttttgtgtatcaagtaatttttgactgtgtgatggataatgtgtgtgttaggccgtgaagactggattctgttctttcagtaggcacttgttcaatctgtaaactctttcttaggtggcagctcaaacttctgttttgtttgtttgttttgtccttgcctgggctgcttgcaatattccctgtgtgtgcattatttgggagttggccggagatttgggcagggaaacttagttaaagtaacttgattgctgtgagcatttttactttgttctgttgttgttgttttaaaagaattcctggatcttagaattccaggtttattaactggaaataatcataagtatttgaattcctgttccttattttaacaattaaattaaaaaacttttatatttctctttattatagatcgagctgggagcattagtacccttgattctttagactttgcaagatattcagatgatggtaacagggaaacagatgaaaaagtggcaggtgagtaaaattgtaaggacagatttggattctttgacattccagaaataatgaaatggcttgaggaatttttttccttctacagtttggtatgtgactataacatatatagttattatacaaagttatgttactaattactaatttactgcaagtttgggggttccccaactttttcttcttgtggtactgagtttctggttatgtatccctataatttgctaagttatacttggagccagcagtttacaaccacacagttgtaaaactaatgtatgacaggtccaagacaaagttgaaccttagcctcattcctttgatcctccaaaccagggctgatagtcatatttgtgtaccaatacaactctattgattgttaaaaattggttttgaaccaggcatggtggttcacacctgtaatcccagctatttgctatttgggaagctg

SEQ ID NO: 90077 - DNA, 1021 bp, Homo sapiens
catacaagatagataacgtttctgctcttcaggaatttgtctgaaatatgtctatatctgtcataacagatacaagttcagtacgttggaaatggtaatagagaccttgttgattttagaacccccctatattcctgtttcaggttcacaagatccatcttttagcatcagatatgttctcatatctctattactgaattacttctctagttcacaccttaactctgttttgagatctggagaactagaactatgctttctgatttgtagggaaagacattcctgaatgctggtaagatcagttaatgtttcagatttatcacatgtcacatcaagtatcggaatgtccattcatactcagcaagtatttgctgagtgccctctctatagttcaagcattatgctactcttggaacaacggtcaatagtacagacatatgaagcctttaggaagcttacataatctagtagacattctaaaatggtctttagatttttgctgtaggatcacctgtccctgtcccctggattagaagtaggcttctcatttcttaggtaatggcctggcagcatccatatccagctttatcaggattaaataagcctatttggcttctaattttgtttctccctaggtacagataaatcttttccttcctattagcagtacattttgattttcttgatttaaaccatatctaaatcttatttcataattttgtcagatttaaaataggataggtgctccaacaaggctgtaaagaagataaatagcattttgaaaatagatttcttgttattcgtcaccatgaaattaaaataggctcagagaggaaaaaaagaatacatcattgtggtgggtggttatatttaatctaaaaataaaagtgattatatgttcattaaattttagtgggctggagaaggagggttttatctttagattaacattgctaaaagtgtatttcatgagaatgttcatttcatagggaaaaaacaaaagtgggaaaaaagaaaaaga

SEQ ID NO: 90078 - DNA, 1068 bp, Homo sapiens
taagtattatcttttcaaagtattggtaaattctaatgacatttggcaatatatatgtagatgtgcataaaaatataaattcttgccgtctgacatgggtttttctggctttctgtgccttaatcattcagtgttttactcttggtcacctaaactttcaccaattgcattttgagttttttcccagtttgtgttttaaccagtttttttttctttttttcttttttttttttttttcatatttctatcattctggcgtagggcacttctgatctgcaattgttctgtaatgtcttagaaaattttaagtgatatcaaaagcatgatatatatatttatttaagatacagttagatatttttaaatcaaaatcaattgcctagagttttaaaatgtaaaaaaaaaaaaaaagtaaaccaacatgctgtgtaaacctattctgtacttaccttacacactgaatgtgtccagtcttacttcaatgcaactctaagagtttccggaagtgtaaatgttaaggaaaatgtttaactttgttgcacagaagtatttgcagatcagcattgctgactaccaaaaaacataaagtaacatacgatgtcatctgatttttagtggtgcttccatgttgctgcagttaaattctgtgcatcaaaataattggcctttgtgtactagatgtgattcaattacatcttgtttttattgaaaatgtgcaaactgagtgaatcctaatttttccatatatttttatagctgtggctctgataacatctcatttggcatcttttttatgtgtattagtcagttaggaaaaaattgcatctttaagatgaaaccttcagttccagtttttatgcagaatgatttaactactgtaatttcttaatattcatttgtggcaaagatcacttaattttcccagagctttacttctcagaaatatattttttctcaagtctaacattttaaagagcttattaaaatgtttcctcaatattcatatttatgtcataatcacactctgtgataataggagaaatcctgagtttcactagtacctcttaa

SEQ ID NO: 90079 - DNA, 2010 bp, Homo sapiens
acaggaacgaaaaaattacaaatcaagtcctgaaattcaggtgggtgacagaagacaaatgtaaaattaatcttccacattaaatggtaacataaatattgaaggaggaatacttatgatttcctgtttgcctcttattttgcttccaggagccaatcaaacctcttgaaaagagagctctaaacttcttagtcaatgaatttttattgaagaataactataagcttacatcaataaccttttcagatgaaaacgatgatcaggtaaagttactttttgtttttacagtgatttttttctacacttataattcactttttcttttacgtagtttctttttttttttttttaagttatatatatagtaaaattctacaaggctagttactagaacagcagtctcttgcctgaagctaattctattagcttacagactttattctttccctgttgctttctacataaagacttttcattctttctagattcctttttactactcctcagtgactatatagtccactcatttttgcatatattcataaagtatgctttttaaagacatactttatagtataggttcttgtgtacttataaatccagtttaactataaacctcttcaattccactgtaacaattaagatgttagataaatatatgacagtatttaagagagtatattgtaaatgagagtgagaaaatcagctgtatctctctgaataggggccaattttagaactttattattattttcctgataaaatctctttaagcaaaaaagatgtcttattttagtgtcatctctcaaatggaatattttgacttcttagtgctaatggattggtttgaatcttacaccttaaaaaagtaaatgccagtgaatttattatttaggaatctgaaggccatcattttaaatcaagattattctgttggttcataaaatctcctatagatcctttagcaaaaatagaaattttctgagtaagatagttcagttaacccctcagttattagaatatatttggcaaaattaaatgcaataagtatctagttattttttattcaatggtagtgtcactgaacatgtgctatgtaagagacattaaactaatatttaacatgagtattatacaatgctatactatggttatagtttaggttaatcatgttttttaaatgatcgactaaacagtgaataggaaagattttgaatatgtgagaaacattgagaggtcaaaaagaacacagaaaaagaggaaaagaggagcaaaaaatagatggaatacatagaaaacagataataaaatggttagattaaaacctagctctatcagtattcactgtaagtgtaaatgattagtccttctcgaataaaaatcagaaattagagatgtcaacaatgctctctcaataattaatagaacaagtcaacagaaaatcttttaggatatagaaggcttgtgctatgttatcaaccaatgggcataattacaattttataaaaatgcttcatccttcaacagtgaatacatactctttaaattcaaatggttcacttacaaagttagaccatattatgggttataaaacaagtcttaagatggtgaaattaactagcaattagtaacaaagttatttccaaataacgcatgagttaaaaaagaaaagggaaattatgaagtattttgaactgagtgaagatgaaaacaaaacatatcaaaatttgtgggatataactaaaatagcacttagagggaaattcatagcactaaatgtctatacaaggaaagaaaaaaattcaaatcagtgaaatcaggctctgccttaagaaactaaaaaaagaaaaccaagtgaaacccaaagtaagtagaagaaaggaaatgataaagatgatagcataagtcaatgacacaggcagcagaaaacaatagagaaaaattaatgaaacaaacaagtagtcctttgagaagatcagtaaaattgataaacctctagcctaactgatt

SEQ ID NO: 90080 - DNA, 1053 bp, Homo sapiens
gtaacaattttgatttgtattttcaatgaaatctaaatctcacttcttactggcatttttgtggaaagtaatgatttttttctaaaattcatatgaaaaggaaacagccaaaacaactttaataaagaagaacaaatttggaggacctaaactacctggcttcaagtcttaaaagatattatagtaaagatattatttgtcatatttgtatatagacaaataaattgatgaaacagaatagaatccagagatggacttccacatagatgatctgttgaattctgacaaaatgcaaaataccttccatgcagaaagggtagtcttttttttacaaatggtaatggaaccatttgcctaaacaaaataaacatcaaaccataccatatacaaaaattaactcaaaatggagcatatacttaaatatagatcctaaaaagctgtaaggcttctagaggaaaacaggaaaaaaaaaatcactgcaggcttggaagataggcaaaacatttattagatatgacacaaaaagcatgatgttctctgtcagatttgctctcatcaaaattaataacttctgctgtttggaagccacttttaagtgaatgagaagaccgagagggtgaaaatattgcaagtaacatatctaataaaggagttatatccaaaatttataaagagctctctaaacttaataatagaaaattaatctattttttaaaagaatgcacaaaaattttaaacaggtgcttcactaaggaagttatatggatggaaaataagcacgtgaaaaagattctcaacatttgtattcattagagaaatgcaaattcaatcacattgagataccacaacacgttaattagaatgtttacctatgaagttttggcaaggatatggagcaactagaaattatttctagttctaagctcaaggtagatacatcttaaattttggttgaatgatagatagatggacatttgaattatgtgtaatgttcatttaataagttttttttttttaagttaaaagttgtttagttcttgtgggccaagcact

SEQ ID NO: 90081 - DNA, 1037 bp, Homo sapiens
atttgtaacagtgatagtggagaaagatacaaatttcatacttcctctggttttctctaaagcccccacttgtaatactcatatctacctcgatttagtcctcaataatagctatctcatcattcaaataaaccgtcaaaggattaagaatatcacatttagaatgttcaaattaatatgccaatttcttagaggttctcataggttataatctatcaaattagtactaaattatgatatattaaaggaagatagaatggtgagacagtgtatttacgtgcaattgattactcagcaattttatgaagctcttctaaagatctttctctacagaatgcttaagttgctgtgcttttttgtacttttaataaaactgttgcagttaataaaactgttgaacacgttttaatacacaacaaattgaagagtagctatttggattctgaaaattgccagaagtatttgtaataatatgaattatattcaaacatttacagcaagaagacatgcagattaaattgtttccctacccattagagattacactaatatgtattaagttggagtaataaaagaagaacaaaattaatgatttgagtttacttataacctataaataataggtacaatttatgtactgagacttccttaatctaaacatgttttatgatgtcatgcaaatatttgagcatgttttatgagcttaaagttaatataaaacaaagtaaagagagtttatatttttaagagatataataaaaaaattgtgtaacattttgatacctaagacaattaaacctattgatctagaaggtcaggaaacttacaagaataatattggatactggaaagtgtaaaataaatgtaagaatgttatttactaacttggaacatacactttgatattataacaaaattatgattatgttgggttttcaatatattcacagaggctggctgtggtggctcacacctgtaatctcaacactttgggaggccaaggtgggaggattgcttaaagccaggtgtttgagacc

SEQ ID NO: 90082 - DNA, 1041 bp, Homo sapiens
agacagacaagcaataacactaaggtatgaaaagtagtataataaaataagtccaacttgctttgggaacatgtaatcaaggcactaacctagtcttcagagcaggaaagtttcatagaagtgtcatccaagacttgaagactatgtaagagttaacaagcaaagaggtaaaagaaagagtgttcccacatgcacaaatgaaacagtgctttaggggaacaaagaagggtttagtgaggcttaagcaaataatgctagtgaaaggaaggatagaagacaaagttggagaagtaagcaaagtctaagaagtcatgtaagcttgcgttaattcattttagaggttgggacatgatggtatctaagctttagaaagggtcctctgagctagaggtaattggaaggtagcaagactgggagcaaggaaactatacgggtatatgttggaagaacccaagtaagaaatgatggaggcctgttctatattcagacattggtaatgggaagggaaagaagtatatggatctgcaagattattagaagttaaaagattgaatggatttggggtgaagataaagggaaggaagccagggacgatgggatgtgcctctaatcccagctactcaggaggctgagatggaaggatcgcttgagcccaggagttctagaccagcatgggcaatacagcaagaccccatctcaaaaaaaaggatcaagcctgatttgaggtttctgacttgggcaagtggaaggattatggtccccctctgagggaatatgagaggagcataaaacagcaaaaggctcaagctttgatacagtactctataatcatagaaattactgagctccattttgtggtgtatactaaataagctttattatctaatttttggtgttagccttttctttgcagatttaagacataaagtacaactcatagtcataattttatgaataatactacatagagactggtgttgttttagaaatataaatgttttaacctcctttattaaacataaataggctaatattttcaac

SEQ ID NO: 90083 - DNA, 1068 bp, Homo sapiens
ttctacatatatagaatcatgtcatctgcacgtagagagatagttttgcttcttctttacaatatagatggcttttattttttcctcttgcttaattgctctggctaggatttccaatacaatttggatggtaatgttttgagaaagcaatatccttgccttgtttctgatcttacaggaaagcttcaatctttcaccattgactatgatgtttgctatagaatttttataaatgccctttgtcatattaaagaagtttccttttatccctagtttgctaaatattcttatcataaaatggcattgaatttgccacatgctttttctgcatctgttgagatgataatgcgatttttcccctttcgttctactgtcatatgcctgcattatttatacattgcctgattttatgttaaaccacccttgcattcatgagatacatcccatttggccttggtttataaaccttctaatgtgcttttggatctgtcgttagtattttgttaagtatttttttgtctatattcataagggatactgttctgtggttttcttatcttgtgttttggtatttggtattggttttggtattgggctaaggctggcttgatagggtataggaactcttcagtctgtttccttgttataagtctgttgggattttctacttaatcagtttggtgatttctatgattctaggaattagttcatttcatcttgattatctgatttgttgatgaacagttgttcatagtattaacttatatcttttaatttctgtaacatcggtactaacatccttgctttcatttctgatcctagttatttgcatcttctctctttttcagtcagtctagctaaacgtttgtcaattttgtttctcttttcaaaaaccaacttttgttttgttaattctctttattgtttttctagtctatgtttcatttatctctgtaatctttattatttctttccttctgctggccttgggtttagtttgatctttctgtagttccataagatattgaattactgacttgagatcttttttaatgtaggtatttatag

SEQ ID NO: 90084 - DNA, 1030 bp, Homo sapiens
ctggaataaggagagctagcagaatgaaaaaaaaattaaaatatgcagtgttttcaaatttatgttgaagacaaagtaatagatttgagactattgaaaattgaatccatgtttattataagcgatttttttttttttttcctgagacagggtctcactctgtctcccaggctggagtgcagaggcacaatcatggctcactgcaacctccaccttcccaggctcaggtgattctcccacctcccaagtagccaagtagctgggaccacaggcatgcatcaccatgcctggctaatggttgtattttttgtagagacagggtttcgtcttgttgcccaggctggtcttgaactcctggattcaagtgatctgcctgcctggactttgccaggtgctgggattacaagcatgagccactgtgccgagctgataaatttcacatatcaataaagcacggtattcactggccatttgcaggattgaaggattgtttgcccaaacttttgtggtttcaataatttccagaaactcttcaaccatagctcataatacatcctgatggacaaaatgtaaatgtatatgttcctgcaatatcaggccctgacttttctgtaaaatgttttggaaagctgccattacctttgtgcatggtatgaatagtgttaatcaacagattgacagccttaaaagcattttggcattaattactgcttcactcaatgtaagttcacaaaaatgcatgtataaagctcctgtatatacatgtttataaaaatgcatgtataaagtttcctccgtaaactttgctgcaaccctttaaactttttccttataaaggcattgtgatgaacttagcaacacattttattccagtcattttgttttaaaatgagcaaatttgttaataatcctcagaaagttggctccagtaaactccctcaacagttaaatcccagtttctctttaattatgaaagtctttgaagtttgaagttatgtattaattaacagaggaaacgttgcccaaattt

SEQ ID NO: 90085 - DNA, 1027 bp, Homo sapiens
acatggctttatttacaatagcacagtcacttattcttaagaaaaatattagtctctggaatatcactgaagtattagtcatttatagtcctattcccaagttctttgggcattcattttttccaccaaaataaagtagaaaccctagattcaatagacaaagtaaacattacatataataataactacctgtcacaatcccttataccatctataaattacagtgcatactaatttagggtgaggttctaatcacttggagtcaaaataacttgggtacaatatatccatataactttcaatttacaattctatacagttaattgtgcacatttaattttttatattttttccattttcttttgtctttttcttttcaagtgtacaatttaatggtttcagtgttgtgcaagcttcactacaatcagtttttaaacatttttgctatcccaaagacaaaccctaactgcttgaattcggttctcctctttcaagattattttgacggttccaggtcccttgaattttcttatgaattttaggatcatttttcaatttttgcaaagaagccagctgggattttcataaacaatgcattgaatctatagatttatctagagagtattgccatcctaattttatatattaagtctttcattctatgaatttaggatgtctttccatgcattgggtcttttaaaatttctctcaacagtaatttgtatttttccgagtagtgtacgttttgcccttttgttttatttatttctaagtatttcatgcttttggatgctattgtaaatagacttttttcttaattttatttttagtttgttcattgctaatatatagacatacaattgatttttgcatttcaattttgagacttactgagctaaagaaaagcaaacgaaagtttatgcacagccatacgttgacattcaaacattctacttttgaggtaactacatctggattaaatttaattcaaagatgtcagttataaacatctctactgccacctctt

SEQ ID NO: 90086 - DNA, 1552 bp, Homo sapiens
ataaaattccaagtattataatattccaaatctctgatttagatactttataatgtatcataaggatggcaggtatgtcaactttagtcatctggggatggctgcctggtttcaattttgcagctcagaggagagaatgctacacttcagttatagtatctgccacagctttctggcaggaaattggcaagaggtattctatgtttaccactccctctctttggtttgctcatcagtggatacatggcaaggctaggattatggatggccttctttcttgcttaaaaatatgttcttaatttattgaaatttttattactttttattaagtgttttattttaagtttatccctttaaaaatctacatttgcctttttctcattgacagggttttgaattgttgctgtcagccttgggtgatccctcagaaagagtagttagtgctacacatcaagtatttttaccagcttacgctgcgtggactacagaacttggaaatttacagtctcatcttatacttacactactgaacaagattgaaaaacttctcagggtaagttcttcttttgtttatatagtttgtagaaacttaaaaggtctgtcctaagccatcttggaacaatgttagagaacagagacagaaagtgcccttagcttaacatactaatacattaccagttaaagatgctgttggactggagccaagaaagagatttgaggaagttttgctttgctgaagctggaggaagagaaagggcatgatgtgcatttgttaactgaaatgcaccttcatggaagtaactcctacattattcagaaagccagctctttcttgacccttctgagtacttaaatattttacacaaaccatcaactctagttccagaatgcagagaaaatgagtctctaaagctttcttacatagtgtcaaaattgctttaactgtggttattccactccagtagttcatttctcatttttaaaatgaacttttaatttttcccacatacaagaattaaagaaatgttgatggaacaatagaaacttcttgatctaatttttgtattaaaagtttcttttagagactagaagagaaattattatttgtgtagtgcatattatgtgccaaatctataaaaagagataggaagtaggagaggggaagtattatagcatgaaatgctgctgggttagcgtttgagcatttctatatgccaacagtgaataagctaaaaaaaaaatcaagaaagcaatcacatttacaatagttttataaaaaatgcttaggaatatatataaccaaagagatgaaggatctctgccatgaaaactataaaacactgatgaaagaaattgaagaggaaatgttaaaaaaaaaagatatccatatttagttgttcatagaagaattaatattgttaaaaatgtgtatactacccaaagtgatctacagattcattgcaatccctatcaaaatatggaggacattctttaagatatagaaaaagcaatctgaaaattcatgtggaaccacaaaagaccctgaataacc

SEQ ID NO: 90087 - DNA, 1034 bp, Homo sapiens
aactttctgacttttaacagtagctataaatgttaatgttactataccttcatttaggttataatgtatttattataaataaggatttattatatccttatttagggtatatccatatgtctatatgtccgtttatatatacacacacataaaatttgggttataatttgttatgaatgaagatttgttttctcataaaaatggtaacccacacaaatatttttagtaccaatttattacacaacatgaacaaatatttatgtcaggcattgttttagacacttaggacacaatcatgaataaaatagataaaaatttctgctcatagagcttacattctgctgtgggaataaaatcttttgagatttgttggatttgttctcatatcacaggaatttcttgattttcctaaaaatgacttaattagtgtatttcaattttatatttaaaatttacaataagaaagtaattaaatatgaggagaaaggaccttattttcctttcaacagaatatctaagttcccaaaatgccaatttccatatgatttattttgcttcttttatgtgtagtgactaggtttcctcggcctatgtcgcctcttcaagatgtgtccactattatcggaagtcgtgagcaattggcagtgctgctgcaactttatgactaccagctagaacaagagggtacaacaggctgggagagtttactgtgggttgtcaatcaattgtaagttaccacctccatattaatttgaatagatgataactcttatatttagccttggccctaagaacaaaatataacaaaacttttaaaatgtaactcggcatcatttttggtaaacacctttaggacacagaggattcacaccattggatatgtaatttatctgagaagaagatgttgctgtattttatccgaatgatctatctgccatcttgtttgtccaatcgtggtgatggattttaaactacatctagacttctcatttttgaggctaaaatgatgccatgtaaagccaagctcttgtgtg

SEQ ID NO: 90088 - DNA, 1021 bp, Homo sapiens
tttagcctaagcttagttcatatccagacttggatataagctttactcattgtagatatcctcaaagattttcaatataggaagtgtcagctagggaactcaaccacaatcctttgaatgtgctgctggtacttactgtctatcacaggttcaggaagcagctgtttgctcagcacactttggtaaaaacctcaagcgattatggaaccacagcaacttatatataaaacttgctgcgaagatgccacctcttagaatagcatggacactggagataaattctacatgtttcagtcattaccaaaagtatcatttgtcacatttgcctatccaggttattttgtagtttcaaatattaacattggaatgtcattagatcctaatttattcattaatcctattaatccatttgtcttcataacattttgttaagccagtactttagagagctaataaaaacataaaaaggtgtagtttctataatcaaatgttaataaacacatttaaaaggtaagcattttaattattaaatttaatttagtgtagctctttactattaaatctatagttgaaacatttaaagtaaatagtatgctataaggaactggacaaaattcagaagacttgggttatggtcctattatctgttgactaatgtttatgatctttactatttaagttaaattatgtgggcttagtcttttcatgtgtgaaatgaagaatttgcttcagtgtcttttaattctcttagcgcaattcagtacatgaaccttttaacattggcctttctctcagtttaagctaaatatataaattaatgtgcctcacctacagagaggagggcaaaaaccagaccttgatgttattgtaggaaaaagaaaattaaaattattttgtatttttcactagcattcagttgttaaacaaatataatttgattttcctgttatcaatattggcaaaaattgtttgatatctccaaaacaagtagctatttttttttttagaaaagcaagtagga

SEQ ID NO: 90089 - DNA, 1023 bp, Homo sapiens
gaacataaatatcacaggatgaatatgttacttactaaacacctgaagtgactggaatttccttttcgttttttaaaaatacaggcaaatgcttttttcgataattctaaccatgtaatatctacctaaataatccttctataaccaagttcagttttagaaggcagtaatttcaaccacttaaaatcatattggaaattattttaatttaataaaagaaaccagaggccattcacttgttgacttgagttgattttttcaaaaatttatccttaaagtttttattttcattaatttgactcttctatcctaagcctcatgattaagaattattacatttctgaccacttaacttagtcatctataaagctaaataaataaatgaatagtagtagcaacagtagtaaacatttcatttaatcaatttgcccattgaacctgagactttttgaatcttctctttgggttgcttaggtaaaacctcagttccaggagattttaagactatctgaagaaaacattggtgagtttgttcattattacttttaaaaacaattgcatttctttatgcaggaaaaatactatattctccatatatgtaaattgtataaatgaactagcaactacaattgaaaaggaaaacttatattatggagttcttggttttataactgtgtcacatctaatatccttcccattagtggcagtgagattaatccctgtcaatctgattgtgaatatataccttcattgtaaccaaattgatataaggctgagctttacaacctgggtactcaacctttagaggtctgaagtagtatattcaagagactgacaattataaaataagctgcatctaattcctaattagttctataatacttttaaaaattaaacatagtggaaaagaacggtatataagcatatatgttttcaaaatgaaacatgagagaaactacagacttgaatgggtagctccagctacttcattgatagttttcactcatctactttaacgagtct

SEQ ID NO: 90090 - DNA, 1075 bp, Homo sapiens
aaaataatcagggctctgtctggctgaaaaccctactgaggatgcaggaggggctcaggaactcaggctagtactgaaaactacctcatatctagaaatagatcaaataacatatatctatgtgcttttaggtgagtgtgtttacattttagtaaactgcaaattgaaagcataaaaattttggacaacctgcctatagggacgcttagaagactttcaagaagaaagttctgatttccaattatggaaatcaagagtataccatctcatttgggttattaaaattctttgccatttatcagaaatgtttatgctagtggctcttcaggaaacactaagttgtattttacaaccaccaataaacatatgttttccaaagtaatgataatacttacttgtaacctagtaaacagttgtaattttaaatataatcgcattatgatttttttctttacacttaaaatatacttatgtttttttaaattattttaataattttagattcctcagcaggaaatggggtcctcactaaagctacagtccccatttatgcaacaggagtccttacgtgttatattcaggtaagggaaaaattcttactctctagtaaaaggctttccatttagaaaaatgcctagtattgtgtcttcttaatgtaagtgacattgctaccaataaagaaaaacaatttacttattttattcaataaataatttataatggatagcatatttgaataataagggcctgagtaaaacctcagttgaacaaataaatttagagattatgagctttttgatattttgttagaagtgttagattgtacttacttagcagagtttctttgtgttccatgataagtttttcatagataaatgataagcagaacacatacgttaggtgaactaagctacaaagcactgtagaacactataccttatcaacatttttagctaagtactttttaataaggcaggttgagtatcccttatctcaaatgcttaggatgaaagtgttttcagattttggattttttttttcagataaaggagtatttgcatatacataatgagat

SEQ ID NO: 90091 - DNA, 1013 bp, Homo sapiens
actttattatgtatttattttctgacagactatcagattcccttcccatatacatttaggttaatttaacataaaacattattttttttactctcttaatttagcgggttttctttttctaacatattttctgattatgaaagtaataatagttcgttgaaaaaagtttgaaaaacacagattattttttaatcaaggtgtgcatctgtttcttaaaagaacacagtagtctatattttactaagtgtgcagttttcaccactaggatattgcaaagataatttcttagaaatcaattttctactattttttctacaacggggtaactattctagtagtttgtattatatagagccaaaatttatgggaacaaaaattcgtaaggtaaattttaataaaagattatactttttaatgttctaaatcaggaccaaacatccaaacttttacagtgacggaaataatttacagctgagttgtccaatcagctaggcacttgccacgtgtgtctattaagcctttgcactgtacccagtttgactgaggaactgaatctttcactttacataatttcttatttaaatttaaatataagtagccacatgtggctagtggctactactatattagaccacaggtctaaattaaagtatcaagatagtctgtcttcataccattctgatgatagatatgcttaataaatatcttttaattaaaatagcttccaaatttggatattttccccttatttggtaacattttctaattatagataggtaaatatggtatttagttctacttgattgtttggaaattcagtatcagtatttttcctctgtaggaagaagaccgaaaactgttagttggattcttagaagatgtaatgacgctgctttcattatctcatgctcctcttgatagcctgaaggcttcttttgtggaattggggtaagaaataacagcttatagtttgctaaaaggcatataaagtttttagattggatttatagagt

SEQ ID NO: 90092 - DNA, 2798 bp, Homo sapiens
ctttgaagcagttggagaaataaaatgaagtacagatttgaagaaaatttagtttcccagaactgaaaaaggagccccaagtgaaagccagcttgtttggctcctgttttcactgtttgatttgcttagtcctgctcatcatcacatcatctggctgctaaaataattttatctcagtctttactgaaaacacactcatgcatttgttaataataccacctttcatttgcataggcttcacagccaacatacccttccgtatagatggtttgagttgattttatttgattctacaacaaccatgtgacatacataggacatgtactgcttccccaatttttatagatgcagaaaccaagacccacagaagttgtaatttacccacttgactcttagtccagtgatctttcctttttcctcatggagaaatttgtttcttcataattttaacttgcatgctattaaaaagagtggaattatctgtcacaattgtgaattcttagagaagttacaagtgtgatttctgaatatgctaaaagattgtggttgtataaggaaggtgacatcttttttggagaatcttagttgtttgtttctatgttttttgagacggagtctcgctctgtcaccaggctagagtgcagtggtgcgatctcagctcactgcaacctctgcctcctgcgttcaagcaattctcctgcctcagcctcctgagtagctgggactacaggtgcgcatcaccatgcccagctaatttttgtgtttttagtagagacagggtttcaccatgttggccaggatggtctcgatctcttgacctcgtgatctgcccaccttatcctctcaaagtgctgggattacaggcgtgagccactgcgcctagccgagaatcttagttgtaacctatgtaaccaaacaaagtaattccatatgttctgcaaatattattatcattaatattccttataaatatcgtgtttttcagttcactagtaagggactgtggctctcaattttaacactgtttttttttttttcttctagtgcaaacccagcctaccatgagttactattaactgttttgtggtatggtgttgtccatacttcagcactcgtgaggtgtactgctgctagaatgtttgaggtatgtcaacacatgcctctgttggtttcaattataatgatttttttttttttgcgaagaagaagggaattttttttaataaaaaggctttgcatatcatgttatgttgatatatattttatggctttgaacagtgtctggttgtgtactgtgtgatggggcagaaatttagctttaacatatttaaaaatgttttctcagcttactggttccttgaatgttattcaattatcacttttatttctcaaactatcttttaaatcttattttaatttctaacttatataactctttctgactatactttttgatttactgaggtaaataaactgaaacaacataggatatctttcaagttgtaaaatatagttgaatttatcagtagcattagaaaatcaattattgaaattatggaaatgtttattttattggttactcctacgtcactattccctaacatttcatatgtagaataacatcccaatacattaactgcccatagagttgcaaaagagaggagaccaggtaatttacctaaattgtactaaattgctacctacccaagttaagtatgaaattgaaataactatgttttgtacccatcatatagcaaattatgtcatagccctagtatgtgtgtaggtggggagcagtgaggttgaggtttagaactttatttgagcactaaaattggtttactgtttcttattgatttccagtcttgcaataaatctaggctgccttggttcagtttccatctctgctacctagtgactttgtaaattacttggacaaggttgagcctctctgtaccttagtttcctcatgtacaaaagaaagttgataacaaaaagtatctgtctcaaagtatcagtctcaaaggatttttgttaatattaaactaattaatgcttgtaaagcccttaaaacagtctctggaacataataagtgcttatatgtttactgtcattatcattattttttccatccatgctattacttcacaaaatatatgatagtaatagggaacatatacttatccaaactaaaattgccccaatattcatgtgtttcttaaaatacctaaacatttatttctataaaaagaattggttaattcaaatcttgccgaatatcagaatttctccacaatttaagataaattgcaattggagatggggtactgatatatttaaaatatatgctttctaaaattttcaaatacgtaaattagatttgtgaattccagaaaattccattgttatcaggaagttgaaaattctccatccatgttattccctcagttatcatacagaagcaacttttaaaaagccgtaatcaggttttttgtgatgatgaatgccaaagccactatttggttttatgtctagtacaagttccttctggatataaatcgttttgattattcgatatgctgaaaagggggcattaccatgaaagaaaagtcattcatcagtctctcctctccccaaaaagaaaaaagtatctttttaaatgaagagctatttctttaatatactctcttcctatgattttattctaagctcataaaagctatttctttttcttaaatctttcatctctaaaatgtgagtgtgcactggtgaatcaaaccatgtaaatgaaaataag

SEQ ID NO: 90093 - DNA, 1004 bp, Homo sapiens
tacgtggcttatgtctggttttggtttctctgtttgctgtcagtgctggtctggaaactatatctatctatgcttaagcagttttcagtgtcctctcaggttgttgatgaacttctggatcttgtttgagagactatttcaatgtttttcaaattcattaatgatacatttcaatgagcatgtcagtaaaagttatcagtaagagaaattaaagttccttttttgtcagtggttcttatttgaacaaaattgtgttaaaagaataatgggtcataagatttattttgatactgatgctttataatttagaattatgcctgcttaccctaaaaaagttaattcaaaataaaaacataaaaaaaacacattctttttttaaaaggtaagaccagaaagaaaagaaaatgagaaatgagaagaaaatgaggcatacatataccaggaacctaatagggtatggtcactgaaattcactaataaattgagtttaatttttagacagcaggacaaaaagagggaacccaatcaatcatattattcccattgttaaataagggaatataaattactttttgaagtagcaaattaataaaattattttataagaggaatttatcatgttataataaatttcccaaaagatgcagaaaagagcttcatatatattttaatcataaggaaattgaacatgtaacattagagcacaactcaaagaggtcatggactttaagtcagatgggacagagttcctttgcaggccctgcaacttagacttggacaagttactttccgaagcctcagtttcttcatctgttaaaatattgatgatatttgtacttacttcatcaagtgaaaagatcaaatgatatattgtgttaaagtgtataacaattgatagctcttaaatgtactttgtgattttctagcttaataaagaaattgaacttaaaaaccctacaccaatgaaaaattaatttgtcctctacattacctcttttttaatg

SEQ ID NO: 90094 - DNA, 1181 bp, Homo sapiens
ttggtaaatggtgaaaaatcattgcaaaattaagaatcttcacataaagtgagttactttctctgatgtgttatataggaggaataccttcacatatgtacacaatggtagatttttgttacaaaaaattctgtgacatctttgatcttctgtgaggactaagtactagctactaggtaaacagattggtgagcatttaggattaatatgtgcttacattctgaaattgagaaggggattgcccttctcggttgaactcataaaattcagtaatatttatcaaacaaaatgtatacggctcagtattgttctcttgtattgcaatttagcattggttgctaaatgaattgttttgtgattagattatagagatctagttctactcatcttttttattttacattttatttgaatttataagaaatctaaaacaaagacctatttagatattaactgaagttttttaaattagatcatttcttccaaacatattacaaatcatatattcttgcagtaatcaaaataattaaactctcatttcttgaatgcctgtttgtcaggcacagtatttaggtatgttatttgcaaattcatagcacaacagccctttgaggtagataataatatcaccattttcagatgagaaaacttgcgtttcaagaggttatggaaaatactatgtatctaagaccacatggcttatatgtggagaactgacgtctgaacccagatctgattcccaagtgtaatactttccaataggcagccttatatctctgtacctcaaaagagaaggctatattatttaaaagattaggaattgtcctatatggttttaaaatacacttgctatagcacaataataagtggtttagtggtgactgctactcctgtgagtttggtttaaaaacagcccagtttgtaccctgttggtcatgataaaagcataccacccttactttgagaattttaaccatagagcacaatatgtgtcaaacaagctaaaaaagtattcttttcagttgcattttgatggacattgaaattgcttagactctttgaccaaaagtacaaactgctgttaaactggtgacaaaatctgttttcatggacgctaggctacttaagctttattttcctcctaagcattctctgcctttgtaaagcactctagcagcagt

SEQ ID NO: 90095 - DNA, 1577 bp, Homo sapiens
gttgttccttccttcttcccgtggcgcactgtgtttgctctttccgtgcatcacctgtgaataccccctgtgctgaccaatcagctgttggtgaagggggtgaatgaaactctggtagctcagagggttgttcctgctctcattactctctccagtgaccctgaaatgtaagtgtcatccctgccttttatattcggcatccctttcaaaatgtgcctgtcaagaaataaccatcagctcttaaatttattgaagaatctctttaaattaataatactggattatgcttatttgattttaaactttatcacattattctttatatatcatggttctttttaaatcaaccctcaccataagtgtaatttggaggccacgtattgaaaaaatatattagtaacattagtgctcaataaatacttccagaacctaaaatatgctgatggactgtttctttcaagccaagaagggatgctctcctaatctcactaacaggttgttaccagtaagtgtagtagcatgaaccaatggcctaacattttaatgtctcgtgtggatgactaaaccaagaaaggccaatgagtctgcctgcccatcctcagtcacagctaacccagttcttattccagtttaccaaaccattttttattgcatgttgactggtttacagctgactcttcgaggcatgagtgaagcgttagttgacaagcgggttgctccggcccttgttaccttgtccagtgatcctgaattgtgagtttcacagactgcgaccttaagttatcctgtctgtctttttgagcattcttcttggtctgctttttttaaatttatttaatttgtcattgctagagactaatacagtatatttaccttgtacttactttaatatacattttaataatactcgttgttcatctcaaatcttcagtttctttctgttttaattctaacagctctgtcaggattgccacaattccagcctttggcactattatggaaacagtaattcaaagagaggtaggaataattgaaatttatttatgtctgtgtaatattgatgtggtcatgatacatgtatctggtggtaggctgcagggagcatcttaccttttattttgtgccctagttagttacaggccagaggaggatctcactgtgaaaacatggtagcctaaccaaggtatatttccatatcctaaggaaatctctagtctttcctctcagtcagaacattaagtataggccaagctttcagggatgtccaagggagagaatatagtcatgggttcttagtttctctttctgattgggccagtaaagccccttcctcttccctcttttctacttatcactagagacagaaactaaaaaccccggcttcaggctgctaaaagccttaaacaaaacaaaacagaacaacaacaaaataaggtgtattggacaagcttgctagatgttctattgtaagctgagctggatgttgcagttttgaataatccttcaaatcaggtctagttccaaagccttctattacccggtaggcttctggccaatctacataaattcttgattgc

SEQ ID NO: 90096 - DNA, 1076 bp, Homo sapiens
ggattaaaggataggctcaacaggcaatgggtctttggtgtgtgccatgttgtcaagttaaatgggtatttgatatgttgtcatgttaaacgggtctttggtgtgtgcagtgttgttgcattaaatgggtccttgctgtgtgccgtgtcatatagttaaaacttttctagagcatgatttgacctttctatgtatattcaaaagaaagactcatgataatctgggaagaatccatctggattcttataggatctgctccaattattttgttgattcttcggaatcttttttcagtaattctgggactatagttatttttcaaattaaacatagtgtcaatatcttaatttctctttctagaattttcaagaatatctaaaaataacccttccattttatttgacagttttattgtagaatagatacctacctatcaaatttgtaggagttgttcaagaggaaaaaatgaattttcttctcataatggcccccaaataacaattaaaggttgttttgggaacagattgaggtgagaaattcccactgcttgaatagttctagtaaaccattatccttaaagcctcctgcaacttactgtgtacccacaagtatgtcttatacagtcttctttcacattttggtacaaccagatttttttaagataaaaattagcctttttttccacctttgtacttacttcccagtcaagtggcttctcttttgctttagaacttaccctgaggaatttagtactctatattaataagataaatattgaagtagaacctgtatgaagaatgcgatagtgttattcctaagtatttatagacaattggctttgggagtttggaggatggacagagaatttctgggtggtaacgtctcccttggagtggcattttgggtatttaggtatttgcccctctatttcttggctaatagaggacattagttctttcagtggcccttgttctttcccaattgttagttatcacaggacctttggtcttgtttttatttttaggaaccagttgttttatctggaacaccgtagagttgttttttgttttcagcta

SEQ ID NO: 90097 - DNA, 1047 bp, Homo sapiens
cttacattaagcgttgtagaaaattgaagatttgatttgtctcactccactccttcttctagccatctcataattttaaaagataagtttaagtcctctgtgcttttatgttctatagttttgagaattttgatgaagttcttaacctgaagtttttatttatattagttagctacataactgagcaagaaataaagggcagaaagaattacagctgagacttctgttaatcaaaaggaagccttgtatatatgacttggcatttaggtttttcagtgaatgtttaactctcagtatccagtggaatattatgagtatctcttagagagatatcacacattggacaagtacagggccaacaaagctaatgatctccagtgattgtagaactgggagaaaacttagagatcatgtaggtccatgtcagtgactgtaaatgattaaactaaggcttaaagacatgaatgccttctgttttttatagttaaaagcaaaactgtgactggaacaaagaactttagccattctgttaaatgttctgtttactatcctatgcctataaaataaaactaagaaggaagtaaagataacgatgggcaaagtgaactcccaacttttaggctcttttatttaaaaggcagaagggttgaagaaaggggaaatgagagattgaaaaaagagtgaaaggctaaatgctaaagtacatgctaaacaaaaaacagagaacaaaggaagagtttcaggattattatatgtggttcacattgttatataccagtctgatgagtttgatgtaataagcaacatgaacaggtaattttaaatgagataaatatgccataaaatattactaacagtcattgacactggattctggactagaatgtaccaataagaagttatttttgttcagaataaaccaaatagagaaagtagaaaagtagagctatctgtgaagtagctatgtgtctttggaaatactaaaactgaaagttggatgcatggttcagagcagtttatgttggaaatctattacaaatggcctaa

SEQ ID NO: 90098 - DNA, 1049 bp, Homo sapiens
tctgatatgcactatagagtttttctagatttttatatttttctcaatcgtttacaattgtcttatacgtaatagttaaacagcaatgttttaagcaatttgcatttatcagtttttcccaaaactttcaacttagttgtcatggaaaacttactttttatacttttttcatattcattgaaacatctgattgggttacatgacttaattgttacgctcactttatacatttccatgacattctgtaatttaaatgatgaataccactgacataaatagctttgtgtgaataaacacaattgactcctgataaataacttactctgcaaatgaggattcatgcttgaggggagcctgtttaccctgagtgatcactatgccataggtatgatataagaaggcttctcttttatatgtagtaactcggttgttctgttggacataccaatttggttttgtttaattcccttaactaccttgtcccaagtcatttcagaggatttaatggttaatcactttttacctggtctcagatgtttacggactgacatggaacatctctctccagagcatgaggtgagccactgtgattaccagtgccatattcatgttttaatacctcatatatagacttgcagtcttctctatgtgaggcttatgatatgctgtaatttttttaaatctagctcaatgtcattttatcgatttatttactagatgcgatatcttcagcaactcctttcacatctttaagcctctctttaattgtctacagtagggataatacactctccttcacttaatataatgagactttaataagataatgtatgtgaaaatttttaactataaaatattagttctctctgaccatcaactttcttaagtgcagtttctattttccatcttcatttcttcataactattttatttcattctatttgtctcctgtttcccctcgtttcctccaaatccctgtttatcatttattttctattctgtatcttcaacctatttttccatcagcttttccttttacgatgtttgac

SEQ ID NO: 90099 - DNA, 1037 bp, Homo sapiens
tattttaatagccatggtgctgtacctagtctcagctctagacattaaaataagggatcttgctttttgcaacctggagaaagcaaaggggcgtagaacaggacagcttttactgggaaaatatgtgtgtgaccatagtgtgtgtgtatgttaaatatatagatgtatataaattttacttttaacattagaagatggtgagtaagctaagggagaatagaaaacatttagaaagaagactagtgaaaatcaaaataaattattgttatatgattgagattttttaaagctacttctgaacctagtctagcaatctaatatgaattcctttaacaaagtaactgccaaaactaaatttttaattaacatattagcttataggaatattaaaaattaaaacattagattaaaccatagtattttactatgtaaactgtatttcactaaggtaaatttttttaatcaggttattttaagttccatgataaaagaatgtgaacaaaaagttgaaaacaagaccgtccaagagcctcaagggtaagacattaattctttttttaaggctacatgttaactttaatttttctatctaaatttgctgtcaatcagtgtaatgtgtcattttgtgttacgttatagtcctttgtttggaagacaagaaaatgatttaagtcattggttctcaaatcctggtccataaactatctcatcagaattatctggggaatttaaaattcaggtctccaccccatgccctgcgccttctctcaatattctcagtcagcctagggatctgcatgtttaaaagcttccaacaaaattcttttatgtagctgggttgttcactcaccagtcaaaagaatgtctagaaacttgtgacaggagttgtaagatgaacaacgtactgcataaaggactatcaacttgggaatgttctagtcacatgcttctaatcaaactaattggaatccaaggattcagtaaaattaaaatataagcatagacgtgaaagagtattataacgttggagtttcagg

SEQ ID NO: 90100 - DNA, 1545 bp, Homo sapiens
gacatgttgagcacctgcagcttgccacacgttgtctttgacatgttcaaacacattatcttacttaatcctcagaatattttacaacagaaattgcaagctgtgttttacagatgaggaaactgagtcagagagagctaaagcatgttggccaaaggcacaaggcaataaactagattccaagtctattacaggacagttgtcaggtcattgaaaaattgtgcttgatcagtattctgtttctgttcagtactatgataaattagcaatctttagaggtcatttagattgtgtttattccctacagagcaggttggtgaaaaagaaagaagaaatggactcgaaactgttgattgaaatcaatgcaactggcaattcaggacatcccccaaaaaaggaatatccccctaaaaaggaatataccataggattattatcagcacagcacaaaacttcattgcaatttaatttactcatttgtgaaaatactgataatatttatcttccaggattgctgtaagaattaaatgaagtgataaagaataactactaacaattacatcatgctattatgtgcctagcactatactgagcactttacagttgtgttaatataatcctaataaccctaggaggcaaatactagaatcatcctcgttttacagatgagattaaataatttacccgagctggtaaacagagccaagattcagtccagtcccagacttgttcctaaccactacacatactgcttcctttactatagataatgaacatgaaagctcctaacctagtatggcatatacaaactaccctccataaatattagtttcccttttgtgacgccaattcagagtgtgttcgttaatgatatgctactaaataaatgaaaaatttttatttttttaattgctttacatgaattttaaattttctttcctagctcaatgtcaattgctgcaagcttagtgagtgaagatacaaagaccaagtttttgaacaaaatgggccagttgacaacatcaggtgccatgttggccaatgtatttcagagaaagaagtagaagcaggaaagaagcccccagtaaacactaagatggacctcaagccgactggttccttgtacttgaagtacttgccttttttgtttcctcagttttatgttcttgcattataattttatcctaacctccaaagatatttgcactgcttttaattactgctgtatatttgttgattttggagttacaactgtggtgatagaaaattgagttgatggtctgtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagactttttattgtttcttaactgactagaaagagccacc

SEQ ID NO: 90101 - DNA, 1050 bp, Homo sapiens
cccatggggagacccctccgaagaaatcccccagggtgtgactctgggtcatagggtgggtgggtgctctgtgccacctttcctcctgccccccatcccatccgagaggggagacatggatatatgcagtcatgccttgtttggggagcacagacacagatctgtgggcttacagttcattttgctgagaaatatttcaaatgcctcccctgttatttcctttctaccacttccccctaaaatggcaaacctgtaataggaacatactccctgtgttgataaggaaatagcttgctttttcagttatctaccagaacttcttacatcaggaaaactgaaacaataaaaatgtgcctttggaggtcaataaatcagtgttttatgaggacatgaaaaggggagttccaaagcagggcctcctctgcaaagagtgttgttttaagaaggggtagtgtggacttcatctgccatgtcaatattaaaatttcccccattgtattttcctatttttgaagttcatggaaaaaaaaatagtgtttttcccacatgctgtatccagtggtctctaggaatgttgtctaggccattttttggtttgttttttgtttttttggctgatgtgagtctgcagcccatcctgatggtacgcaactgtccaggtggttcactccctagggcatctgccccctggccaggtggcccatggcctgactgctgtctcctcacagcatcctggccttagtccacagggaagcacacctgcctctgagcacacaggctgctgactccagctcagtgcaccccaggactggcatgggtaggattctgcccagcaggtgatttttcctctgagtaccctttcattctctgcccggattgtgggacggcctttctgtgtatttccctctagttgcagtgtggggctttctatggtgtccactgctggaaacacagtttaagttcagctcaccctttgtgccccaaaacgctaagcttgaaagaaccaagaaggagccgtgggtttcagcaaaatagccttgatccctctga

SEQ ID NO: 90102 - DNA, 1025 bp, Homo sapiens
gctttcaacaattttactatgacttatccatgatatgtcagtggttattctgtttggaattagttgagctgcttgaatgtgtagattaggtttttcatcaaattgagaagtttggggcattatttcttcaaatattttctctgcacctttcttctcattctggtactctcattatacacatggtatccttcaggtctgtgaagctctgttcattttgttattctttttcttctgttctttagattgaatctacttccaagttcatagattcttcttctgctatctcaaacctattgaacccctctaataaatttttcattccaattactgtacttttcaacttcagaatttccatttggttctttttaataatttctctcttttcatcagtattctctatttgatgaaatattgttgtcatcctttcatttaattatttaaacattattttctttagttatttgaatgtatttagtctttgtctagtaaatcaaacatctggcccccctcagaggtggtctctattgagtgcttccatcctccccttccactgtgtatgagttatacttactgtttcgtagcatatcataattgttgaaaactgaacattttagataatgtgctataccaagtttgaattctggtccccctcaactgcaggttgttctgatttctgttttgcttgtttgtttagcgatttgcatgaactaattctgtggaatctggctccctcacaacatgcagcagctaatgtttctgctcagttaatattattattgtcgttatcattgttttcacttcatgcctaatttcctaagggttaccctgggccatcatagcttactggtcagccagtgagtggtcagaagttgtgcttaaaacatcttgatctaataaagcttctactttttaactgacagatttgtgtttaggtgaagatcacatgcagtgtacaggcagtttacaagtctaccctgcttttattttttttattttattatttttttgagacggagtctcactct

SEQ ID NO: 90103 - DNA, 2902 bp, Homo sapiens
cgggctccgcgcacctcacctccgccaatcagcaccgcgaatcgacggtgacgtcgctctccccgccccctggggggccgcctttctccaggaagccacgcccaactgctggccggccgcctccctctcggcggcttccgtgcggtcctaaaggctggtgctcggcaggaggaggacgcgggctggggccgtggggcggcgtgagggtagcccgggagcggtgaggagcgtgcgaggcccacgtgagcggagggacgcggccgctctcacctttcctgagggccctggcccggctttggactcctgattctcctctgcttgccagctgccgccccgcctccgccagtggtgcccgggctgcctgcgcggccggagtgaacgcgtcccgggagcaggggtttctccgaagtgagtgcgccagccccgggacgagctcgttcgagtcctcaccgcccagtgcacttcctgaaagccggcggtgggctgtctcccaccttgtgaaactttgccaggtgtcgctcacaggggactgggtccggacgcgggtggcggcgctggtttgcggccccggtttgcggccccggcgccgcgatcccgggccgcgcccacgcccaggctggaggcaccgtgcgcaggtggggacgcgcggccgggaggtgcgcagcgggacccggccggccgagggtgagcgctgctggggacgctcctagtctgtaacgctctgtgaaaattatttcctggatagtttaggaaaagcctctcccttccccgcccctaaacctctatcttttgggaatcattgatttgctaaatgacatttcggtgcctaacccattttgaatccttgttctgctgtgaatttcatgtgactggaggaatttaataagctaccaacttgacaggctttaaacttaaaaaaaaaaagttttgttacgtttttcagatttaggcttccaagatgtttacactcgcactgttacttttttttttttttttttttttttttagcaacatagtccaaatttttaaaactcagctggatcttttgagggttaattaaaaggtgggttaaaaaaaatcttaagactttaaatttagaagtcctactacagctatgtagtaggagtatgcagaaagataagaatcacattgtaactctttgcggtggtgctggaacatctgttgggagagcatatgctgaactctgttcacctcacaagtttatgtcctaagaggctcattcacagttcagtaaaagggtgaactgaagcctgaatcagtttcggggatgaaagggtgagagggagaactgttttcagcacatttgaggttggcaaaatatataaaagtcactctttcttgtaatttgctagttctttacagtctttagatgtaatttacagccaagaaaactttattatgaggacttatacgtcattgcccttttttgctgtcaccctcaactaccctgggatcttctactcatatctcatctcctgttcccacttttctaaagcttagggtgaaatacttaggcaactagtaataatattaatcttgctagatattcacaggttcatagtgagccagctgtctagatctggatatctagtgagcaaataaattctttacctccgagttgatttttgttttattgatcgattgacacagtcttgctctgtcacccaggctggagcacaggctcaagcagatcctcctgcctcagcctctcaagtagctgggaccacaggcacgtgacaccacacctggctaattgtttgtatttttttgtagagacagagtctcaccatgttgcccaggctggcaaattgagttttatatgtgacgcagtcaaaggggcattttccttggcaataagaagccatttgatatgaactctccacaatagttgatgcatacattttataccagaattcaaatttgtaatcaataatgattacttgggtgtttatagctttggccaacattaaacaatatagtgatcaaagcttatacacataagtgacatataccatgatttaatgattttggttatccatcagctggacaatttgttgtttatctccgtctctgcatactgcagctcacaaggaggcctcaatgttttttccatgttaccataagtgagagaacacattcagtaagagtgaaaaaacgctagtgcttttgagggaggggccccgatggaagtcccactgtgacatgtgagtttttaagctgggaaaactaccctgatgattctagtaagactccctagaaagggattcctcttagccagcctacctgttgagaacacctgctctagattttctgatttttttttgtattccctgcataatcaaatcatgtgggccagataacattattgtgatagtggtgagtgtgtggtttgtatccaaatattttataaagaaatatatcttgtaacaaaaaccaggacacaaagtattattgtctcttgtccccagatgatatatatatttttaacttcccatactacactgatgtacctagatgatgtttaatgcacattcagtatattgttttatttgcctttttaatagtgaaaggtgtcattattcatataccatgccataccgtaatatagctggtattattgtccaagtatttatatgtaaccagaaaactgattccaagtgaaggtttggatgaaggcactagtgacggaggaggcttttcaaccctcctttttgcagctgggttgctgcaagacatttcaccaaaacctcagataactgggtggttcagggcagcctgatacactaaaatatatcaactataaaaaggatgcccagatacgtccacttctacttcagatatcctgaaacaggcagtctgattcatatcaagaatttgttcc

SEQ ID NO: 90104 - DNA, 1116 bp, Homo sapiens
tattacatgctttgaagttgactgggcccagcaactgttagtgacatgccatggttacaatgttaatagttgaggtataacacgtacacaggttgccggtagaatatatactttttaggctacattggaaatacaggaaagctcaacaaggatgtttttacttttaagagtaacatttctagagtttttctattatttggatgactttatggtaaatattacattggattacaacttaaatgtcagcagtttttttaggaggcttgtacataaatctcacattcctcacacaactgcggtggactgccagtaacttgtacaaaattcagcaaagaggccagggagcagtagtgaagtcactcactactgtgagtgtcctaggaactctgtgtgattgttacaatcctgtgttaggaagttacagactgcttatatagcatagctgaaaacgcttggtttttaaaatgggtgtcttcctattattaggaagccaaactataaattgtgtgttagcaacaaaaaaatgcctatgtattttaaaaggtactagttttgttgctgtttcattgaaaagacaggaagcaagacatgcaagcaatgtttgcatacttaaagacattcgttaactgttcgggaaaatgggtattctcattttggaggtttagtccccaactagcgacacaaaggtataagaagcataaaatatgtagacgatcatagtagtggttattgattaatatggtatgacgattctctggagattgtgtcaccaagatcttcaaagcttaattgcttgactaacagtactaatgtttgaatgaaagataaaaatgtaaactttcgatactaaggcacaaaattatcctatgtctttgtgttatttgaactcacaaaacatatttgagttcatcatttgaattcacaaaaatcaagtagccatgagtccttcacttactaaaagtagtgaattaaaaagaaaaccttgcggccaggtgcggtggctcacgcctgtaatcccagcacttcgggaggccgaggtgggcggatcacgaggtcaggagttcgagaccagcctggccagtatggtgaaaccccatctctattaagaaaaataca

SEQ ID NO: 90105 - DNA, 1295 bp, Homo sapiens
tttgcctaattttttacagaaaaaaatattaatgtatgtttactgcagatttgtaaaatcataattgattcttaaaaccaagttgattttgatatgagtagtgttttgagattctgcacataaagggaggggataaggtgcaagctgtaataaaaaactgtcataaggctatttatttacttacttaatatgatgttgtaacagtttgtatgtgacagtgcttgatttctggcgagctgtttgtaagtttggcatcacctttattactccaagcatcggatctaggagtcaaagttaccccggttcactagtgattggctgagcaaactcagttaggtttagagcacccagttgctgttagatgactgaaccttaatggtaaactccctgcctgtacatattcttgtttagaaatccttggcatgtattgatgatacctttcataagactttttcctaataaagcatctttttagactgttattaaaaccaaacaatgaataaaaatggtgtagtgattcttgtaaaaagtacacatgccgttccctatggaggattagtgtaaagggcaccatttgttatgtgttcctttgatttggattcagaattgacatcattggcaactctgtatattattaagcaatttcctgtgtcccaagaaagctaggacagtcaataattaatagagtgctcatcttctgcttgcggctctcacactgtgcctttgtgcccatagtgtgcagtcacctattggacctctaaaaattgccactaaaatggttgttagtaaaatgagaagacctaaatctgtgattattactcttagtccatggtttaagttaacgtatctccctctttctcatctagaacaactctgctcatggtgattacatgcaaaataacgagagcagcttaatagagcaagctccaatacctcaggacggacttaccgtggcacctcacagagctcagcgagaaggtatgctctcttttttgtaaacttaaagcattaatacatcaaaagattacagggtgctctttacgctgattaactctaaactttttactctcctttttgaagtggagaagtcctactggtcctaggcttcactcaagagccagtcctcctagttctgccatctgcacgctgggtgtttcctgcgccacagccctgcttgtcctagcacgcacacagtcattctgctctgtagtccattgtcttggctgaatcttaaacctggttgcatgcttctggggggcagagacccccagagtatttagtatagtgctttattt

SEQ ID NO: 90106 - DNA, 1052 bp, Homo sapiens
acaccagacagaacttgaaattatcactgaagctgtgttcccatgtcctgtaatgtcatagtggctttttctgctaagcaaaactgggttctgaccaaacaaaacccaagatcccctacccttgaggggaccaatgatttgcagaagtagagctgctttatttctgaatataagattagttcagaagatttttgttgaatggcgtcatcctttaacttaatataacagcttttggaaacagcataccctcccatcaccactttggctcttatcctattgcacagttctaaggagttacaggcttttgcctggctttttgagattttccgttgtttccatcctcaacatttctggcccgcaaaggggaaactggcccacaagcaggccaccaaacactatatatttgggaagttgacacaaaatactggtaatgttatatcctttgtttattataagtgtcttttcccctgtgtatttctgtatcttatgcttcatgccttctcactgcccaccttccgtggtcttttaacagtcttactcctcctctatgcttttgtcactttgtgtattccactttgtctattttaacttcttcctctaaggcaaaatgaatgaatgccccttttttcctccatctcctgctctcctgaatccaacagtgtaccccccacacccattctgttgagttactttcctaacctcttctctgtaacctttagcatattcattatcagcctgatattacctccctcattatcctgaaagtgtggtttcttctgttcataccctgaacagcagtgtctttaagtccttagagtagagtacgctttgtagattggctcttttgaaattgatttatttcctaaggtggtacttttattaaaggtgtcgtaaaatggatagttgggggatttatacatttgcttacttcatgaataaactgattatctagttcaattcagagtgttttaaagtttaatataatttatgtttactattttatctctgtaatgtaaaaaaattttgccacaatgaacgtttattataatgtt

SEQ ID NO: 90107 - DNA, 1031 bp, Homo sapiens
acaactattcagctgtgcacttccctgaaatagttctccatttcttccttctttgagttccagctcctccccacctcaccccccatatgatagaatctccaaactactgggaataagaagataatagaaacatcttattacagacttgccagaggtgaaaggtatcttagatcattttgttcaaaccatcacctgtttcttttatactaatctgattttatcgaaaagtgaatagttagaaatacatatcaaaaggagagaataggtataaatggttgataaattattctttctcagtaagcaaatattttaaaatttattgttagtagagagataaagcagaaagtccagaaacaaaacattcccaactgacttactaagttttggttacaagtgtagttattaaacatataacatacgatattatgaggctagtgctagttttaggttgtctgcttgtcaccataagtgtgttcttttcagatcattcttaaatctatgagagacttttattcatcaacttgtagagctttgaatagcacattagatgctggttctttgaggaagactgtcaaagtgtgaattccactggatttcttattagtccctgtgaatgaagtagcacccagggatgacttgaatagttccatcttcctgtggtttattataaattaggctctgtcagttaagggctgaggacttctcctcccactcattagtgacctgccttgggtaagattaggggatgagttttactcatttccagatgctagaggccactgcctgtgacatgtcagctctggacaccttggggagagagatggcataggtctgtgagcttctgtctgctgtgctcagtcatggtaacagtcgtgagggtgccagagaagagtggcctagaccggggcaggctccatctgccaggcagtgcaccccattggagaaaatgagtgcctgaatgacgttctaattacagaggaggctaagcagggctgcctcaccccaccgccacacacttttacaagcccttc

SEQ ID NO: 90108 - DNA, 1160 bp, Homo sapiens
gtaatcccaggtactcaggaggccaaggcaggagaatcccttgaacccagaaggcagaggttgcagtgagccgagatcatgccactgcactccagcctcggtgacagagcaaaactcttagaaaagaaaatgggtaggccaggcgtggtggctcacgcctgtaatcccagcaatttggggggtcagggcgggtggatcacgaggtcaggagattgagaccatcctgactaacacggtgaaaccctgtctctactaaaaatacaaaaaattagctgggggagggggcgggtgcgtgtagtcccagctactcgggaggctgaggcaggagaatggtgtgaacccgggaggtggagcttgcagtgagccgagatcgcgccactgcgctccagcctgggcaacagagcgagactccgtctcaaaaaaaaaaaaaagaagggtagattcagacctggtggtcagagggcatgattcccacagcgggtgtgtagaatgccgacagagtcttctatctgaccagaagggacttcattctgacagagcatcttgatcttgcaatctactgtacccacaatgaggaatgctttatgctacctttgctaagtttctcatttctgaattgactcaaaatacttacttttcagaagaaaatttacttcggacttctcaaagctcaatatgtaaatcaacaatttgtatagatttttgtattcctgtggcttctcagatattgttaatggttctactctgaattttagtgaaagtgccagtaataggacagattagttatcaaaagtcaaatttaaaactgaatttttcaaagacttggaaagttggcttatgaataatcaatttaggaatttttttaaagtaaactggttaaattttgtttaaaacctaaaagttttattggccaagtgttgatttttttgtggtttctagcacattgctctgagggcacctcaatcacatgaggcacctctggcgtgtggtttttatataaataagtaatattgagggtttctcacccgtctctcatattcagttctttatttgcttcatagcactggtgatctgacattgcctgagagtaaaacgtaaaacaggaggcacaaaagtgctaagtgcaaaggcagagataacactccttggaatactattcc

SEQ ID NO: 90109 - DNA, 1056 bp, Homo sapiens
tcctcctgtcacctgttcccaattgacctttccagccgatcagacagaaaatgttagccctgttcttctcactctgcctctttgttttcatcacggaaaggacaacccatactagacaaaggatgtcttcctttatgtcccttcgtcaccatccctttgtttacagttaggcctttctttcatgcacggactattaaaggtaaaccctcactcttttctcagattctagtttcccactctgatctatccctggattatcacaaggataaatgtgttaaattcctgcttggtctgaaattcaggcctcactgtgaccttccgggagcttccttctgctccctgtgctctgtctcctagcatgcccagctgttgcctgccctgtgtctttgctcatttgtacccttacttaaacatacatccttttgtcatagcccattaaaatcacacctgttttaaggcccagctgaaacatcacctcttccacgaagctttgccagtttttcttatgttccgtatgttgagttttgccctcttatttcacctttcaccactgtctgccttgtgtttaattttctacacatctacctcagcctgccttttacaaatattttgtcagtaacattggcgtgtcctttagcagaatttctgctgaacttcaggcatagctatggcaaggaacatttttcttttttaaaactgtccctctgctctcaagagagtcattttttcctgtatttaaaggggaaagaaaaacacatatttcctcaatttgaggtgtgagaaaaagaggtgcaagaatagtatgattgttacacgggctaacctttaaagtttctctaattaagtgtgttaatgctaacgtaattatcaatccgaattaaaaatatgactctttgtgattagttgaccaagacaaaatgtacaacttcatgattaaatttatgtctgaatgataacaacagcatttattaaagagaatcctgatcattctgtagctatgtagatttaaccatcagtgctttccccctgcgccaaatgtgttttttattgaacatg

SEQ ID NO: 90110 - DNA, 1757 bp, Homo sapiens
agacactgagagattaacaatttgacagtgccacgttattttattgtattttacaaaagtaacgatccacagcaaactgaagatttaaaaaaatgaaaactgaatctttaccacaccacagatgtttaagaagcacctttctactttatttcctcattttgcacatgagcacactggggctgacagatatgaaatgacttgtccaggtcagtcgctcttcagggaacagctggcctcttgaacacggttcccactcacagtctagtgctttgggctgtgtcatcttgccttctcactagtagccatgttttcttcaccactcaccctccattcattttccttaggtaaaaaaacaattattatatttgttttctttattttaattttcctaaaaagttaatagtattgaatgcttcctgcagataacttacaatcctctctgaagacttctaagatattagaacacttaaaagaagacagctctgaagcttcaagtcaagaagaaggtaaaggtagattcactagagtaaatcattctgcctgctgatagcacatggatagaacatttaaggagtgaagaaactgacatataggaattggaatgtgacagaggttgcattacaaataagtggagaaggaatagaccattcaataaatggtgtgtggagaaagaataaattgttcaataaatggtgtgtggacaaagaatagaccgttcaataaatggtgttggcacaattgattttccatatgaaaaaataggtataattagattcccagttacatcatgcagaagacattcaagtgaataacaacttatatgtaaaatgtaaaacttaaacttttcaatgttaatttgggaggagaagcctttcttgaataaagtagagcatgaccacggtagagatcttaataaattagagcttctctgtgacaaaaggaaccatatagccaggagaccatccatagattgagagatggtgtttgcaagatatttacagataagactatatccagactatggaaggatcttcctaaaaagtcaatgagacaatcatcccaacagaaatataggtgaaagacataaataggtgattctgagatgaggaaacctgaacagctattacataatgtgcagcctcactggtagtcaggaaaatgcaaatggaaacaggtgtcatctcacactcagcagattgacaaaacattttggagtctgacatcaaggatatgaagcagtgggaactctcaggcactgctgatggggatataaattgacagaactattttggacgaaatttggtgctgtgtagtgaagttggagataattatatgctgctgtccagcaatcctgcatctatgagaattgttacacacctgcaaaaggggacatgggcccgggtccttgaggcagcattgtttgcaagggcaaataccaggaaattgcctgaacatttcaaatgttagtaatgttataaataaataatgtctttgtactaggtagcaattaaaataaaggatatttatagtacaattggctctccatctctgcattggtgggtttaaccaactgtgagctgaaagtatttgggggaaaaaattctttttcttgtcattctctaaacaatacagcataacaactatttgcatagcatttacattgtactaggtattataagtaatctagagatgatttaaaatatacaggaggatgtgcatagattacatgcaaatactgaaggacagttgtatattga

SEQ ID NO: 90111 - DNA, 1032 bp, Homo sapiens
atgttgagaaatgcttagaagtgcttcataccatctgtcaccagtggttatgatcatacaaactagtagcatcctactgttggtttttgctgcagcatttagtgtaataagttactttttcctctcttctagatgtgttgcagcatgccataatccacaagaagcatactgggaaaagtcccattgtgaagtaagtatcctctttctaaaacaaaaagtgctttggtatgttttaaaatcaatgtaacatttaattaaatttctgatgtatttggctataattctgtcattttgctatttgctttttatttcttcactttttctgtttccttttctcactttttttgcctccttttgggttgtttttcttctgtggtttttttttgttttgttttgttttgttttcccctatcatctttgatagttttacaatgaaagttcttctagtggctaccctagagataatattacatatctttgacttattaaagttggatatttgtgcttgtactggtcccaaacaatttgaggaccttagattactgcaacatcatttatttccccctaacttgtaagccgtggctgtcatgcattttaattctctgtataattttaaattccatgaaacctctttgtagtgtttgtgtactcattccttcctgtgtctctgagcatccacctatgatcattttccttccaactgaagaacacttgagtatttcctatagtcacatcggccagtgatgaatgcactcaaatttttatctggaaaaaatgtttattttgccttcatttttacaagatactcttgccacatgtggacttctaattgggcagttactttccgtgagcttttgagagcatagtttccttatcatctggttctccctttatttccttgcatcttattctctccactcacctccagtttctcctgcagatcccataaaaccgtctgtgatttcttactcataccacattagcgctgtgctcctcaagtatgagccgtgactttccatgttccgccttagg

SEQ ID NO: 90112 - DNA, 1007 bp, Homo sapiens
gaagcattttattattttaaatactccaagtaattttcattgaataggcattttggcagcccttttcttcttgagttcttttaaagaatgaattttccagcaagctcttaagagttaaaatatctagacttagaaagtagctcaaagtgatattattggacagaccctgcaaccaaccttaactcgttttttctttgaagtcagtaagattgacttattctgtgcattgttttaaggatatatttattaagtattttctattagaattgtaatttaatcagtttagatcaaggacaagcttttttagatggttgtggggaaactgaagaaaatatagctaaaattaatttctaatgattcaacttagaaattaatttaaaatgacttaacatgattttttaaaatagtgttgttatttttagatgtgaatttggacattggctctggacatgacacatgtggagaaacatcttcagagagttacagttctccatctagtccccgacatgatggaagagaaagttttgaaagtgaagaagagaaagacagaggtttgctctttgaagtgggagtattgttggcatggcaggggtggggaagtggagggaaatgtgtgttgtttcttcatgtcaaagtcaaacaaggaattttatgatcctataaatgccattaactgattttaaatgtaaagtcgttataaaggatgtcgtatagatcattgccttagaaattcctaacaatgttgatttgataaacatatttcactgcatatgaagttaagtaggatgaagacaggatcataatgaggtagagttagtgtagaaagaaggaaaatgtgtcttgttagatgcatatgtatgtttatgctctttacgtcctctcgattgattgacccttttatcattttgggatatccttctttgtctctagtaacaatttttgtcttaaagtctattttgtctgagaatagtatagtcgatccagcattctaggtactgcttgcacag

SEQ ID NO: 90113 - DNA, 1049 bp, Homo sapiens
gagctgttttgaaacttaaatgagaggatttttttcgtcttctttttttaaatttatgagacagggtcttgctgtgttgcccaggctggtcttgaactcctgggctcaagtgatcctcctgccttggcctcccaaagtgttgagattataagcatgagccactgcacccagcattaaatgagaggatttttatgccttacccagaatagacaaactttcagtatgtttcattgtacatttatgcttgattctctaggataagcaggtgactctgtggctcacactgcagatttggccctgtccgaagtgttagtgtacatctgtacacttgggtaatgacagcatccctcttctgccatcagatggcacaagttggaggcctgtgtggaggaacttggcttttttcaaataggctgttattaaatatgaaagaatggcttagggctgtcttcacccaaggaaaatatccattatggtagagagttttgatcatttttagaattctgagtggatgaaaagtctcctttgaaaagggcgtgggtggctttgctgttgctctcctgggtagtgatggtatttctgtttggggctttacacttaccgaaatcagtgcacaaaagggtgagacatgtctcagcatgtctagaggagtctcaggatgcttagaaaaccaactgggagcattaaaaatcatgaggccatttgctatttcacatagaaatttaacgcacttcttccaaaatgtttctgcttctttcagacttaacatttttatctttgactgtgcactggtgtgatgatacagataaaatgccttcaataagtttggattttgggatagtttttattttgcaaagtttagcaagaaataccccaattattaatctattaggggaagtttatgctagaaccattcactctttgagtttcttctaatataaattaaaatcattgaattagtaatactgttgatgttctgtgtcagtaagtagctttcatttaatctttcttcaggaagacgaattcgtttttagtgttctgtttgaaaa

SEQ ID NO: 90114 - DNA, 1083 bp, Homo sapiens
aatattgtcttgactgagctctttgaaattgtatcatttatctgcgacaaattgaagaacttgggttggcagtgcagaatagaaaccaagtggattgcctgaagtttattaaggttaagagtgtctgatgctcttctcagtacaaagatggtgttacataaatctctttgttttatactatgtttcattcagactccaactagccttttatgttttgttttctgtttatatccccgtattttaaaaataaagcgttgatctaatatcgacccatagaaagccgaaagttaaagggaggtcagcttggacagtcaggaaacatagagggacactttccaaacttgagttactttgaggtatactcaatgtttatttctagcaagaaagatgggagttatgcccgtgttaatatctctttatgtttgttttctttagacacagacagcaattctgaggattctgggaatccatcaacaactaggtttacaggttacggttctgtcaaccagactgtcactgtcaagccacctgttcaaattgcttcactaggaaatgagaatggaaaccttttagaagatcccttaaactcacccaagtatcagcatatttcttttatgccaacgttacactgtgtcatgcacaatggtgcccagaagtctgaagttgtcgttcctgcacccaaacccgctgatggcaaaaccatagggatgcttgttcctagtcctgttgctatttctgcaataagggagtctgcaaattcaacccctgttggaatactagggccaacagcttgcactggagaatcggaaaagcaccttgagttactggcttcccctttacctattccatcaaccttccttccacacagtagtactcccgctttgcatcttacagttcagaggctaaagttgccaccaccacagggatcttctgagagctgcacagttaacatcccacaacaaccacccggaagcctgagcatcgcatcaccaaacactgcctttattcctatccataacccaggtagtttcccaggctctcctgttgctaccacggaccccatcacaaaatctgcatcccaag

SEQ ID NO: 90115 - DNA, 2425 bp, Homo sapiens
attgctttttaaagtgagcggattggccatttggagtggcactagagctgacgaaggtgccttgtggagagcatgcccgtgtgatagcttgtacgtagtggtttgtgatgacgtttgcttgtaagcggtgacttagttctgtctttcccattttaggcacttacagactgagatacgcacctcccctccccccttctaatgatacgttggattctgcagactgaaacgagtaaagcttgcctacttaatacactcaagtgtggggagtcatggggtgtggaggggaggaaaggaaaggtattttgtttctttgtctatacatttcctagatttctatgcagttgggatttttcatttctcttgtaccaatgtccaaaacaagaaagaatgcaatgcttttgagcctctggtctcctggttcaacaacaggcttatatgtatgatacatgtaatttaaaccttcagacaaacttaaatgttggtgcgtgcttttttttttttttttacactgaatacttgctgtgtgcaatgtttactgaatctttaaaactgtgtatttgaccttttttttacaacactggtgacagtcatatggttttgaaaaaaaaaagaaattttgcttcttcccagcttttctcactttcaccctaaacgacacttcctccccagccagcctcactctgtctccggcccgcagcaggagcagccagcagtgcattcaccccacttttgtaaactgctctgcatataaaccaagggcagaatgtttcaccctgatcttatgggaggaatcaaactcccaaaatagtgtgtatatatgtaataaacagcgtcacgtaaatacatatatgcagtgcttgttgtccaaatagaaatgaaaataagtggaagagagaggaagaagtcaaaccatatgaaactgaaaaaatatgacgtacgaaatggacaaaaagctttttctgaaaccaactttttacttccatcatccttttttagcctgttgcttcagagagacacaaagtgaacacactggtgtgaatgtcgctctctgtgtgcttgtgtttgtaatgaaagtctacagccaattttacttgtctaccaccgtgttgtgctcaaagagacactacttgagtgaagatttcttctttccctgtaccagctgttacagtgttacgttgtgtttaaaatgtgtatggtttattgcaatctgaacagagctatgggtttctaccataagtcaggttgtttgttccctaacctgtctctcatagcaaagtcacttttataacagtttaccactatgcttgattataatgtgaaaggcggaattctgagtgtgttaagatggtattaatcatgtcggtgtcatgtcactaagtttaatgctgctgtttttaaaaaaaaaaaaaagtttttttaaaaagccaatctatgtactaaattgcttccaggtaatttttgatttcctaaagtgcactgaggttatctggaagattgggtgtattttttggtgactgctgcattcatcagcaatgaacagtttccactgtatagtcctaggggtcagggggtgggggtttcattttccattcctcagcacagagcagaaatgatagatttttattgtttggagtaacgttggtatgcagcagaggaacgtaaacatttggtcttggttcagaagcctaacagattgctagacaagagaaaaaacttgaagaaaaaagaagcttaatttcatgcttcataagtagcatttatatttatagcaccaatgtacattttgaaactttctttcaggggtgggagttatggggaaggggtgggtgtgaaggggtagatgaaagctttaatttagaaagaaagttcaagtaaaggaaattattttgattaaatatattttatttgatctgggtatttttggaccacattattaaattaattgttaagctgcagttgagttgttcaagtgagagttttgataagccacttatgggccgcgttgtgaatcacttgccagttgtactttatggagcttattttatgatttaaaatactgtactgtacataggaggtatgttaccttctccttatttgtatgtttaccatatactttgatatttgaaatgttatgtactggaaaggccacttatatttctagaacagattggattttatgcaaccttttttccttgaattaacagcaataaaaaaatgaaaaacagcttaagaattgtgcctcattgtaaattttgtaaaagtggagataggacatcatacatggcgatttttttaaagttttatttaggtatgtaattattttggggttaaggatcaatccatttccctgcagggtgggcagtgaatcccaaagttatttaccatctggatgctcctcagttcttcccccaaataacctttttgt

SEQ ID NO: 90116 - DNA, 1051 bp, Homo sapiens
ctcaaaacctcatctcaatattaaaaaagtctttcctggttaaatcttaaaatgtttggcatgatcttttaatctttttgttttgttctttatgaaaagcagtaattgttacctcattctgcacttactgccttgtttctatatgtacagcataaatgcatgtatgcctctgagtatgtgcttacatatactcagatgtgtgggggtgccacacaaagtatccaccctattcttgaacatgaagccagtgtacaggtgtcctagaagaaaaatgcctgattgttgcgaagttgtctaattgcttattttggctttaaagcaaagttgagcttattttaagcctaagttaatataccagacatctctgctgttattcatttgcagtagaacaaaatttagtgtatggtgaatccacttgaatttttgcaaagaagttcagttattgatgaacaaaagcgtagtctcatttatggaaacgttgtcaggactccacatatagtgaaggtttgcaccaggctggaagtgattcctagaaatgatctctgtgttccaacagaatataggacacctcaacaggacagagttacattttggtagtagtttttttctgtaggaagaggataattaatgtttgttttagatgacatcttttacagggtttttgaaaattctgtaccccattggtaattttatacataacttatttttaaatttattgctgcatgttgttttgtttacgtatagttggggttaaggatagctaggaagttgctttcaaattcttttgaatatttttctgcatttaaattgagcttatctactgtcttgagggtctgctctcttgaagatcacctttctgttcaattttagtatttataacctgactagggttgttttttagaggctttgaaagccatttgtggttgctttgaatatttaaatatttatctgggtaaagtaaaatgaaagtctttaatgagcgagaaggccctggataaaggtactatctaattacagagttgttaatgaaaacttggtttgaaaattgtta

SEQ ID NO: 90117 - DNA, 1356 bp, Homo sapiens
agtttggtaacttgtctagatttggacagtgagcaagagagaggcagaattcaagttcaggcatcacatgtcagagttaacttgtaagtgtcccccttgatttgctgaatatggaaaacgtatccctaatgagcttctgtggtcagtttgggcacatcagcatttgtgaagcatagactttaaactagttaccacctggacttgagttctggctgtgccactgacacggcttttctgcattctttcttacctgctgcacgaggttgttgagaggatcaagtaagataatgaatgaaagtgtctatgacgacagtactagttcttacacaccatccctccacattttgggatgtctgttgctgctcttccttggggtggaaagagcactggagcccttctctggtctttgtgcttctttacatgatgtgagacctatagtaaaccccttaacctccttcagcctcatttattagagagagagagaaaaaaaaaggtgattttaaaaaaatctgttttcggccaggtgcagtggctcatgcctgtaatcccagcactttgggaggccgaggcaggtggatcacctgaggtcaggagttcgagaccagtctggctaacatggtgaaaccctgtcactactaaaaatacaaaaaaatcagctactcgggaggctgaggcaggagaatcctatgaaaacgggaggcagaggttgcagtgagccgagatcgtgccattgcactctagcctgggcaatgagcaaaactttgtctcaaaaaaaaaaaaaaaaaactgttttgaagaactttgtgagattcagatttgatgatacgtgtggaagtgctttgtaaactgtgaatgttatacaaatgtcatgtggttttattatttttagcaatgggaaattgccacagatgttaattagagttaattagggctcattaaggaagatgggatctactgttgttgggcactgatgctcagttacatggaagactgtacaggcataccttgttttattgtgcttgcttttgttgtgctttgcagatattgcatttcttacaaattgaaggtttgtggcaaccctgtgttgagtaagtctgttggcaacgttttttccaacagcatgtgctcactttgtgtctctgtgtcatattttggtgagtcttgcaatatttcaaaacttttcattgtttataattttttaaaaaaaatagggaacgtttcatgaatttgcatgtcatccttgcacagggaccatgctaattttctctgtatcattccactattagtatatatgctgccgaagtgagcacccttttcattgttatatctgttaaggtgatctgtgatcggtgattt

SEQ ID NO: 90118 - DNA, 1178 bp, Homo sapiens
gagcatctaatagtttcttacctagcatagaaacctctgcttgtccattcctgattgatggttagctggcctctgcttgttgactgcattgtgttgagccttggccccttgaaatgtggtctgtggaccagcaccatcagcctctcctgggagcttgttagaaatgcagaatctcaggccccacctcagacttactgcataatcggcattttaacaagatccccaggagtttcatctgcatggtgggagtgggagagagtagaagttgaaggaggtaaaccactgtgtggttcaggcgagacactgagggcctgagctagggcagtgggagggagtaaaggagattgatgtggatattatcctgggactcagtagctaactggctcttttggcaacagaagctccaagatgacaagtttacagttgggtgatggaagaattgtggatcagttcataaaagtaggaagcaacagattgtgtagcggatatcactgattaattcagtgatccttgaggaccaggcactacttaggagttggcgacataatgaatgaaagtgtgtcctctgttcttggtatttacaatttaacattgaaggactggttttgctgaggcatgagtttgaaatggtaatacatgttaagctgactgcagccatctgtttagttggtaaatgggcctggctcaccacccagcttccaaatttcagtggaggtttgtcactttctactggttaccatatgtgtggtaactctcaggaagtgatatagacattatttatttacttggttttcttctaggagccatttatttttttccgtatacaaaataaatgctagcactagctatggctatcagacagaagtgaggaggtataaaaagaatatgtattacatttatgaagctcttaggatgtatgtcttttgaatgttgagtttttcctatctaatgggaggtgacgtttacataaataataataataaaacttgaaatgccttattggaggcatttacacagtgccaggggaatccagaaaggctgacataccagctccctggaagtagaatcctctggaaaggattcctgggaaagattctctgagaaaatgagagactagcattgcatgaaaagggcatgccaggtactgcagcatgaatgacagggctcgatgtgggtgg

SEQ ID NO: 90119 - DNA, 1052 bp, Homo sapiens
ctctatttaggtagtacttttgaagcctttggattgaatgaaaatgctagacagatagtagttttgaagcctttggattgaatgaaattgttagagtgaggaaaggccttaggaagcaactccgaagaatgcctatatttaaaaagtagtagcgagttatattgagtgaaataattcagacatgaaggagatacaactctatgattatgtttatatgaaggtcagttagctggcaaagctaatttttggtgacgtattgtagtggttacctttcagcgggatatggatgggaagggacatgaggagccgtctggtcttgatattgctctttgtattgatttgggttttagttttctgggtgggtacatatacaacagttcattgattggtacccttatggtttgtgtgctttattagatgtaagttatatctcagtggaagaagagaagaggccctgaaggcagaaatttgaacagtatttctatcctgaagggagagagggagaaagaggctaaggatgatggatgaacagaggggaaaaatttaaacaaaggaaagaaagaaataagcaggcatggagcatccatgaaggagttaaccctaggtgggaagagggtcgtctgtttccataaggcttttaggaaggatggataaagagattcttgtaagagctctggaagtctttgggtctcaattggcctcagttttcttagtgaattagaaggtaaagaagagtcacatctcaatatttattgtaatatgctttttctcgagctcatcaaccaagtaatcatagtgtataccatctgttgtgaattcatgagtgatttcaactactgctgaatttttggaggattgatccttccttgggccatcctaaagcaccttactgcactggaagggaaacggggacaaaggagaggtggaggagctgattgccaaacttggttttacaggttcggcaatgcttgcattgggtaggtttgttttgatagcaagcacagcttgtagttccctgctcctaatctgtaggggtgtgtatgtgtttgggc

SEQ ID NO: 90120 - DNA, 1019 bp, Homo sapiens
tcctttggaagtacttcagtcaaaacgatgacactgttattttcttaaaaattaacactaattcctatttttcagcaattacctagtcagtgatcaaatttccattaatcttacatttttggtttgaattatgatccaaatgtggtccaaacctagtaattgcattttttatgtcttttaaatttcttttaattttaggtttcccgcctctccagctcttcttccctctcctcttccaccctccccctctccctctctttccttgcaatttacttgttgaaaaaaccaggttatttgtcctgtagagtttctcacagggtgagtttttgtgactgcatctctgtggtggttacattgaaattttggacatatatgttgataggctttttaatttttttgagttttgcttaatgtttactactttgatgtggagaggtaagttggatcttcttttgctggatttagagcagaggtccaaaactggtgccgtgggacacatgtggctcacaggtgtgttttgtttggtaggcacaattggaaatactttaaagttaattgccatgagttagacattgtaaagttcccttaagaatcaagatttcttctttttttaaattctgttttaaaaaatcagagtatctgggcaccccagcttctgtggcaatgcctctggtgagtggtggggctccttcagagggcgcatgcccgcacctggtgcgagcacactcctcatacaggcttcctgcctggtcccagaggcctgctgggtttgtgaaccctgacttagaggaacagagattacctttatttgtgtggtgtctctgaaattcaatgcattttttgcctcatgttttctccaagctggtatttgagctgtttcactgtctaagaattgatgtttattcagagagtggtcagagtgccagctgaagttcctgctgtgcttcatacctctgtcttaagcctgactccatgcattgcatgaatttgttctcatgtgcctctcccttggactgtgg

SEQ ID NO: 90121 - DNA, 1046 bp, Homo sapiens
tgtaatgttttaaaacctggcatttggatatcatttaaaaacaataataattttaataccattgcattttagggtttagtaatcttatttgttatactaatgcatactttgaaattagagttgaggttttaatttttttggtagatgttaagcctgcctgaacctttacttgctgctgacaacctttgataaaaagtgtgggtggggtcaggttctgtaccctttgactccaggagaatatttagtttatcatgattaagagaacaggaaaagtaaacacgttaccagttgcatgttctagtataggctaaattcttattccctagtggttattacatgaaaatgtagtttgaatgactccaaacaatcaataaactaacattgcattaagaaatctagctcattttatactgttaaaaattgtcaacaagtggtactattaaaagtgaggtgtttcaattttaagcagtccttcagtggcatttgtgggtggtgagaactctcattgagagcatgtgggtgccttcacatagtgcagtggtgagtgacggggatgtgctatagtgttgcaagaaattagaggttttttggagtaattttaatagtaccaccgttctgtatttaccaaatactttacattttttaaaccatttcagtattgaaattataatcactaaaccaaatctttgaaaaattcatgattaaaattaaaattcttaatgttactcttgcctcttttagtgactgaattgaaaaaagttactggtagtaaatgttggccagtgttctacatatgaatctatgataagaatttttacaatctggaggaaaactataaagatttgaaatccaaatactgtactagtatatagtgaactgtgtcagagactgggtcagaggtgttagatctgaattgctgaccactggatttctttctgggctcccaaggggaatactcaaatgcatgcctaatatatgttatataagtggaggaagatggaagaaaaactaatttttttttttttgagacggagtttcactcttgt

SEQ ID NO: 90122 - DNA, 2712 bp, Homo sapiens
ctccttttctgacgtcgctgacttctgaaactggcagtgtgctggtagaggtagactctgtctattatagcttaaatataaagctataaacacatgtagtttttcttctctaaattctttagcaagacacctgtggtcctcagctggcacagaatacctggttgccttggtgcttgcttaccttgggccacccttgtgctgttttccagttttgcagctctttttgcggcttgctctttcacctgcttgcagacctgtgtgaacaactcaacctgtgaatatttcctgcaaaaacgttttcatcttgcccatttggctctgggcccttaaggtgtttgttttcgtgagcaaggcctttttcactggtgtgttcggatttgaaagaaatatgttcaattagttttcagctgtggaaagttctagtttagggacacttttaaataaaagctcgtcggttatagtgtggtagaggcagcatgcatttcgaccccatgagcggagcttctgcaaatgtaaaatgcctttttctccaagtgctctaaaaaatatacatttaaagtttattattagcagagagtagaaatctttttccctattctaagaaaagttgttgcactttggatggtaaaattgtaattgtaacttttttttcttacccctatagggtacctttaccaaagtaaatcattttggcttccagtgattaataacatagcttttaaaaagacaaaatgaaacacctaattcaggccagtaaactgacatttccaagataagggaaaagcactaagtaacttggaagctaagtaacttggtgaagatttttgtcatctagtaaatgggtatcctttcgtgctcaacccatgctgttatgatagtattctctccttactccgtttctttagataaaagcaaaacctttatttctttgtgcatctttgggtagtcacagaaacccctaattagcaagcaaataaaaaaaatttagcttctttttgctaaagtaaagagcctctgacaccttaactaggtactgttgagtggattggtctgaggcagagatgtgacatcttgttaagtttgtaactttccctagtaaatccatttcagaaaaaatttcagtttatgactgcacttgcattttgcatgtggaaaacccgtgccaccagagtgaaggatttccttaggagttgaaacaaaacaaaacaaaacaaaacaaaaaaacgatctttccacctctttgaaaattgcttccttttaaggataatgaaccaaatgcaaattaccttcttttcacatggtgattgcaataaggggagaatggaggctcttgttgaatccaagtctttctaaactaaggaaaaaggaaaattttgtgtttaattcctgtgtaatgtttacagagccgactgtgatgttctggagtcaaaaacaagatttatatggaaatgttgatttgttgaatttgtgagtctgctttgtgggaagtacataggatagagagaacagtccttaagacaacttgtagctactttaaaaaattacataaatatgacagagggtgatttagtactatgtggtgggatccgtatcaagggtttgcatgcctataatggtatggagtgtatcagatggccctgtcattcagtgagaagactgctgcagaaaaaacacaggtaaaaataattgtcttgcaacctcaaaaagtttgggaaaatgtttaaaaaatgtaatcatttccatagcttaaaaaaatctccactcacctgttaaatgaaaactcttttcagccttaggtcagtgtgtacttttggagattctgttgtgtttgcagctaaaatgtttctgaatttattcacaaagatatttctttggaaatgcaacagacagaggatgcatagagagatgggaagagttagctatattgagtatgttctcatttgtgtctttggcttaagtaatatttgtcaaaatctcttgaacatactaaatatttgtcttaatttcaagatcttgcttgaaatgtaaccacactgatatgcttactttcccttggctatgctttgatggctaaaattaaggactaataacgaaatgactaattctacccacccaaattaatcttgttcagaattagtgatatcttcaagtttctgtaactggtggttgactgactcagttaagagcgggttttgcctgagcattaaaatcatcttaccatttatgtatcatttcatcattagctatattgttcctcccctcccccaacccaatcttctcttttgcagccttgctctttctttgggaaatagaaaactaaaaccctgggaatgaaatatatagttagtgactaatttcatcttggcttaaatggatatgattcatctagtttttataatcttccggctgttctcagacctgtgtctctttgccccttgggttccatacttgtctttgtatttctgtttctattagaaatgatagtagtgcccccagaatactggaggttgaaaactggcagttctaagggatggatactagtggtctacagatttatattgtttgatcagtggtgtgtttaatttttaaaaattaattgtcagtatgaaataataagattatttccagtgtctcttgaaaagaagcacaaaatctggcaacaccaggcccacattcctgcatgaagtgaagcagcagctgcctccgtagatg

SEQ ID NO: 90123 - DNA, 1071 bp, Homo sapiens
ttttcttattgggttgttattgagttgtgaaagttctttttatatgctggatattagtccttgttaggtatatgtatgtattgaaaaatattttatcctattctgtggtttcttatattcttatttatattatatattttattatatatttcttacatattatctaaagggtgttgttttgaaaagcagaagttaaaatttttttaaagcctaatttgtgaggtgttttttgcctactgtaaagtcacaaagatttttcttgagttttcttctagaagctctgtagttttaagtctgtgatccatttttgactttaccttttccgtcactgtctatatttggatatcacttgtaatagatttctgttttagaaaggactcatccccttcccccaaccagtaaggactctcttttagaatatttttgttaaagtgctcgttgtttttgtctctcacattaaaacacccttctcattggtgtcctgcatatcatgtctgccttctccaatctatttccataatgccataatgtcataggttattactttaaaattactccaatcattcgtgttactaccctgctgaaaaatcctcaataactgtcaatttcccaagagttgcctaaatctaggtgatgtcacttgttggaatctccatgtcataccatatgacaaggagagagtgaatcagccagttttctatgtaaagaattaatcaatccctaacttggaggacttagccataacttctgttattatatttactgcattctattgtcattattttgttagattgaactctttttaatgtattacctttgatattcttcccagcacctcctagaccattgtgatacaggagactttttttgagggaatagttgaggaaccttggcagttaaaaagacagcgctggaaatcattgacttgaagggcagactgggcagccagtaaattttgggtgctatgttgtttttaaaaatcattttatacttagaggggctaacttaaagagaataatctggaagactaaatatagcctttagtttaattaggaaatagcttctgttgaa

SEQ ID NO: 90124 - DNA, 1030 bp, Homo sapiens
gaatgtcatctgtatcatcatcctcactgaagtaactgacagtcagaaacaacttgtgactaaataggtactaattgatatgattgtctgtttaaattactcagtaattgattcagcttttcattacgtagtacagaatttaattatggtagaaacagatactgtcttttgtggctggagctatgcagattacagggttctgtctcgtattcaatttgtcgggtcatgatttctcatcatatcaattctttaatgtagctaaataatactcttcttttggttttaagtttcgattaattccagaggtgttttgggacttgctgaagtatcatcaggccatgtgttctgttttttttgagttaaagcttggctgaggcaggctggtagattgagagctctctgggctggaggtcaggaagcccagcctctggttttagttctgccagtagccaactgtccacatgaatattttggccctcagttccctaatttataaaataatagagttgaatgaaatggtctcaaatgttagtctttttttaacagtgtataattatgtaattctgggcaagaaccagtcattttgcgcttgtgggaatttttataggttgtatgcgtatgtggtatatatgatagttgtccagttaccattacgcttttcaagaaggaatagtcgagtttgttttacttaactgaacattaaaacatctgaaggattcagaagtggtctagtttatttcagtttttgtttgttttcatttttgttagtggctgcaataagaaatactgtacatgatttattgggcatattgatttaaaaattggcagtattatttaagtggataataaagttttgtcttaaggatacttatttggccttctcacagtttgaaggttctcaacctttttcttctttggaagtcatttgagaattttatgattgacttggcctcatgtgtcctactttagcacatcagttttacttaaggttcatatcattcttcattgacattagatatgcatcagtttt

SEQ ID NO: 90125 - DNA, 1016 bp, Homo sapiens
taggcacacctcacctatttagtgtttggttgtcagtcagcgatcacttgcaagcacaaccttgggccaggaggctagcgaaaaaagacctctaagcagcccaaacagacactacagaatttcaataaaacacgtgggaggaggtatcaaaagtagcattcataaagtaggagccagcagtctgggacctcagtagtatccatggatgttttatgaatatcatttattatactctaatataaccccataatgatgatgacctaaggccatcaagaaaaggtacttgctatttatttgatttttgaccaggcaggacaagttatgacatattcaaaagtattgaagtaaaacatattgccaaaagaataaattcttgggcatctataaagctcagtaatctagaataccacatgactcccaagtttaggaaagccaatatattaatattattgttagcagctatcaggatttaaaatgttttataaaaagtcacagcatttaagtggaacaaatgaaggtacccaccatgattcctggtggtggcatgcatgctggtggtggtatgtggtaggaagaaactgtggatagaaagattagttatgtggctcttgccgttagttgagtgggagttaaggtcatgaatctgagtctggggactgagaggaagggatggatacaagagatgctatgatgattcttgaggatgaagtggttaactggatatacatggcaaagagggagggagtatttaaaagtgaccccaggttttgcagctcatgagtctgggagaatgttgtttactactgcagaaatgggacaggcagctgattttgcagggaggaagactggctttgttttcggtgtgctgagttgaggagctggcgacagacctggccggagcttggacttaaaggcctggagcactaagaggctctttccgacagttcccaagacaagcaaagacaggcatgctttcattattgtcctagcaagcgcttaataattagtggttgatt

SEQ ID NO: 90126 - DNA, 1050 bp, Homo sapiens
ttctttgtcagagttatttataaagtcccaagcattggtaagggtagcatcaccatacttataggtcagtatttcttgatttttaagtgatatgttaataaatggaaattaggatttggatgagaaaatgggtcattgggggcacattgagcaaatattttctttttctttttctttttttttttttgagatggagtcttgctctgtttcccaggctggagtgtggtggtgcaatcccagctcactgcaacctctgcctcccgggttcaagtgattctcctgcctcagcctcccaagtagctgggactacaggcgcatgacaccatatccagctaattttttgtatttttagtagagacagggtttcaccatgttagccaggatggtcttgatctcctgacctcgtgattcacccactttggcctcccagagtgctgagattacaggcatgagccactgtgcctggcctaagtaaaccatttgttaattggttgtctaaatgtctgatctgtttcaagggttgtaagtgaaggaagtaagaccacatgtgtatggtaataaatggttttgttgctcactgctgtgtagcaagcacattcttgtagtctttccttatgaataaatagcctatgttagttttttcctctctattctagtttcaagaaggctaatacttgatcattttcaaaaataggttttggtcaggctgtgcaagatgcgtttagattgattttagtcgttcattttgaaaccaatgctgcttaacttttgtcggagcattgaagagttagtgactgatatactaagattttgccctgtggatggatggattactgaaaaaatactcatctgtattaccactataggttattaaaaatgcatatttaatgtttgatactttgttaggtcaacagtctctctctttgtgatgctgggtgtttgcataggcaaatctaatataactattcagtatcctctttggggaaggcactgtgcttggcaccccagaaatactaacatagctaaataaccctgcctgcctttgaagag

SEQ ID NO: 90127 - DNA, 1013 bp, Homo sapiens
aaaatatatatatatgtatatatataatataatatataattatatataatatatattttataatatatatatataatatctagtgcttttgtgtttaatgtaaaccagaatcacattataaataagacaaataaatgctgatatttcaggtaacctgtgtaagaatgtttttatatctcatttagagaattaagtgtaaaataatggggtggattgcagtccttagtgccttggtttgggtgttgtttttgaaatgacaaaatctctctagggtgccaggagcattacaatggaatatgctttcatatttttgaattggtaatttaacttgttatccaagttcagtgtgattcagattgctgtgtgatgtaattatttgtcaagtgaatgagtaagggaataactttggaaaacagttaagagaaaatttgagaacagtatctagaaaatcattttgaaatactggccacatttgaattaccaggtaaaaaccattgcctgatgatgagatatcatttaggagagttggtttctcttccttttagagaagaagcaatgggtagagagtttcggttgatagggcttagaaaattctctcaacctaatagacaaatggaggttctaaatgtgtaaggcagcactcctgcagggaaaagtagggaagaggacccttgtccttcagattcacatgtagaattaatgtgatattagaagtatacttgtctggttttaaaattattcatatgtttacaaatgtgaggagatgaggagatattaaataccattgggcttttatatttataatttatcatttttattgtgcttttgtatgtatttatatcaaagtggttttatgggttgaaagcagtgagtcaattgcctacgctctgctttgttcagaataaaatgcctaactaggatcaaagtgcagcacatttctttctgtatagagatgttgatattttaaatcaacttttaaattattaactttttctttattttggaatactttt

SEQ ID NO: 90128 - DNA, 1428 bp, Homo sapiens
gttatttcagtttagaactatttaattttattttctctaaagttttataatccagttttaaacaaatggcaaagatacctagtttgcttatcgtctcataacaaaagaagcgtgtttttgtgaagcagtgctcatttgtataattagactattaccattttaaatgcatcccatgtacttccatcttccttcctcctgtcttctcatctcttcccccttctttctccagctgtgttggaattagccgttgttgttctcactgtccagcaaggagagatggggagagggagggaggaaagagaggactcttctgtcttttctttgtgccaggcactaggctccatgtggattgccaggacctcagcaaatggaaacgtgttcctcatgtgttcttggtggaactctggaaaatttttcccaggaaaccttaaagaagtttggttgggatctgtacttctgttattagtactttaaaatacttgcgggtttgatctgtataatgttatctttaataaaataacttctagggctcaagggaggaacttacagctgcattttaaagttgtaaaatgttgttttaatattggtaagggcccttgtaaggtagttgacaagaagcgaatattaatattaactgcagttttctaaaataattgtgctaccagttatttgacattttctttgaaagcattctttagtttaaccttgaattctagtcttcaacaacaaacgactcttagttcagagacttaagatttggaaaagaccagactctcacaccatcccacccatgtccgtaggcatttccaacatctgtagtgtctgatgtgacagtttttccttataagtgagctgaagtctgtttcctctagctttgactcattgacccgaatttttctatctggtaaaacgcaagaaaattcgactccctttcctatttaataacctctcaatattgttgagttaccaggatctgtgcccttgcactgccctgtctgctccttagcagtctattttcagcagaagtatccctggcaattccaacaattccttctgttgcttggttctcagatactttatctcatagatttttttgggtgctctgatttgttgacatccttgcagatctcatctgatcagcacagagtatgtgaccgttattttccttgctttagacattatgtccaaagtgaattagttacccatttatttgtgaggtcagccctaaaagaaaatatttttgctcttttgctccctcaacttgttgacatattttctaaacaatataattatttactgtatcaaattgatgctatagtgacaacaataatgcacatagtaataactaacattttggcaacttttaccatttggcaagcactgttgaagatactttgtagtagccctgtgaagtaggtgctgataaca

SEQ ID NO: 90129 - DNA, 1014 bp, Homo sapiens
tttcttccccagcctgcagttgtttccatactcttatttttgggtcttttaactatattttaacaggtacctcatagcctatcattttaaaatcatagatcctacctctcccacatgctcttgccctcaacagaataccatctctcatatttatttatttatttttgagatggagtcttgctctgtcgcctaggctggagtgcagtggtgcgatcttggctcactgcaacctccgcctcccggattcaagagattctcttgcctcagtctcctgagtagctgggattacaggtgtgcgccaccacacccggctaatatttgtatttctagtggagacagggtttcattatgttggtcagactggtctcaaactcctgacctcatgatctgcctgcctcggcctcccaaagtgctaggattacaggcgtgagccactgtgcccagcccatctctcatttttaacctattgatgatagcctgtctggattttcctgttgtattcattgatttgctatgtcattacctcgaatcattttaaatgttgtataatttgcgtaatcttttttcttttcttttttttttgagacaagatctccctctgtcacccatgctggagggcagtggcacaatcatagttcactgcagcctcaagcttctgggctcaaggattcctcccacctcagcctcccatgtagctaggactataggcacgtgccaccacacctggccaattttttaatttaattttgtagagatggggtcttgctgtgttgtctgggctggcctcaatctcctggactcaagtggtcctcccgcctcagcctcccaaagtgtagaaattacaggcatgagtcactgtgcctggcccttattttattgcttatatatctttttccatctcatttaaccatttaagaaaaagaaatggtgagattctgaaattccaggtagaatttcataagtataaaactggtagctttgatatgcttttattggaacattatgaagatatat

SEQ ID NO: 90130 - DNA, 1138 bp, Homo sapiens
aatgatttgatttggaaatggtagtgttagtagtagtactagtaatagtaatagcagttaacatttattgagtgctttttctgtgccaggcatgtagaagtaggtaccatctttatacgtgttatacagatgagaaaactggatcttagatcagtgatctattcaagttatctcagctcctgagtggtggtgctgggctatgaatctggacactgaactcagaaccatacacctaaggactacgttctactgccttgtgtaattaggaacagaaacctggggtttggtaaaagaaaaagagatcagactgatcacagagaagcagtgaagtttctgccctaaagctttggtaaagataaatagggagaattaaccaaagttttagaactgtactcccattgcctctgtgaggagagaaaaccaagatgtgtggaggtggggctgaagccatgtgctttagcataaattggcactgtgttacctacaatattgggaagagcatttgagaaatacagggtggtcagtgcgttttctgcttcccacataaaagttggtctttagccctgagatcctggctgtgggaggagtcatttaaccaggaaggcattgaacatctggataaatatttagacataaaataagttttacataaaatacttacatgaagcaaagcacaatgaatttgtaagcatttcactgaaactgggagaggcagcctgaaaagtttgtagcagacaggcaatggaatctgattctactgtaccattaattgaagatgtgtacaaggtcagtgtaaaggtcttgttctttttctttatttgtgctattttaaatcagtatatacaatggcttttatatgttcagtttagatcttagtatctgtctcttgaccgtgtatttactcgatagctctgaattctctttctgtcggagagaattattccttatgttttcaggaataaaactcctgcattggaggagattactgatatcactaaacctgatggaataatctatgttctttccagcctgtctcctatgctaggttactgtacataccctccaggcagggacattttcctgcttttataaagtacttggctcaaatactaagtacagacatgcatcacttaatgac

SEQ ID NO: 90131 - DNA, 1111 bp, Homo sapiens
ggttctcttcttgcctaatgctgccgacctaatttatggcaatgatggcccattttcttattccctcatatagtacattttgaagacggagctcagaaacaaaatatcagccaggctatattaaattagtttgccctgttgactttttgggatagtttaagatgttctttaacatttattcccacttaaatagaagggagagaggctggtatcttcaaaagccttggcttgattccaattcagttattgtattctgtccacttccattctttgagctctgtggagctctttgccgtattctctgagctttaacttaactgcaagagtttaatgccaacactgtatttgtagatatttgctattctgagtggtaatcaactttactctgcacagctcctagtgcatagtaataagtatagagtaaaaggaccaaactgatgcttattttgttgatggtgaagtgtcatcataacttgggacttgggaacataattaacatctttgctgatgacttctgaaataattctttggttgccggtatgagaatgctgatggagaccaatactcctctcctccctctctctgctacttcatgtcaaataaacacatctaattctggagctcattcagacaacacacgcatgtcagttttgaaaactaaggacccatgaaaatgtctgtttttatttagtggctgtaattttgatgtcactcaccatgctctaaactaatggagctttgaatgggaggagtcacattcctcttgtcatttctctggagtggtgaggatgatgacaccagaactggcaggatatttgacagtgacctctgtaaaagcagggcacacccattcctccctggtgatgtcttttggacgtataattaataagaaaaccttggggaaaggctgactttctaaatagctgtttttttcccctaattttaaactttgtcagaatgcatatttatactcctcatattgtgtgtgtgtgtgtgtgtgtctggaagtgcaacaaaggggagatattatctgatacatgtgataaatatgtgcatgttcagatgtactatttcattcaattcaaagtttttcataggcaaataccagtgt

SEQ ID NO: 90132 - DNA, 1296 bp, Homo sapiens
attacagacatgagccaccacacccagcctaattctgccttaatacttaaaatcaaagctagtggagtaatttaaggagagtcttgcttagtttctctaagtaaagggccacttttattcaattttttttccctttaaatggaaatggtacatcagattgattatttttttctttgcattgatgttgtttgagtttgatattatttcttctgtggcatcattaataattcctcctcccttctcctctttctcctctttgtacaaagtgtggctgttacttcttggtcagttctctttctatccatgttttctgccttgggggttgcatatactctcaggcttcattttcacctttcatcttgatgttaatcattccccagtctttccctattccttctttgacttcttgagaccagttccacttaagctgccagctggataacttcttggttttccctattcacacatttaaccaaatacatgtaaaacagagttcagtgtctttcttactcaaccaattctttctcatggatttctttttttgctgatagcaacaccacctcattggttttccagacacacaactcttggctgattctgtcagctcttcttttacatgagtttctgtcttttatcccttcctttttcttctcactgtgactgttgtcttctacctgagccatttgcttccattgtgcagcctcccaagcaagcacaattttgctcagagcctgcggttctctagttcaaggtactcaagccctcatatttggtttcagcccactggtatgtgagtcatttgaggatgaggctctatctctgagctgctcatgtgtgggcctccaacctgtggtggcaagttaactatttgctacttttccacaatgagatgtgtacagaagttaagactaatattttagtaacatataatgatttgacattgccacaatatccaactgcattacgagttgattcttgctgtacagggaatcaactagttttttttattttgttttatttattattattattattattttttgagacggaatttcttgttgcccagactggagtgcagtggtgtgatctcggctcactgcaacctccgcttcccagatttaagcaattttcctgcctcagcctcccaagtaactgggattacaggcgcccatcaccatgaccggctaattttttgtatttttagtagagacagggtttcaccatgttggccaggttggtctcaaactcctgacctcaagtgatccaactgcttcggcctcccaaagtgctgggatt

SEQ ID NO: 90133 - DNA, 1030 bp, Homo sapiens
agtttaatttaacctaaagatagggtctcatgctgtcacccaggttggagtgcagtgatgagatcatagctcacttgtaaacctcgaactcctctactccagcagtcctcccactgtacccttttgagtagctgggactataggtgcatgccaccatgagcaactaattttttatgttttgtagaaatggagtctcgctttgttgcccaggctgatctcgaactcttgggcacaagtgatcctcccataggcgtgagccactgtgctctgcctcttccttactttttctttatttcttctccctatcacaattcatcttgcttctagagaaaagcgaatccacacattctttcgatttatgcccttggtactttggtattttatttgaggttttatttattctttgtaatcaatttgagtttagaaccacatttgaggacaaattcaaccaattacttttatgttcttgcatttaggaaccgcttagaaaatgtgcctgagtgggtatgtgaaagccgaaagctagaagttttggatattggccataatcaaatatgtgaacttcctgcccggtgagtattacagatcaaatgagaggatctcacaataaatgagcaattttaaaaattgctgattcagtgtttaacttggtatcataagcctaaaagagtttgctttaaaaactaatatggtgtcttttaccccatgtggtgtcttcaagttacacacttgcttcatgcagtgcagtgaggagtagagtgaggctttgactgtcagccagacttttcaaaaccatgcaggcagtggtgcttggtggaaatttttaagtaagccaaaaacaatctttgaagcaaacaatatgattggcccacttctggaatcttaagtctttcagaatcttccacctctgttcattgacttaacatgtctactttaaccataaataccttttgttctccctagactttaactttgacgggggaaaaagatggttaggtcatgaaacctagaaagagcaaactagattctc

SEQ ID NO: 90134 - DNA, 1033 bp, Homo sapiens
acaggattatgtgaagggggtgggataaatttgattagctgtttttttaaacctatttttgtattagttcacttgttagaagataagaaaaatcatattttctaatgatttccaccaaattattgcctttaaaggttaatacttagcctctttgcacaacctcaataatggaaatttttacctacctatttttaaaaattttattacttttttttattgaggcataatttaaactcaggaaaattgacaaatatcgtgtatttggtttgatgagtttgagggggaaatgaataaactagtactgacagttgttgaagtaggccaacccggaaaacatgaaatttaaaatattaaagacagtttttaggaaagattctttgtgactggcttcttgcaggtggtttcagttgtgatttgtttttgttcacatggttcaatgtagcagacatctcaatgagtttaaatcactgtgctggatgcataggacattgagaaatgactaaacataggaattatcctcaagaagcttacaatcgaatgaagagtttaaactaactgcacaataaactatagtgaaaggtaggtttaagaaggtagaatagacggaaaattacacggttggtctagtataatttaggctcatggtataatgagcaacattttgttgttggatgatacaaagctgtgtgtttggcaaatagctgcaggcattggtgagactttgcttcagttgcccttccattcagtttgctacttaatacaaatcttaaaaatatggaaattccttttttatatttttttgtgataataaattatggttacagttctgtgtttcgttatataactgaggaaagggctttatatgtttcagtggttcgtgttctgaagtagaacttgcactaccaagtgtcaagagaaatatcagagaagcatgtgttgttggacacagagcagaagaccatattttgactcatgagagttttcctttgctctgaattttgcctgctaaagccagtctcatagttttaattac

SEQ ID NO: 90135 - DNA, 1029 bp, Homo sapiens
tccccagctttgcaatgtgcatttaactacatttcacaatcaccgtggaggatttttttttttttgggcaattttacttatcttagttataaaaccattctttatattttatccacgtttctttttctttcttttcttttttttttttttttttttttttttttgagatggaatctcgctctgtcgcccaggctggagtacagtggtgcgatctccgctcactgcaagctctgcctcctgggttcacgccattctcctgcctcagcctcccgagtagctgggactgcaggcgcccgccaccacacccggctaattttttgtatgtttagtagaaacagggtttcaccatgttagccaggatggtctcgatctcctgaccttgtgatccgcctgcctcggcctcccaaagtgctgggattacaggcgtgagccaccacgcctggcctttatcctcttttcactctagcatctgaaaagtgtggcagcaatatattatcttgtttgtttgttttaatgtaaaatttatttaagtacaatataaatacagaaaagaggccagatcataagtgtagcccttgatgcttcgtctcaaagtgagcacacttgtgtaaccagcacctggactaagaaacagaacattacaatatttgaaacgttacacgccgtctcctggatactgcctcctttccctccccacctaagagttactgccatcctgacttctgttactacagagtaattttgcctgactttgaactttatatagttatgggatcatgcagtgggtctcctcttgtatctggcttcttctggtcattatgtgtttgtgagattcatcctgttgatacatgttgttttagttctttattctcattgctacatcatattatgttgttttaatagagagcaaattatctcctgcacttgtgaaagccagtaaaatgtgctttggactttatactgaagaggactcaagtcactatgtgatttagttgcattgtgatctaatacctgttttattactataag

SEQ ID NO: 90136 - DNA, 1110 bp, Homo sapiens
agactagttttttttttttttgagttggagtctctctcgctctgttgcccaggctggagtgcagtggcacgatctttgttcaccgcaagttccgcctcccaggttcacgccattctcccacctcagcctcccaagtagctgggactacaggtgcccgccaccacgcccggctatttttttgtatttttagtagagacagggtttcactgtgttagccaggatggtctcaacctcctgacctcgtgatccgcccgcctcgtcctcccaaagtgctgggattacaggcgtgagccaccgcgcctggccaacccagactagttttgtgtgtgtttgtttttaactctggtttcagcagatctttctaaattcaaagccatgcccattctaacaaaatattgcatacattttatggaatagcttatgtatctataaagatgaacaattagtccttcatgaactcatgcattttagaaggcatctctttagagaggcttctggagaaaggagcaccatgactcagtcctcagaagaagtgatctgtgaggtggttactgtggtgctcttcagatcctgagggcaaagggaagtgcactcacgcacccagaaatctgggagatgcctggaatcacttgtaaatttcttttcaagtctctttttcagtctaaaaatcatgctcattttatgttctactttttatcatttctcttttttttaatgtaaaaataatggctctttcccttctcaatctgagtaaaactaaagcccccagatgcatgtgccaggcatcctgtaactttgtagtataccattgagtacccccaagggcacacataattaattttttttttttttttttttttgagacggagtcttgctgtcgcccaggctcgagtgcaatggcgcgatcttggctcactgcaagctctgcctcccgggttcacgccattctcctgcctcagcctcccgagtagctgggactacaggtgcccaccacctcacccagctaattttttgtatttttttttagtagagacggggttttgccatgttagccaggatggtctcgatctcctgacctcatgatccacccgcctcggcctcccaaagtgc

SEQ ID NO: 90137 - DNA, 1049 bp, Homo sapiens
tttcccagtgttttagttttctattttggctggatgtggagattgtggttaataactgcttattgaatgtatgtgtagatatggattcataatcttctcttatttcccatgcctctttttccccttctgtcactgacatttaaaaataaactcatcagaagagaagcatgtaggaaggcatgtgtgaagcataatttgtgctcatccttctctgcttatcaaaattggctgttggaaattagctggagtcagtttacctgcccttaatctgtctggagtcatgaagaaagagacaaaactgagttaggaaaatcttgaaataagcactgggctgggcctggagcaggaggatgagtggactcagcacagaagtgtggttgccttgcaggttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggtaaaactcagagttcctgcttacctgctgtgtgttttcttgctctttgagtgtttatcctctgtttagaaaagcaggtgcccaatggtctccaagccatgttttttgactatgagtaccaagatgcattcaggcaagtttggtgttgcccaggcatcaggaatggtgctccggtttgagacatactgatgttcagacaactttgtagaaggctcagacaatgacaaggaattagtttctctgagaactggacctcactggcctgtgttgattgcagattttcatcagattgtttgcaatgccatttctcctcccaaatcatgtgagctgtaggggctttttagactttctgttgtggggacctctctttgaaatggaccgtttctatcctagtttcttggcccttatgaaatactatcactggtttgagatagtgcaaacctttgtgaaatcaagatggtcagat

SEQ ID NO: 90138 - DNA, 1050 bp, Homo sapiens
cgggctaataggtagtgcagccaggacctgacctcaggttgtgagactcccttcaaaggatgttgtaactagcaggcacatcagctttcctgtttttaccacccttttgttctagaaaaacagcaagcatgtatcatatgcacacacatacacatgtgcatacagaccacagcacaaacacatcccttcacaacccccaaaaggtctgctttttatgcaccctcaagcactgggtaagaattaaaaactgagaaccccagtctcggattacttgctatactttttacaaatcactgtgcctgtgaaagggagaaagtagagatgccttggaagggtctagagccaaatatctgaaagttggagtttaggaacctaaactataggcccttctccagggtcttttgtatgtctcttattttccctatctgttaagagggtacgggttgtgtggtgagcttttggtccttaggggaactggtctttgtgcgggatttcctaatgcatgcaagtaggcagccctggtttccattgctcttcttgccagttgcttaccttacacacgtgataggagcagacagtacctgagggtctgcccttgtaaaacgggaggctgtttttcttaactttcttgctcctgtaccactcaggaacagcaggggcctgggcagtgttaccatttgtggggcttgccatagttgttcatgaggccatgggagcaataatggtcttttgtccgtctctgccatttctctcccttgataatctgccagaacaagtagctttgtaagaggggtttttgatttttgattttcagaatttgcaggtgctttctgtatttggtaggtctgtggattctcatgattaaaaagataaatcacaagcacttggtatttgattactagaatgtcctttctatgagttttctagaatagatggtgctggtccagaaagtctttactatatagggcaggaacatgaacactccaatacttcaaggctgctaccagcaaacacccttataagggggagagggttgtcaggtttttctaa

SEQ ID NO: 90139 - DNA, 1124 bp, Homo sapiens
tctgcaaacccttgttcttccaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcag

SEQ ID NO: 90140 - DNA, 1004 bp, Homo sapiens
gctataattatggtgaccacattttccatggcaaaaattaagacacgtcgtctgacaaaggattcttgtgccacttctaggtgtgagaccacccatacttagattttttttaaagcaggcttttttaggcaggccctataaaaatagaggtttgttaaataggtgtgtttttagacttttcattaaaagcctacaatacaaacagtattttattttgtatctgaatcaacatgttatatcctaaagcactattttacagcctaagggtgtgtgttagtctattcataaaaacatactgctgcatagagcaataatacctgccattatctaggtgtaataaaaaggtcccaagtggtcctctccaggtctttaattttccttttgaagataaagctccttctttcactttcatggttcaagatttttggaccttgcaagtgattgctattgaagtgtgccagatgtgagcagttgtgagcatagtactttaaaagaaggtgaaggagtgactttttcttccttattgtctcccctactaccatctgtagtttctacacatgtaacttttccaaaacagcaaggcatgggaagggataccagccagggccgccacagtccaggcatgggacttctgaagtgaggagatagagatgaaagcggcctgtattgataaatgacagatgatgaaaccaaggcctgctggaccaagattcaatgacttacccaaagctacacagcttgttggtggcagagttagctcccaatccccagctttgtgagcaagggaggtttccatccccactatgatgttttcttggtgttctggggtcactctggtcgatttccatccactgtgatgttgggtatgccccctccatgtgactacataattctagaatcataattctaaaatgatatatcactgcactatcatgggaaaataagctggaagagctggagaggcgatgcctgccaccactggctcttctatagaggtgaccttg

SEQ ID NO: 90141 - DNA, 1651 bp, Homo sapiens
aatttttgtatttttaatagagacgaggtctcactatgttggacaggctggtctcgaactcctgacctcaagtgatccacctgctgtggtctcccaaagtgctgggattacaggcgtgagccactgcacccggccgcgaaacttctagaaatcttgagagtgactcttccaatattttgtatttcaagtagaagttttcagtaataatgaagttgaaagccagaagagaggagcagataatgttctcatgaagcctcagaagacattaggagcatctatctcgatattagattgaattgaaaatttgtcatattagtcccttgacttattcatattttttctcttgagccattggtttgtgttctgtaaacacagcctaagaggctattttaaaggaaatggagatcaggtgttctccatagattcccatgctcgatttcccggagtgggagcaggagagaattatgagcaaagagtttcagccctcaccctgggacattacccctcctccctgcacagacttcacagtgggatgctggtgaattttttaatgttaatttttatttttaaatttaacttttattttaagttcagcggtacatgtgcaggtttgttacacagataaacttgtgtcatggggctttgttgtacagattattttgtcacccaggttttaagcccagtactcattagttatttttcctgatcctctccctcctcccacccttcatcctctgataggtcctagtgtgtgttgttcccctgtatatgtccatgtgttctcatcagttagctcccactaataagtaagaacatgcagtatttggttttctgttcctgatgttagtttacttaggataatggcctccagctccatccatgttcctgcaaaagacatgatctaattcttttttatggctgtatagtaagtattcattccatggtgtatatgtaccaaattttctttatccagtctatcactgatgggcattgaggttgtttctgtgtctttgctattgtgagtagtgcagatgctgatgaatttgcacttcatattcagtgattttcgccttgaagaacataccttacccaatccatgttacttgaagacgaccgtaactgaggtgtaggaatttgtcctaaattactgtaaacaactttttggggcatttcacaatattccagcgcctctccgttccctttcattgtcttctccacctgatccctctttcaaactcttgtctttatttttatacatcttaccccaaacccagattgcagtaagattcctatgtgcattgccacatgcattttcagcaatttgaaattttatctaatatcaattaagctggtataaatcataccacttcacatacgtgaagttgtttgctacagccctgttctggagaacggtgagaatgccctccttgttttgtggcaggggtgaggggggatgttttaatgaggagagactggtaataagggattgtggtgaactggcaggggaggaaattcaataaacagaagagaggaactcaggatagttgggcactggagtgttgcaaataaagcaatatgtgatgctctccccatggaatgctcacctacgctatactcagaatccctgacagccgttttgcactctccaaca

SEQ ID NO: 90142 - DNA, 1032 bp, Homo sapiens
gggtcagcagggacagagagaaatagcatctgtcagctgggttgaagtctcccgcatatggagtcagtcactggttctttgctgagggttcagctaatgagacttgattgcttgtggcactcttgtttccaccaaaaagagcctaaaaacaggatgaacttgaaaacaagaggaagtggtgctatgcttccccatgactttagctccagtttgcctttgagcaagggggaagcagaaggaggaacttcttacgtacctgcacggtggttcataccaggggttcatcaaccctgggatcttgcccccttctctgcctcctgtcataaatctctgtttcaaaggaaagaaaggggatggttgttaaagcataaacctccaggtcagctcttgttacattagaccccaagatgatgtccaaaaccttttgttgaactgaaatgctagcttggtttgaaataactgagccattcattgcctagggatagaaaatctttctgttgtaaagaggtggttggttggttggtgtgtggctttgtttgcaaatacagaaagtgggatggggattggaatagtattggccttgtgggggctgaatattgaaagcagcaaaactggatgtacctaaaaactaaagttgaatcggcgagttcatccatccttttagagctattttcattgagatataatttctttcagttgcttgaagttttcagcatcagatcaagttttctttcttgctctccaatacctcttttgcttgtttgccatctgttcatttccactgcaaactgctctttacacaatgttactcggtgttaattagaacacgtgtctctttgtcattcatctggagaaggggttaatgatgatttatgtccctttaattggttttcctccaaactgttaggtttaatttattattttataagaattccaagagactgggaaagaggaagagtgcctaatttttattcttcatgtctttaactatatatctcttttgctttaaaaaagagcaatcttggcctaact

SEQ ID NO: 90143 - DNA, 1031 bp, Homo sapiens
cactgtgtcaagtgaagctttaatttttcaggggaggttttctccattgagaccaatacatcttttcttgtgacagatccagttaccatatttccttatttttaactgtcgaaaagacagttaagctgcaacagagtatggtgagtttaccaattttaatacttgaagcaccaaacaaaggatcagtgttgcaggctgtctcttcttgactttttccagctctccttagcagataaccaggatgatattttttctgctttacaacatgatgaatgctatatctctatattaactctgaaattgaattgcagccaaatattcctctcagctgcattagaattttctaaaagaacatgagacacataaacttagtcttcttagttcaatgctatatctcagatatattgatatctgatttacaattaaaataggaataaaattaagtacaaattatatcatcagctttaaatattgatttatcttcttgaaaaaaaaaaagcgagtccataaaggatggcagcattggcatttctggatgtaaaatttcagggctatctcctagccatatcctttatggattcctgccagcatctttaaaaacacacacactgaagacacacagagaggttttgaggtattttataacaaaattataagaacagggagacaaagccacttactaaacattaaagtgatagtataagaagaaaatgatttgaagaagtcctaattgagggaaatgagcaattgtccacaaaacttaaccctgggttcccaggaaccggggtagtgatggtcatggagaggggttttagaatctggttatttaggaaaacatgcacactaacttgtttcattgaaaaaaacatttattgaggccctacaccatgcaaagctctatgctaggtgttttagttaagcgaaaaaatgtctaagataacttttgccttcaaggaacttaccaatcagtaggagaccaagacaaggatacaaatcactgtaatcctggacaatgtgtagtagacagagag

SEQ ID NO: 90144 - DNA, 1034 bp, Homo sapiens
agcgggggctcttcctttgagcaggggaaaaaaaagcttctgttttgttttggtttgaggttatattactgttctatttatcaagacacttctacgatgctagttacagaaattcacagtccattgtaacactggcatttgccttcggacttttttgggcttgtggtctgttcgtttaaatggagactgtaaaactttcaaaatgccaacaaagctgttttcacttaaaaacatatttttatagattgtcacttgttgttcttatatatgcccaattctgtatatgctatagcactatttctctgccctccatttgccagacaaaagatacacccatctgtccttcagtgtgaataaggattgaatgattattcctctctcttccaagccatgggactttctcataggtgccaccacccctgtgaccatcccctacctgccttatcattccaccggtgagggacctctcaggtgtagctccttgttaacttccaattagtgatgggtaggatttacctgaagaaaaccgtaatgcgcttagatactagcaaaagggagcagaagtggggagtctaatcaaagtgagaggataaccctcaccccaaacttgctgcaggcagctgggcaggtcaaaattctgtgaccagacactatccttttcctctagtgattataaactttaacctgtgcagagaaaagatagtatctgctggcaaaatttgtacttactttgattcctctagtgcaagattatagtggggttatacctgagacttcaataaatgtttgactaactaaactaaaatagcttagggtaaggactacttccccaaacgcccttttaaacatgtgagaaagggaatctccctgacatactggtatggccatttgtagcaatatactgagagtgacttgggtgattttctggggcgatcaaccacattccatgagcaggttaactgtggaagacacctgcccttgagcatcgcgtttgggccacatgcgtcaatggggaaatttgtgtttccattctg

SEQ ID NO: 90145 - DNA, 1031 bp, Homo sapiens
atgttggccaggctggtcttgaactcctgacctggtgatctgcccgccttggcctctcaaagtgctgggattacaggcgtgagccaccacgcccaaccccaaattatgttttgatttctgttacactcctgattttataacctccattttgcctcatccatcatatatttgttgggtactaatgatgagcttggtatcaggtgctggggatacaattatatatcaacaacttgttccttcctcatggcaattacttttcttgtttcttcaccttctcccatccttcatccctcagatggctctgctatatccttacaagtctcttagacaaagaggaaccattccccattttcttctttggcttggagcctctgaattttaggcttcaaatctttgtatgctaagcactgttctaagctggaaagactccaaggaaaaataggatccctgccctcgaatagtttataatctagtgagaaggatatatgccagagattacactgatctgagaatagcggtgattaagataccataaccaacactgaaaacaggtaccagtcacttgtgagtgctttacatgtattaactcaatgaaatcacaagctaaccccaagaatagtactacttatatttccatgttataaatgagggaacaggcactgaaagcttaaatacttggctcaaggtcacagctactcaatggtgaagccaggatgagaatcttgattctgatttttaggcatctagccccgtactaaatgtcttctagcagcacagaaggaatgttaagacggcccagaaacagcagggatggctttacagaggaagaaattcttcagccaaaactaaagaaatgaatttgtcaggtgaaaaagctgggtaccattcagggagaccggcagatgtgcaaaagcgaaagacgtgagagaccttggcatattccagaaaccacaaaaagtggatatagttgcaagaagggaaaaggaagagatgaggggtagggaggggggtggcaaaggattgggccagat

SEQ ID NO: 90146 - DNA, 1032 bp, Homo sapiens
atatttctcatttcttttagttcttagtaagtcagctttaaaaagtacctgccaaccagaaccttccatattctggactaaatcttgctcttcggattatacttcagtgcagtaactgtggatttgcaattttgaaggggagatagtagctattatattttacacttgcttgatgtgataactctaaagactttttaactgataaaagcgcacatggctattttgatacacaaagttgtgtttgctactttagaagcttttgtggcagaattgtaatctaattttcataccttgtatttctgaatcacaacaaaaaaataaatggggaacaagacttacagatttgcaaacttatttatctagaagtttgtgttttttaagagaccatttgggcaaaacataaatgttttctataatgttatcctgactttgcatcctaagcatttcaccaggcctgatttttatcattttttaggaagtaatatttgtggagtaaatacttggtattctgagctcttgtgtcaagtaggttctgttcgtatcactatgatgtgggatatacgagtaaaagtttaagaaatgtgaatttagcaaaatttcttaaacaagtacgttttctatacaaatatatttctcatactttaaacgaaaacctgatattccaaccatgtaatatctcccagatcctgatgggcagcaaattatacaagactgatatggaaaagaacatgcctcgatatttatcagttcgtaaacagaaaggttttggaacattgagaagagatttcttggacatcgtggtttgcaagcttaatctttctttacatgtgagcaatttatatacataaatggcatgtgatattatatctgtaatttttgtttggatatttaaaggacaaaattatgtgttttgtttgtttgtttgtttgtgatggagtcttgccctgtcgccaggctggagcgtagtggcatgatcttggctcactgcaacctccgactccctggttcaagcaattgtcctgcctcagcctc

SEQ ID NO: 90147 - DNA, 1107 bp, Homo sapiens
agtattgtactttatatttatgctacttcattgtgacttaattttccctgaagaaatatccatggatttgattataggttttcccttagatgctgtggaggtgttttgtaatattcaaaatatgcccatattgcctttttaaaaccccaaagattatgaattctgaaacacatccagcccagcgggttttggataaggggttgtaggcatttaagcagcctcacataatgggctgacttcatccaaaacatgaaaatattacaaggcaaattctattttttatattttttggttcaatgcttgaacaacttgtttttctgctgggggaagaaaaaaagaaccaaccctgagtgtgattgttacggaaactaatgactttgtttttaaaggatcacattgattcaacaccttctattggacccagaagtgcgtaaatattacctatggtagtaaacgtttaattatcattcagtttaaatgttggccttctgtatgtagccaagaacagctcattttgtgaatttcagtttttaagtggctgctttttgatttggttgtattattttattataatgtatttgcaagtatattaaaaaattaacattgagccataaaaatccccaaatatgttcaaggacttcataattgaaaaatatatagaaaacaatccttacttctttttacaaaaacaaaatcatgggaattattcttttctatatatttagttataaatctttctctgggccgggcgtggtggctcacgccagtaatcccagcactttgggaggctgagacaggcgaatcacgaggtcaggagttcgagaccagcctggccaacatggtgaaaccccgtctctactgaaaatacaaaaaattagctggacacggtggcaggcgcctgtgtgtggcgggcgccagctactcaggaggctgaggcaggagaatcgcttgaacccaggaggcagaggttgcagtgagccaagattgcgccactgcactccagcctaggtgacagtgcgagactctgtctcaaaaaaaaaaaaaaagaaaaaaaatctttatctggatctgttaaaccatatattattgatcattgcaagtgaaatt

SEQ ID NO: 90148 - DNA, 1387 bp, Homo sapiens
atcagtaatcacgggtctcaaccctgaggcagtagtttcaattttacttgtctttccagcctgagaataagctcattgagggcagggactgtgtctctcaccacagtgttcacagcacctagtatagggtctcgctttcatgctcagaacataaattgcaaaccaaaaaagccttgattgtagtttggctatttgagatgctgcagtgggtctttttaaagctattataaccctaagactgcaagcaatatatattttattctgcttatggtttgaatttattaattggacaaatattttgttatgtatctgggctgtccagcggtgcagagcacacacattctgttctcacagcttactgacatttacagagttttcattatattcatccttagagcagactagaagatttgtcttagaaactgtttgttagagacctaggtaccttgaaatagtcttgtaccgttggatgcactaaaagctctctctttatcttgcaggtggtcaccatgggccttttccgcactattgctttgttttaccttggaagttttgacagcatagttcgtcgctgcatgatgcagagagaaaaatctgaaaatgcagacaaaactgcctaatcttcttaccccttggaagaagactgtttccaaataatttgaacagcttgctgctaaatgggacccaatttttggcctatagacacttatgtattgttttcgaatacgtcagattggaccagtgctcttcaggaatgtggctgcaagcaaggggctagaagttcacctcctgacagtattattaatactatgcaaatatggaataggagaccatttgattttctaggctttgtggtagagaggtgaaggtatgagaattaatagcgtgtgaacaaagtaaagaacaggattccagaatgatcattaaatttgtttctatttattcttttttgcccccctagagattaagtccagaaatgtactttctggcacataaagaaatcttgaggactttgtttaaaccttccataaaaaaacaattttcggtttctcgggttctctctctctctctctctgtctctctgtctctctgtctctctgtctctctgtctctctgtctctctctctctctctctttctttctttgtgtattttattcaagatgagttggacccattgccagtgagtctgaatgtcactgacagccctgtgttgtgctcaggactcactctgctgctggtggaaactcatggcttctctctctctttgatcccataaagctacgagggggacgggagagggcagtgcaatgggaagtaaagagatattttccagtaggaaaagcaatgctttcttgtctttagactcaaatgcttagggaacgtttc

SEQ ID NO: 90149 - DNA, 1434 bp, Homo sapiens
acttgtattttctttgtgtattatttattactgcgagtgcgtgtggtagtagaggtgacaatgactcctagtacagtttggcaagaaccccgtggttcttgcccatgtctctgcagttttgcagaggcaaaactgtattttccatacaacacactgtggaaaagacaatgaatgtcttagtgttattaggacaatcatttgtccttgggggcccgcaggggtccgtggactcacttgttgagaactgccatctgccaaggccgtgcgtccatttctgagtgctgatcaatgctttgtgaccattttatctcacttaaagtgaacgagcacactccactgtttctgatgtgtccgactgatttctgtccacattactaggattccctctttctcttctttttcttctcttttagcaaggaaatttcaacagttcccttggctcagatgggtacatgctctcggccctgacctgtgggatggctccagtaacttctattactgaggggctccagcaggtaagctctgcctaggctagcaatcagacaggccgatggacaagagaaaaactgcctttcatcaaaccttgatgagaagaggttaagggaaaactaagtaactttatttgacaatgtatttttatggagctatcaacttttcctcttcctccaccaggaatgagtaaataggttaaagatataacttcaggaatttagaatggcaagaagtcttcagtgccgggccttgcagatagagaaataaaacaccgtatctgctgttgaggtgttaacctggattttcacctaagaaccactgctccaatgtgttttgaaaatggaatactcctctagagtaaggggtagccttgcttaaaaagtactgggatattagactagaaaaccttttctaggtgaatcaggtcacacacagctaaatttagtgagacacgaatcatggattaaacagttgcttcgcttatagaatgtattattttgtccaagatacacagtgtttcattggtgtgctaggcactgtacttgctcatggggaatcagatggaaggcgacctctccagcttcaggggcatacagtcaagtggaatgcactgaccaaaaaggtgatagtagtccgggcgcggtggctcacgcctgtaatcccagcactttgagaggctgaggtgggtagatcacttgagatcaggagtttgagaccagcctggccaagatggtgaaactgtttctactaaaaacacaaaaattagctgggcatggtggcggacgcctgtaatcccagctactcgggaggttgaggtaggagaattacttgaacccgggaggtggaggttgcagtgagccgagatcaagccactgcactccagcctaggctacaagggcaaaactctgtctcaaaaaaaaaaaaaaagatagtagtgcagtg

SEQ ID NO: 90150 - DNA, 1083 bp, Homo sapiens
tagggcagcagattttaatgaccccaatgtattttgtggatgaaatcaacacaagagtatcagaagcagtctgaaggaaaaacagatgtacagtctggtgaagaaaggaggggcagactggtcccattgccttgataaagggcttggatgctgtgcagtgcgtgtgggaactggactctttttaaaacactgccctcgtcggacggctcccagggcctctgtctgggcagcaggagtggaagacactgcaaaggaggtgacttgccatactttagggccagctgttttctggggtccaggttagggtgagctttttgcctacattctggaatcatcatggagaggggtttctcaatgcaattggtgtagttccccgcctaacagaatcaccccattgttctcaccgctttttgggaatcagggcagccagtgcaggttggcagtgtaggacctcagtgtgtcttgtttactgaaggtacacgtgttgttttgaaatgcaggtgaagccatataatgtctacatcacagttgcttacccaccagacacagacacacctggctttgccgaagaaaacagaacaaaggtcagtatcctacatgtcccaatttgaacctctaatgtttactgcttttctgattttctttctactcttcagctcacactcgttttcaccaatcaacaatgtttgttgggtagagtgcctagctggtttctgatgaccttgagattctccaggcaaatattccttctttccttcctcttttccctcactttattttcttaaagtttaaatttctaccagattttttctctatagagacagggcctcactctgccatccaggctggagtgcagtggtacaatcgtggctaactgcatcctcaaactctcaggctcaagcaatcctcctgcctcagccacctgagtagctgggcctacaggcatgtgccaccacacctagctaatttttaatttttttgtagagatggagtctcactatgtcgcccaggctggtgtcaaactcctggcctcaagtgatcctccctcctcagcctcccaggtgctgagattataggcatgag

SEQ ID NO: 90151 - DNA, 1038 bp, Homo sapiens
aaactgtctttcagaaagtactacccacaaacatgcagtatactttttataaggagaaaactaactttgaccagttttcaggaaaaacattaactgctgtcatggtcagaatgcaagactagactgaaacagtcttcaaatggtaggtcctgagtcttcaaatgctaggtctcaaatcacatttcatttatatcatcatgtcatcattcattcattcagcaagcctgttgggcttcccagtcacttgagcttgcattgaagaactgaaatccagaaagcagactaaattctccatgtgcacagccttgaggcttttgacctcatgtggcctctttgttccctgcagaggttaatgagcatcaattacctgggcagcgtgtaccccagccgggccgtgatcaccaccatgaaggagcgccgggtgggcaggatcgtgtttgtgtcctcccaggcaggacagttgggattattcggtttcacagcctactctgcatccaagtttgccataaggggattggcagaagctttgcagatggaggtaaaagttgtattcatttttgtatttattcctctccgctcagcaatatacattccgctttagttttatagcttctttacatgtgttgttgtattaaattagagatttttaggtttgacattggtgaaagagaattggctcaaccctgagttttgcagttaacatttttcattgcatgaagactatagttaacgacagatgcaaaatggtaatgggatttttgcttgtttaacttaatacacaaaatattagtgatatcttcatagtgttattagtctaatactgtgtgaatgtgagtaaggttaaccagatattttattttatagagatttttctttaacaagaagtttgtccttatgactgaataatacgtgaaattagtatatgtttgagggaagagcttgaatcagctgctaatttttagcttttagacaagtcatttaacttgctctcagtttcctcatctgtaaaatgggagggttggaataaagcaataattt

SEQ ID NO: 90152 - DNA, 1011 bp, Homo sapiens
attgctttttttctctcctttgcaataaacggacatgcatatagacggtcatcacgactaattattctgtattgctttcaggataagctgctgcaggcaaagaaagaaattgaaatgcactctattaatgacaaacaggtaaatctctgtcttcagaatgcattttctgtataactcagcacagctgtataaaggaaaaacagagttacttcacctgtgaatagttaattgaaagcatatatgtactgttttttaaaaggtggaattgtttgaatggtctagtaactcagaatatcacacacacgcaaaatgaatagactcccacacacattcatatctacaaatggtcaaataacagaatgttttactggcaaataatttcattttaattttttttttaatgaactttatacaaatgcttaagaggaaaggaatatttaaaatttatttggttatggaatttttgatgaataaaatgctatttatatttcagtataaaacataatagcaaattaataatcacacacccatcacccagcctaagaagtagaaatgatcagggtctctgaagcccccacagcagccttgtccctcttttcttgttcctagaggggcaaatgccaacccgatttttggtgttaatcctttctttttcttttcttttttctttcctttttttttttttttttttttttgaggcagtgtctcaatctgtcatccaggctggagtgcaggggtgcgatctcagctcactgcagcctcgacctcctgggctcaagcagtcctcccacctcagcctccctagtagctgagattatagacacgtgccatcatgcatggctaatttttgtatttttggtagagatggggtttcgccatgttgcccaggctggtcttcaactcctgggctcaagcagtccgcctacctctgcctcccaaagtgctggtattataggagtgagccactgtgccctgcctctttttctttttaattttaccatatatgcacat

SEQ ID NO: 90153 - DNA, 1047 bp, Homo sapiens
tgggtgcagtgcaccagcatggcacatgtatacatatgtaactaacctgcacaatgtgcacatgtaccctaaaacttagagtataataaaaaaaaaaaaaagaaaaaaaaaaagaaaataagattcatttggatttggaatcagaggcagactaatgtattatttatgagctagacttatagggcacttttccaccagtgaactcagaaaaatattataggtgtgcaatttatggttccataagaaaacagtcaaagcagcaggccttgctgatagtatctttcatgcttacacttactccagtcattaagtttgggatgaagaagttaacaacagctaatcatttagttcttgtagattcattttaagagcctgtcatagttgttttttataaaaacttcctacagaggggagatttcaagtgctaagaatattttatgattttgttttaggttacaggaggttccagtggcatcgggaagtgcattgctatcgagtgctataaacaaggagcttttataactctggttgcacgaaatgaggtaaggcttctaggttcattattactgacttgcttcttcgacttgaaattagtcaaagaggctgtgctaaacatcttagcattcacacctagaaagcgcttcttccttgatgtgagatgtgtttcctgaactactgattctctctagtatttaggccaaacacttctctgttgaaatcaggtcggccccacaagtatttatttagtaccattggcatattaggcaacatcatcatagatactgcagatcctgagatgggagaggccaaggtctagttgaaggagcacacctggccattggaagccagggagggcccttggccaggtcagaagtgctggaagcagtgattctggagctgatacctgaaggtgtgtaggtgtttctctataatttttcactacgatttgcttaggacatgatatatatctctagtgaaatctatacaccatagaggaacctcgtccctccttagaagtttagcaaaatgtgtttttctgtattaagt

SEQ ID NO: 90154 - DNA, 1801 bp, Homo sapiens
ctgggaggcagaggttgcaatgagccaagatcacgccactgcgctccagcctgagccaacagagtgagactccaactcaaaaaaaaaaaaaaagaatagggagtttatcgttagtatcttatggcagactgcaaatattcatatttaaacttaggttaaagttcatagcaataatgataatatgacggttttttattttgttaactctattattaatatcctccctacccttctttttccctgacagtcggatatgttgcggtcactatctaacacaaaacctacagtcaatgaacatgacttgttgaaattaaagaagtttacagaagattttggtcaagaaggctaagccaaagacaaggaagatgcttaccatatgtattctttctttcatagatatttttgtctatttggatcgcattaattgtttccagtaaaactcttttaccacagggaaatacacatctcacttcagagttccattaggttttatattgtacttttcctccattacttattaaatactcctattaacaaaaggtacaaaataacaggttatgaggaaatgagcgatatatgaacggcataaaaacagaaattacccagtaaaaaggatgtcagaaattgacatacaaatatttacaatttttatgaatggtggtctttgcaaagagcatttatattttcttttttttttactaaaatgatatagggtttattttatattttcaaaaaaattgttaaacatcattcttatcaatgtaaaatttacgttattaaaaaattacaaatgatagaatctttactcagggatgggcaataaaacagcaaagagctttgtgattgggtttgaaagattttgaattatagacagtgctcttaatagtttttaataagttgatatttttttctgtgtagatttaaataatttctttaaaagcgtaagctttggctgggcatggtggcttatgcctgtaatcccagcactttgggaggctacgatgggtggatcacctgaggtcaggagttcaagaccagtctggccaacatggtgaaatgccgtctctactaaaaatacaaaaattagctgggcatgatggcgagtgtctgtaatcccagctactcaggaggctgaggcgggagaatcacttgaacctgggaggcagaggttgcagtgagctgagatcgcgctactgcattccagcctgggcgccgagatagcgccattgcactccagcctgggcgactgaataaaactctgtctcaaaaaaaaacaaaaacggtaagcttttatatttaattaactgatacctttcactgtgcaatctcaagaggaagattttctaaattagacattgtctttaccttaaagaagaaaattgtctatttcagtgtcttttttagcaagattgaccaaaacaggtggtaggtgtgtaatttttaactgtcatgaaatactgtaatgcgcacctttgctaataaggaaatggtctccctttgaattatgggaagtttcttgtctgtgatatggggtgtctgtgtacatatatgtatatttccttttttaatacaggataataatatggggtcttgtccttcaccttttaagttcagggaacagtttgtcctgaccacacatatgttatcagtgtaatgctttatgaagctttagaaatgagctcatgactcattaaaaaataataaacgatgctattttaatattttcaaataaataatctgaggatgtgtttcatactttagcatcaacgctgagttgtgccttgtagaattgcattgtcta

SEQ ID NO: 90155 - DNA, 1038 bp, Homo sapiens
tgcagtgagctgacatcgtgccacttcactccagcctggtgacagagcaagacgccctttcaaaaaaaaaactaaaagcaaccaaaatctatcccattacccaggggataactactttttgttgtatattcttaattttttttccaaaagtaaacattctaataaaacatacaaaactattatacattttaactttcctggtaatggattaagtcttaatgttcaattttgtttcaaatacatatttcagattactgtttatttcaggttcgcggaccttcccgagctgatcctaaccatcttgtagatgatctgctaacaccttgctctccaggtgaccctggtgccattgaaatgacatggatggatgtccctggagataaacttttggagccagttgtttccatggtttgaaattttgtttgtttttaagaaaatattttaaaacattatacttcataattttcagttatataagatttgctggaaaatcttagtataaacaggtgtattttacttaatattgttgactcattaaaaattatgaagttaattgaacttaaaatataaaaagtcattatttttaaactattttcttgggtttagaggaacctttaagtgaaaaagctattttttaaagcacaagattctgactttacaggtcttatagctagaatatctccaaaatgctcatatatagtataattattgtaaagacctaactaaaaaatagggttggtgaaatattttttttcccctgcatctcagattttttaaaataaccagaagtcacctgtaatcccagcactttgggaggccaaggcgggcagaccacttgaggccaggagtttgaaactggcctggccaacatggtgaaatgccatctctcctaaaaatacaaaaattagccaggcagtgtggtgcacacctgcaatccagctactcagctgaggcaggagaatcacgtgaaccagggaggcagaggttgcagtgagccgagattgcacaaccgcaccccagcctgggcaacagagcgag

SEQ ID NO: 90156 - DNA, 2179 bp, Homo sapiens
tgcacctagggaccactcagaacagtctcacggaagcagactttcgggaacttgggaggaaaacagatggttattcaggggcagatataagtatcattgtacgtgatgcccttatgcagcctgttaggaaagtacagtcagctactcattttaaaaaggtaagtcatttttatctatcctttcctatcttttttttttttttttgagacagtctcactctgttgcccaggctggagtgcagtggcactatctgggcttgctgcaacctccgcctcccgggttcaagcaattctcatgccttagcctcctgagtagctggaattacaggcgtgtgccaccacgcctggctaattttttgtatttttagtagagacaggatttcaccatgttggccaggctggtctcgaactcctgactccaggtgatccacccacctcggcctcccaaaggcgtgagccactgcgcctggcccttttcctgtatttttaaaatcaagtttcaagaccgtcattggtttgtcttcaaagaatttgggaggatttcagtgttgtataataataccataagtgggtttacataatagacatatttctgtgtcactgaaacaagttctttaataaagtttatttattggccatttttggctgggtgcagtgccccatacctgtaatcccagcactttaggaggccgaggtgggcagatctcttgagctcaggagagaccagcctcaggcaacatggcaaaaccccatctctgtaaaaaatacaaaaattagctggatgtggtggcacactcctgtagtcccagctacttgggaggctgaagtgggagaatctcttgagcccaggaggtggaggttgcagtgagccgagattgcaccagtgtactccagcctgggtgacacagtgagaccctgtcttaaaaaaagaaaaggccttattaatcatcctaatgtgttttaaattttcctatgaaatgatttttgaagtatttgtgtattattttgatataagtatagaaacttaaatgtacagatgtaaggctgcttctgacacatctagaatatttttgagtagaatctggtgcatttatacctcataaagtaaaaataataatagctaatatcttttaaatattcacatgcctggcactgtgttctgtcttttatcttactatttcatttggtcttcacaaaaatcagcaagagaggtacatgtagccagccacctaatggtggttagtcttggacgtaggtgctaacacagtagctagagtgggacagacatgtgatttgcctggaggtgaggtgtgtttccaaatctgaaatctcagccattctgctatcctgcccctcctgtgttctgttttgtctgcaagaacaagttaagcatctgtggctgagataaagttttataagaaggctgtggtcttgagatacccagtttgagtaacaatgaactaggtaatctggaccaacccttttgctgtgaacaacagtatccagtattactcatgaacatacatgtgaaaaactattagcaaacctaatctcataatgtatgtcaagactaatatgactaagtcacatacgtatatttatcatgtaccataataagatttttttaagttaacaagcttgaattaaaatctgaatttgaagcctggcaccatttacttgttatacctttttgagcaaattctattacttctttaaagctcatttttatcatttctaaaatggggatgtgataatgctattttgaagtcctttccaataatgaagtgatataatactcataaaacaccagtcgtggtacttcagatgcgtagggaatgttactcatccacccttcttcagccatttcattactgaagtactgttaagtttatgccacagccattatgttttttcttaaattctctttgccatttagaaactataaatgcataggaactcagtcctttcctactgagagtttgtcactcaattctgcatattactgccagggtgagctcacatgacgctgaagccaggtccttgttagtgggatgaaggtgacacagccagatgagttttatctctgcagctggggatcaccagctgcagcagacctctcagcggctccatcctttacttcttttaaagctgattatttcagttaacaagaagaagattcc

SEQ ID NO: 90157 - DNA, 2314 bp, Homo sapiens
ttgaatgaatgagcaaacaaatgtacttcctgttagaaggcttatgttatgcaagtctctttttgataaagtagtctctagaagaaacaaaatatatttaagacataccttagattgatttatttttaaaatattgttttgatccttagaggtttagagtgaaaatctttccagagtattcctcagtatagatgatacaattaagtgttaaaattctcatgacatttttctaaatctaaattttaggcaagagaacaccttggaggggaatcctattatttgggccgcctggaacaggaaagtcctacttagccaaagctgtagcaacagaagccaacaactcaacatttttttcaatatcttcctctgatcttgtttctaagtggctaggtgaaagtgaaaagtaagtagtaaatcaattttttaaagttttttctttgcctgtaattactgtatcactccttaatagatttcttacatcacttatagatattcagagaagtcatgtaatacaggtactcacttctctgtcaaatcagtctctaatctagaatttcttttgtgggaaaagatagcatatatctacaacctagtgaatcataaagtgaattatccagttgtagcattcttattttctgtacctgaaacatgattaggctttttaatctacagagttcttgtaatattgatatattactttgttttaatcttttactattttttagagacttaaaagttttcatttatttttagactggttaagaatttattccaacttgccagagagaacaagccctccattatcttcattgatgaaattgattctctctgtggttcaagaagtgaaaatgaaagtgaagccgcacgtagaattaagacggagttcctagtgcaaatgcaaggtagtgttactaattttttttttctttttgagacggagtctcactctgtcgcccaggctggagtgcagtggcgcgatctcagctcactacaacctccacctcccaggttcaagcaattctcatgcctcagcctcctgagtagctgggattacaggcgcgcaccaccatgcccggctaatttaatgttactgatttttaaagtcgtttttgtttattttataacaatttttataacagtaatgaaaaattcaagcagaatttctccattctaacaaactgtttcattttgccatgtttcattccaattgtcttccatatgcatacataatttttactcaattgtaattatcttgtaggactcactgacataaatagaaaagagatttaatgtattcatttataatgtaccaggaacaacttcagtaaaagtaatatgtagacttcgaatgaaatttttcaagaaatattttgaaacgaatgttaatagtattttccacaatctgggagatttgattcatatatttgcatcatattgcatcatagtgtatttggatcatattgccgtaaggtgatatttgattaaatacagttcttttccaaagacagactctcaagatgaagcactttaatggtaaagcaccacatttcttaacagaatatatggaagaagtttaaagaacaccaaaatgacaaattaattaaagcattacctattttaatgcaggggttggtgtagacaatgatggaattttggttctgggagctacaaatataccctgggttctggattctgccattaggcgaaggtaggataatatagtaaatatcttatttctcactgcagatgtaacaagtagatgataattctctttttgtcttgtcaggaagcattctaacaacttttcaaaagatttgtaatgtgctctaaccctgttgctcccctgccttgagtgggagaagggtggtcatttgcttgtttgtttccctagtttatcaaatatacaagatttccacacacttctgtctttcatattagaaaatatattacctaatgcttacctttcattctgattaagtttggtgggcactgatgcttcaaaaatttataaacatagtttgacaattcagtaaaaaccatttatataaaattttagcaaaatggcaattctataagtcaaaataagataaccaggtaagattttttttttttttttgagtcggagtctcactctgttgccaggctggagtgcggtggtgcgatctcggctcactgcatcctccacctcccgggttcaagtgattctcctgcctcagcctcccaagtagctgggactacaggtatgcaccaccacgcccagctaatttgtatatttttagtagagacgagatttcatcatgtggccaggatggtc

SEQ ID NO: 90158 - DNA, 1041 bp, Homo sapiens
gacgaaatgaatttacttttttcttactttatagtagtctgaacttttggaatacaaaatgcttatggtttcatgtaattttaatctagtagctaaagattttcataatttagggaagtaagttgctagtaactagtcttagagtaacagattatctttcctaacaagaagaaacaatcagtagcagtgatttcataaagtaatagattgtataagtggtggtgttctgttacacttaaaacaactaactacatgtcatcttagaacaggctgcttcatagtttatagtggaacagtttccatattctagaaaattagaaaagcttttgataaaagagaactagaaaatttgtcagtaggctatattaaaagacatccttcttggactcttactgcaataattgctttggcttttgaatatactgcattcagaagctaaatcttccctgtaagttaactttgttaattaacaaaagttgtaaatagatctatttagcagccaaatagaaacttgggcaaatcttaggaaagtattgcaaatctgcaggggtatcttttctcggtttcccatcatctgcttccattccttcctttcctctctccttttccttctcccttctgtctgtctgcctatcttgagttaaatttgttaagcatattttttttttcagtggttgaggagaggattagatcaccttttcttttggttaacaggagaaatggtagaacaagtacttttgatactccaaaatcaatgtattcaaatataaccaccttatggaacgtttggtgcttttccaaacactctaatattcattatgtcatttgattttcgcaccaacctatctaagtagtttgggcagatggtattattttcatttcacaagtgaggaagctgaaacagaagggtaaagtaacatgccccaggttgtctagtcatccacctggttcctagtcctattgactactccctaacacctgcttcctgctcacgctatttcaaaaaggttgttagtacataaaactttcccaattttataa

SEQ ID NO: 90159 - DNA, 5282 bp, Homo sapiens
atgattatttacttcaaatttatgtttatgctttgatttaaatgttgttattttgcctccctcaaacagaaagcgatagatctggctagcaaagcagcgcaagaagacaaggctgggaactacgaagaagcccttcagctctatcagcatgctgtgcagtattttcttcatgtcgttaaatgtgaggccataggttatattttatttaaaaacacgaaaaggaaaatttattctgtttcatttctaaaaaattgaaatataatgccagacaattctaaacgatccatttgttaaaaaaaaaaaatactccactttctttctagtgatttttaagtattgagatgtagctagcaaatgtgacagccatcatagttattactttgtatatgtaaacatcttaaaatgtagtctagtcagtggaaaataggttaggagacattctatttgtgtctttacagatatgtattgcgtgtgtaccacgtggcaggcactggggatacaatggaaagaaatggttaagacccctgccctcatagctcttaaatggaatgcagttagatgattgaagatgttcttttgagcttctcccatttagttctgaggttttatgttaaagtgagactaagaatgagtcataacctgtaagctatgtggggctcatcccatctattgcacgtgttgccaaagttcactttgaaaacagctctgacagaggcctttgtgtagtaaaatttacgatgttggtattacacagaatatatgggatttccatcactttactcttctgaaataaagcttttgtagacattcatagaaatgattaatactgctttccttctatttgtcttttttataattgggtttgtctaagacaagcaactttgaactatctgcaaaaatgtaagggaaaaatatgaaagcttcagaatattaaataatttcctgttagttaacattaacttaatataccctgctgtcttgcttaggttgtttctgattcagacccactgttggtctccaaccctgctggaggaaggggtagaaaagaggtgataatcattggctatgatgagttagagatgatcttccctccttcttccaacatagaatttccttgtctgaaaaaatacatatttaagagttcaaacctttctacatagaatactaatggaaaaaaatctctctcatttccctttaatagatgaagcacagggtgataaagccaagcaaagtatcagggcaaagtgtacagaatatcttgatagagcagaaaaactaaaggagtacctgaaaaataaagagaaaaaagcacagaagccagtgaaagaaggacagccgagtccagcagatgagaaggggtacgtgtttaaaattgttcaattttattgtggctttttgctttcgatttgtgaaatttcttttgattaaaacaggtgtcagcaaactatggctcatgggccaaagctgcccagctgcctgtttttggaataagctttatcagaacacagccgtgcccattcttttacatattgttgtctagggctgctttcgtgccgtaacaacaaagttgtgtggttgtgtggagaccgtatggcccacgaaacctaaaatatttacttgtttggtcctttacaaaaaaaagtttgctgacccctagtttgccaagttgaatggataatattcctcaaacaacccttcctgactgcctgctagtaggaggagagaatgcttgtaggaatagtactcagttactctctggccattagctaatatggaagcttaaggttataggagtgaccagagagttaaacctttgaccacatggaaaaaatgaaaagtaactccaacaatgtaaattttttttggatatcttatgcaaaattttttgatgtgaatttgtgttagatttgctttatgttgtcattgtaaagaaaacaacacagcataacttataaacgttgaaactgatttttggcatgtcttcctagatgggggatgtatcacttctagatgcagaatttgtttattcagtacatgacatatgcgtgccaagtttgtgctcagcactgggaacatattctaaccacatcctctctggctgtcctattaattgatgccagtagttccaggtaacacacccttaagaaaatgagactctgggatggagttatctggcctgcttgggtttgaaaacagcgagattctgctcagctttagaggatgtggttctcattgttcatggtatgcagtggcgcaggttatttagacaataccctgtggtcacaaggaatgaagtgccttttaggcagtgctttggggcttcgtggctgctaccacagaccatttggaagtacatgaggaatataagaaccagtgttgacttggctgcttcaaactatgtggcagagtttgaaggaaatgataagcttaagctcaaggttttatattctctgttcaagatgtgatcggggaaccagggagtttctgtgacaccctaagaacatgttatcttcttcatcgatagcactgacttaacaaaaatcagatgatagtctgatcttacaaattactgaattccaacttagggtttcttatatgaaagtgaggacatttggtataaaacagggactccaaacatgaagtgaaaatattgggaagaatttagttgaccttgactgcccaggacctccagctgtcactgagactcccttgacagcagaagcttctcttcccttgtccatagaagctcttctctcttgcttgaaaaccctgtaaggatctcttctgagatgattacctgacaaggcgatgccagtttttcttttgtactgaacagcaatcttcgtttacagtaggacccactttggctaatttaagcaaaaagggatatattatagggtattaccttacagaatagtggggccagggaatcaggagaaatggccaacagtaccagggttgttcaagtagggatcccactgttgccaactcctctgctaagcactgatggtgcttgggagcaggtagtaaatcctctgcgcagctccctcagcaaaaccagtgccttcgcctgaagattctgtctccttgtgagcagcccccaccttcttggaagaatttaggtctcatgtggaaccctagctacaagggagatgagaaacggcagggttttttttgtttgtttgtttttaataaggacagcctttatagtactggacagcatgatagaaagaggttggagtgagtgtcatgtgaatcttttgcagtgtctacctcacccacagccccaccgtcctatgataaccaaggcaattccattttggcataaaacatgtcatgcttttatctccctttatatgttattgttttaaaaatgatataatgccttatttttggctttatcacttttatacttaacattgtatcaggaatatctttccaataaactatttctacatcacgtttaaatgttgcaatgtatcctgtcatatgctagtccctataatatgagttactttttccccttttgcaaacagtgtgggtgtgattatccttatggtcaaatgcttgaacttgtctaaaattatttcctcaagataaatccctagatatgaatgaaatgccttgatcgacctacttgttctttgggtgtagttcattgtcatcaggaagcttcctctgtcctttggaatccccagactaagggttgtagacctttgtaccttagtgttccagatttttttcctcctaatatgacctcttgttctaatttatatcttgcccagtcctgatgtttttactgttgttgtttgcagctctcctgtgattcatcttgaatccttcatggagtgatgtgtggggcatgcatttatgaattaatacatacctaaatatgtcatgggaatttggagctagttcctgacttcattctggtctttttgtccctttcttttacatgattctctattgatgataacgtgactgcttcttatttactacattctttaaaataagtaagcataacttttaatgtaaatgtctgattttgccactgaaattacaaatatttcaggttaatttttccttcatttttgccttatttgatagcaatgagtgatcatttgaatatattaaattctttttattaggaatgacagtgatggggaaggagaatctgatgatcctgaaaaaaagaaactacagaatcaacttcaaggttgctttagatttcatttttaaatttactatcctattaaaaagactcaaagtgaattgtctatttgaattgtttttgttctccctctatatttaaatgaagtttaagaactggctttggttcccaatagtcatgtgctggctttgtttagagtgttttcttagggtttgccctctaggatcatggtttggtcttttttatgtaatagttttgttggcttcacatctgcctttaaaaggctctcagtcaacttgctctttctttttgtttatttgccgccttttagagaaggtaacacttatactattagcacactgcaaaatttgatggtattaaaatttactactgtgggagaagttaggacttacacgtggcttttattgccgttgctgtagctcacttattgatggtttattttgtttcttaactgctcttcatctgcttttcagtgttcctgtttacatttaattgtttaagctttctgtgtttaccatccacacctgtaaagccctttcattctgttctactatagcacagtggcataacagaggggacataggtttttggctccattcagatcttgattctgttcaagggtctgccacttagaactttctaattgtgggcaagtgactgaatctctcagaaccagcgtcccccatctctaaaatagaaatgagcaatagcttcctttcagggcttttaagattaatgacagtgtaaaaactacctcatatatctgacgaagtctagggactcaataaatggtagcactgtttatctaaaaaggcatctatttgttggctggctttgttaatcactgagatttgattattcttcgaaataaattatctaacaatttttcagattgaattttttgctcacccattggtagtatgtattttgttcatttgaatcttaccaaatagaatgcataactgggaaggatttccattttataggttcagccttggttactgaatagtgaaaatacttacctgagccaaacttttagccttgctatactagtgtcttcgttttggtagtatttttgtcttgcctaccc

SEQ ID NO: 90160 - DNA, 1495 bp, Homo sapiens
ttgatttgtctgtgtttttttccttttcttttctttctttttttttttttttttgagacggagtcttgcacggtcgcccaggcttgagtgcagtggcgtgatttcagctcactacaacctccacctcccaggttcaagcgattctcttgcctcagcctcctgagtacctgggactacaggcacccaccaccacgcccagctaatttttgtatttttagtagtagagatgaggtttcaccatgttggcccaggctggcctcttgacctcaggtgatccgcctacctcagcctcccaaagtgctgggattacaggcgtgagtcaccgtgcccggatgactatctttttcaccaaggttgtattaaactaagattcagcaatcttcacttgagttttttgtagctttttgtagtcctatttggaaaggttctttttggtaaacgtatttggaaaaagcgttggtcatttggtaaaagtatttttcccttgagtattaaaggtgactcttctgaagtgcccatcttgtcatcgttggctttttaacaatttttattccaccagcttttcatttgtcagagactttgcatgtgatttcgatactctacaacataatcttcatcatttgcaggtttttgttgttgttgttttgagacagtcttgctctgttgcccagactggagtgcagtggcgtgatcttggcgcactgcaacctccacctcccaggttcaagtgattcttgtgcctcagcctcccgagtagctgggattacaggtgcctgccaccacgcctggctaattttttctatttttagtagagacagggtttcaccatgttggccacgctggtcttgaactcctgacctcaagtgatccgcccgccttagcctcccaaagtgctgggttacaggtgtgagccaccgtgcccggccccagaatgcatcatacttgaattggactgttggctgttcttcagtgaatcagccagagactgaccaacatgaaaggcataattgttactcttaagcaggaaggatcttgaattgtaattttgttagtggtaggttcacatgtgtgctttctcattcaaccttttcaaccttctaacctaggaaatttggattaatattcatgtagtgattaacttcctgctgaacaaggcaaaaatctctgtggccagatgcttataatctaatgagggaatgcagataactaaaaatcaaaattatataatgtaataaagctgcacagtattctccacttccctgtggttttactttccacagtttcaataacccgaagttaacctgggtccaaaaattttaaatgaaatattctagaataaatagttcataattttgaaacactatgtcacaatgcctgtgtcattcacttcagttcatatcatgacgtaggcattttattatttcacataatcacaagaaggttgagaacagtgcaataagatgttgagagagagaaaccacattcacatcacttt

SEQ ID NO: 90161 - DNA, 1044 bp, Homo sapiens
agacacagtcttagtaggcaacataagaatagaataactgaactaagatttggcctgctacttaagaccataattgcaatttgagaaaaacccaataaaagaaaatctggacacatttgactgcataaaactttaagaagagagtaattgaatagggaaaaacaccaaaacaaagtcaagagacaaatggaaaatagaagaatatataccactgtataactgataaaggactgataccttaataataggaaactcatgagaggaaaagtcacataaggctcatgacaatgattaaaaaaacaaagacaatctaccaaaaacatatgtaaaacctctttgagcatatggaaagatgtttagcctctctgataatcaaaagatgcacataaaaaccatcatattatcagaatagcaaaaattaagatgcataataatacactctgctaacaagagtattaatatactttgcttgtaagagtatgtcgaaacaataactttcttacatatttagtaggaatgcaaactggtaaaatccttaatgagggaatctggaaatatctcaaaaacaaacaaacaaaaaatcacacaaaaaaactagatatatgttaaccttttcatctacagtccaaattctaggaatttactctgaagatccaactcattcagtacaacagtatatatatattttataagtatttcatacattgatgttttatttaatatcagatatttcataaatatttcattttctatattatttaaaaataaaatcgaacaaatacctatgcatacatttgaggacagacttaagtgaaggacaatagccctcaaaaataagcttctagttgtgattctgtcttctctttataacatgactagcatttatttttttcagcagaataatcacactatgaattatttcctattgaaaaatctccttttcctaaaacttcatttgaacaccattgtttctacatacttctctttgttttcatgcaactcttctttagaggcaatgtggactttagatctctgggaaagggc

SEQ ID NO: 90162 - DNA, 1058 bp, Homo sapiens
gcttgattaactttgatcagaaatagaaacgttttcatttgttgatttaggaaaaagcataaatagaatgcagtataacaccacttccaaaggtaaggatacctaacattcttttttttttttttttttttttttttgggatggagtctcactttgttgcccaggctggagtgcagtggtctgatctcggctcactgcaacctccgcctaccgggttcaagtgattctcctacgtcagcctcctgaatagctgggattacaggtgcacgccaccatgcttggctcatttttgtatttttagtagtgacagcgtttcaccacattggtcaggctggtctcaatctcttgacctggtgatctgcccacctgggcctcccaaaatgctgggattacaggcatgagccaccacacctggcaagggtacctgacattctaagatatcaagacacttaatatgtgggctattagctgcttatttaaatgttgaccaaattgtctgatatatctgattaatcatgatttcacttcatttcggaagaaaaattatccatatcatttttaaagacgcaaatgactttggatttttgcatagagtacaatagacacttcaaacaatagattctaacattctctgaaacacttgagatgtttgagctaccatttatatgggttatttatatttagtctaagtaacacatacatgtttaattgattctgttttcatggatagattcaactaagtcttccaagcaattaattttttgttcgtcgtcgtttttccttcatacgttatctagttatgcagcactggaaacagactgaagatcataaaccagttttatcagacctatgtgtaataagactcctgttaatacaaaaataaaaagctaaaagcaacttgtctatgattgggataattttatcttaccccttttccctaggtctttgagtaatgctattaagattttgtatggagctgaggaaccagcagttggaaaatgcaggacaagttgaataccgatccccaaacccagaattttagcaactgaacttggtcc

SEQ ID NO: 90163 - DNA, 1053 bp, Homo sapiens
gcttttggatgtgtggagcacttgtagtcagcccatttgtgcaaaatggacaaggacagaggctgagggaagcaagaagtctttgtcttctgaagggcaccacatggatcttcctgatgttgtcattacctcacttcctggttcaggagctgaaattctcaaacaactttttttcaacagtagtgattttctctacatcagggttcctacagcctacattgatattcctgaaactgagttggaaatcgactcatttgtagatgcttgtgaatggaaggtgtcagatatccgcagtgggcattttcgtttactccgaggctggttgcagtctttagtccaggacacaaaattacatttgcaaaacatccatctgcatgaacccaataggggtaaactggcccaatattttgcaatgaataaggacaaaaaaagaaaatttaaaaggagagagtctttgccagaacaaagaagtcaaatgaaaggcgcctttgatagagatgctgaatatattagggctttgaggagacacctggtttactatccaagtgcacgtcctgtgctcagtttaagcagtggaagctggacgttaaagcttcatttttttcaggaagttttaggagcttcgatgagggcattgtacatagtaagagaccctcgggcatggatttattcaatgttgtacaatagtaaaccaagtctttattctttgaagaatgtaccagagcatttagcaaaattgtttaaaatagagggaggtaaaggcaaatgtaacttaaattcgggttatgctttcgagtatgaaccattgaggaaagaattatcaaaatccaaatcaaatgcagtgtccctcttgtctcacttgtggctagcaaatacagcagcagccttgagaataaatacagatttgctgcctactagctaccagctggtcaagtttgaagatattgtgcattttcctcagaaaactactgaaaggatttttgcctttcttggaattcctttgtctcctgctagtttaaaccaaatattgtttgccacctctacaaacctttt

SEQ ID NO: 90164 - DNA, 4333 bp, Homo sapiens
gtatgtaaattgagggaaattagtaagtcaatgaagttttactactaaccagataagtaaaaaatattaaaaatgtcatgtgaaaagagtatgtgtgtaccttctttgtggtaaataacccagccttctccataagcagattcctgtggttcaggaagcaactctaaagctgctgggcgcacatagtaagcaccttaaagagacctttgtggttaatgtagaaaaatcagtgtctttaggaaaggctgtagaatatttgatgcctttttctgttgctaatagctggttctgcacacacatgcttatgtatgtgcatatagaaattatatctcttaacagtgtctttcacatggtagttactgctgaaatgattgattcattggaactaaaaacaagctgaatagcaacaagagaaatctatagtggtttcaagttcatttcatgctatatatatcagaattacatgtgaagggaactgagttttaattctctttccacagtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactcttttttttaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgcaattgtttcttatttttactgtgtatcctggttgtttgcaatatgaatagttctgtgtacaaagacaacagctacgaccatatcttccagaaagtgttgcttttattaaaattataattgtagaaatatagaattttagagatgagagagatcagattgcagtctaattctactataaataacctgagattcataggtttgatatagtttgtatttgacaaacctggtaattgtacagtaaaaagcatatcttatagtttattttgagaagaatcaatccttaagtcaactgctaaattatctttgacagcacacaaccacaattaaaa

SEQ ID NO: 90165 - DNA, 1024 bp, Homo sapiens
agattgcaggtatggccgaatataggatttgagtgattttcatcaggaatttttcactctcttcccttcagcactttcatcctcagggaagctctccctgcacagtagcaaaggtatcctgcagcagctctggttttgcggtcccagctaaactcaaaagctggttaggctgtcctcagaggtgggtcagcttcagccaagctgtgtgggttatgaatagaggaggaggaattgtttagagtagaatcagggtgaattaacacaagcaggcaggaggaatgctggacatgacacagacaaaaaacaacacagtaaatgtttaccacatggccttttcaggtgattatgtaatattttggagtcaaccatttggcctgcaattgtaaggttatgtaacaccaagtaaatgaagtaatggtgcttaaataatttatttttcttttccttttttgaaggcccaaggaggtgatagcattttgcagagattgaaaagaatagtatttgatgccaaatctactattgtggtaagttgtgacagtttatgtcattgataatgaagaagatataggttctttatgtctagctgtgttaaaaatctgaatttgaaaagattaggtcaaaatatgtctttttaatttgcaggatatgactagtcagtatttaagaaaatatattcattaggtggaaattgtttctaattgtttatatgattgatgagttaaaactaaaattcagaatcaattaacttgatagtataatttaaaagattttatttctgcaacctgccatgtaaagtttttacttagtaatttctatgatttgttgaaagtgcagataatatgaaatttttagttccattacgtgctgtcttctgtaaattggtcatttttgttaaagaaaatgatgtgtgctgggaagtcactttttattttgcaggagtcaaaataaaattttagatcttacaattttaaacatccctgttaattctgtacttttccctagttggtaaataattaagatcatt

SEQ ID NO: 90166 - DNA, 1068 bp, Homo sapiens
actgtgtctgtgtttctcagaatcctgttggtctatgggagaatgctctgcatgttgtagacattttgaaaaaaactcacgaaccatttgaaaattaaagaagcatataatacaaaaaaagaatagcaaacgagatatttcaggaaggtagatgtcattgtgaactgttttcatcagagagttagaagactgaaggttgtgtagaatttagacaggtgtttaagcagtatggaattagaagcagcattaaaatgcagggataatactgaaagattatggatttaatcctacatgtatgtacctgctctgagccaggtttatgcccatatttctgggcatctaatcttacttaactctcccaataactctatgaaatatatattagtttttggaaataagttgaagtttactgaggcacttccctgttcccctgtggcttggtatggtgcctagaacatgatagacactgcttgatggcagtgtttggcgttctgattctaacaccactcttctggttattacatcatgccagcttcctagaagatatcaggatacatatgctttatgttgtatttagggttaagtaaatgtgagtcagtttaattctgcatattataactggcaagtactgaaccatggtaccaaagtcaacggccatgtaaaaaccattttcttattcttctagaccattgttttagagctacagtaattcttagcaaacttgcttttaatcaacttatttcctgtgcttttagcctttgaaaaaatagttatcttagccaatttgtagggtgtaaggaaaaaatacaattcaagcttgtaagttggtataaaaaatactatttaagtgtataaattattacatatttactcttatttatattttggggtgggacgtggaagggaatttgtcactggagttgactaattcactgattgactctacaaacatataccgtaatgtgttgatttaatttgatataacatgtagggtgattggaattaaattctagaaatactttactaatttcctactcagaactaaagtgataattgaacagtttgtgt

SEQ ID NO: 90167 - DNA, 1061 bp, Homo sapiens
caacctggcttgtccctatgccaaaccagtcatcttaatgacctccccttcttgccagtggttacaatagaactcagcaaagtcacctactatgttgacatttttgtaatagaagtagattgatattatcattaacaattaggtgtgtatgttgtatatatatgtttattttgtggattcattttatataaaacgtttcatatagaacatttccttggaagtaaagacatttttattgtaaattgtatatctgttttaaatcagtagtcaattaaaatgagcttaagatagtaccggttttgaggtatctaggtttatgtttgtatgttttgatctttcattatgtatctactttaaaaattatatttaaacttcttgtctaaaacattattagatcatttagtcaaagggattctttaaatattaagattcatatttactgtagcacaacattttaatggttatctttttttgtttgttgtttgtttttttaaaacaagttttatgcgccatggtgtggccattgtaaaaagctggaaccaatttggaatgaagttggtcttgagatgaaaagcattggttctccagttaaggttggaaagatggatgctacttcctattctagtaagccttcacttagtttattattttactgttctcacagcaaaaacatttatatgcaacagtattcagggtgggaggaagacttttttttgctcatgtaaaattcaattaacttaataatttaagactgtatactttatgagttaaatgaattagccattgaacatgtagcgtgtagtgtgtgttaatcttatgcttaacagatgtttaaaccatcctttctcctttgagcccacttcagatggtttatatgaggcagctgtaaaaggatgagtgttaaactattgatattgctacttgagttcagaatccgtttttttctgagtagcctgagatgtgctgtaaagaaaaaatgggaacttaaaggacgaattgagttagggtgagtacaagtgaggatcaggaagcttttcacattagaaagaatactagagcaa

SEQ ID NO: 90168 - DNA, 1026 bp, Homo sapiens
ccagcacaggaattcctcaatccaatatttctcacgcgcattttatgaacactgagccatcattaccaggaaatggtgagaacacttctaaaatccaagttcccagatgccaaccaaggaccattcttagaaacagttatttctaagcatagcagcctcaggcttcctttggtaccttttctaaacaggtgtaaaatgttctagaagggcaaggagcttaggcatctgtttgtgtttctaccaagtcctactttaattctttttcttggagtctttcctcctaattactttatcattgatcagtcctctgcttttatctttgagatgtttaatggataggtcactgagtaaaaattttatgtaaagtattattgaaggaatttgggtctttcccttatatttatcaatgtattatctctgcctatactatacagttgtaaagtggacacaaacatacaatcaaacatttgttttcttgttttttaggtttaaagaaaatcgaaatgatgacatttggcttgtagatgtaagtatgtaaattttatatgctaattacccacccctaccattttaagtattattttctattctactctacccaaaaatggcagtaaacagctagtgcttatgtatatactcaatttgttttcttaagtattactatatttgagattttacattaaaaagaaccttagagttttaaggttccatgcgagggaacgtatttttgatgaaattttgggggtgagaatattaagaggaaaagctggaaccctgtcttacaatgaggtcaacttttggattatatcttaatgatatagggtatgattttattacagaattcactcttgctttcttgatagtttccaagagattgagtatattaatatcacttagtcaaagtcatattttcatcttaacagtggacaaaattaaagtttcaccttcctttctttaaagtttggaatatatttaaaccttatgatagttgagatttaacatgcctcagcaaaaagtagaatagga

SEQ ID NO: 90169 - DNA, 1024 bp, Homo sapiens
tcaggcactgccgtgtaataagtattagagttgcagctcgactttcttcctacgtatctatttgaggggaaatattttgaatggcatttggagtttttacggaagaggtaattgctactaaagcaaaagaaataaagaagaatgctgtctatttgtattccaaaaagataggatggttaaaaagagacgtaagatgagagtgaaaatatggaggaaaaaggaactgtgtgtattagatttattggcttacctagaacttggccggtcacgatatggttgcatacagactaaatatttattaaatggatgaactacctttgcttttgcatcatttgcaccctgggatgcatcagtgatgaattttttggtaggttgtgaaaggtcaaaaacacttcagagatgactaagcttatacggtatgagccaaataatcagcatttattgtgtacattttgtctttttttttcagttgttgtacttgatatggtcgtctgtaaaggatttgtagaagatttagatgaatcgtgagtatacatatatatatttaaaatattattttaactgtccaactcagatatctgaatatttgcatgtgattctaatattttagattggaaccaatttttatatatcactcatttttttcacttgttgtaagtgaaggtgagggtgtgcccagaagagttttattaatagttatgagatcaaaaaactgtggcaaacttttacatattctttttttcctcattatcttaccttgtatttatgtctttttcctttaattatattgaatgggtgttagaatttggtaactgtactgtatttatcttcatagtatgacagcattaatcagccttgcttatagtaagtgaggaggttcacttcagacccaaattcctgtgtgtgatctttcaggcttgaccatagacaattgcaaggctttttctggcataggggaaggtgccctccctacaccaaacttggtgtataaccggtgcattacagtccctggagggagtggtag

SEQ ID NO: 90170 - DNA, 1087 bp, Homo sapiens
acagtggggtgtccttataatctatccagcttggaatttgattagggtaatgaggaatgatggcaaaatttcagctaagttcctgttcacaaattccccaaatgcacctcatgcaatgcagaacctttacaagaaataagcatccatggcaatttgccagttttgaatcattaatacagagtaaattttgcccagatatttataattggaagtgaaatattctggtccactttattaaggactgtatgacaatgaactctccatctggaaaaaaaacttcagtaaaaccaataaagacattttactaagacttcttggtgatctcaggtagaaagcagttgtcttttgagaaatttgctatgtatatagcatttgttacatgattctacatgtatttcaatgtcagaatcaattccaggtcctccaatatcacatctttttactgcctatatggaaactattagattatcgtaattttgtgaatccaaaaacttataatgtcctctagttttgtaacccatgatgatgattctgattttcaagaatcacttaggtagtgtacctagtaaccttcatttttccaacaaaaaccattgaatttcacaggattttcacattttcatggaactgcttactaaatatttaccaagtaccttccatttaaattaagtagcatccttgcctactggacgattgttaaaatgtttaaaaaatattacacaagctattgttggataaatgaattgctaaaatcatttattgaactttgagatctataaacaatagtgtttctaatatggtatactagtaatgcaattgttatatgtatggagttaatgaaatgaacatgagggtatctcagggaaatactcaatttttgaattaaattctttagagcaaaaggtaaaatgcttgcttataaataaattagtataattgagtaattctatatggaatgacacaggttcagatttgagagatttccattttaagggtatggctgttttgcaaacaggctggagatagttttctctaagtggacaattacagtgaccgaaatgataaaaagctatattctcaatatttt

SEQ ID NO: 90171 - DNA, 1064 bp, Homo sapiens
gattttctgattaatgagatatttggacaggccacagcaaaatggcattgtaaaatgtgccaatattcagtatgtgctttaattatatcattttttaaaataataaaatagatagatgaaggtttaagatgtgattgcttctaaaaatgcatctgtgatcttcgtcttatttttgtactaaattttctttgccaacagtgaccactgtgctgaagtatgttcttagtgataagaactggcccaattagaattaactgtgagcagaaaacctggatctaacatcagggagctggaggacagtcttccaagaattgatcctgttacccttatatccacgtttccctgtgatgtggtcacaatactagagacggttttcttttcaaagcacattattcatttttagtgacaccaaatttcagtgagcgttattctctgaacattttttatgctaaaacactgaattgtgtctttcctgtactgtaatatatctgttggttatttgtgtttttatagtctgatttttttttttaagcaggggaggttttagtttgttttagctgcgaccatgaatttctggagctagtgaagttaaagattatgctttaggaaggatggtacataaaaaaagattaatggcattcatttggaattatagttaatggtatccattatggggggtactttttaaaaaatactctgggtaagctgttaatttaaaaaaatattgattttgtaacttgtttattttttaaaaaatgcaaaatattctggaatgctattacatcaagaacttagagctttaaattatatataaatcctgttcatatgtatttgtttatgtgtgtgcctcctaagtatagtaccaagtttcataaactagtatttctgtactcttatttttctatctcagctttcccaaactcagaagcaaaccctctaaatgcctattatttgaaatgtcttgaaaacctcgtgcagctccttaattcttcctgagtgccatgggatgctacaccttgaagctgacagtcatcaacaggggagctaaagttgaagccagctgt

SEQ ID NO: 90172 - DNA, 1033 bp, Homo sapiens
aagttttcacacacacatacatttatatatgtagttattcatagactgttcaggtcaacaccaaataattttataaataattttctaggcatttattaagcacccactgtgttcaaagcactgtggaaggcatgggaatgaatcaggcatggcttcagccttccgtgggcttccaggagtctcctgaggttagcaaatcatgtcattccagtgcacatactggacacctggaggaaggggagccgtggacgagggctccctggccttaccttctgctccctctcctctctccttgctcttcctctaactccagctcccctcttctgcatcttcaagcaaatgctactatgtcaatgaagcctctcgggaaccatgtgttaatataatagccccgcacccagggggccttctctttcctcctcctcactatttcctttcctggttttgtttccctccgtagtattatcgccatctgatagattatgtgtttcatgtatctgtctattcctagtcttcccacactagaaggtaagctcttatggggtcaggaggcttttgtctgctttgtttatgtgtagcacctagaattgtgcctgcaactagcgagcactcaataaatatttgatgattgagagagatcccaagcagaccggagagagttcagggcttgagatcagatggtgcagtgagcctcgcagagacttcattctctgagatgtaggacagatggaggcgaggattggtaaggattcagaaaaaaattgaagcaaaaagaatcggaaagatctttttctgcaaccatgtgttatctctgtgaggagtatgtgaatttcgtggggagtgagttttataaaagacatgtgttctagtgaaaaacagaaggtgggctccagacccctacacacctggtcttgaatgccagcactagggcatcactccagcgtcgcctggtgcagcctcgctgggcccagcttcttcatctataaaagaagcccactcttcttggtttggtaagaatcagtttataaacaca

SEQ ID NO: 90173 - DNA, 1038 bp, Homo sapiens
gtttaaactgcatgctcaggtaaactgaaaataacatagttatataataactactgtggttaacaagatctgccacccacttattcaacaaatgaaagtgtgtgaatagtataaatatataaatatacatatatgtgtgtaggtaaggccgttatagcagcactctatgtaataactagtttctactgcatttaagaaaccaagacaaagtcttatttaataatgtaattgatgcaggagattgattgtatgtttatcagttctttttttttttttttttgcctcttttcctccctagccaaaggcccttcatcattgagaaagtcagccaacacctgatattattgaaaatctctcagtatctgcctcactttattgagatgaaacatggaggctatcatatatccgagttcctccatgcttgatagaacagaaatagctttttcatggtgaatgtgcttcttgagatatggtcatctttcagagatcgttagcctgtcagttccctcaaagttacagtggttgggcatgattagagcacacctgcattgtcccgtgacccaaaggggagggaattactatacacaaaaagtgaagtatgctgttgcattcacagttttcaactgctttttgtttaaataggaggatggtgttattaaagagttaagcattgccatgcagctcctaagaaactgtctttatcaaaatgaggaatgtaaagtaagtagaactacttttcaaaattttaataggagtactggtattaagcagtttaatttttatgtgagataatgtagtaggaaaaatggaaagctctgacttttaaatttttagacacacagttgattggtccttaaactcagtgttaattgtcagaaatgtgtgtatctaatcattattcatcgacactgattacatttcttcgcaaacttcagcctcattctgtactcttaggtattttaaatgttttacatatggaatgaatggctggatgtgttttataaggtagattctttcaaaacgggttgtcaaaacaac

SEQ ID NO: 90174 - DNA, 1033 bp, Homo sapiens
ataaaaatgtatggaatctgttattgtgtctgcttttgtacatattagaaatttttaagtgaaaatttttctagctcataaatttaaatgtataaaggaaatatacagaaatagtagtttcggaattacaaatgattttccatttctctgaaagtcaaaaaagttacacactattttttgagaaaatgttatatgacaggtgcatgttaccatagaaacgaaagatggaaagaaccaaatcacctgagatataggggtagtttagatagaaatggagagaggggaatgtgtccccagaaggagaaaggaggaaattgatgacagttctcctgttcagcagttttacaaggacccattttaataaggtacacacatatatatacaatatgcgctggtgaatttgagtaagtatatgagcttgctacgtgaaagctaaataaagcttttttctgtagatgatgagtctttaagaatgattgttgttcttttccatattataagcaacttatacagtcttatccacgcagaacattctcaaatattaatgatttatcaaaatccagtgaatttcacatgatagttgaaacctagcaatatcttttaagtagaaaatgttctttattcacaacagttttgctccagattaaatatttcttcaaggcagtttgatttatattctctgcagtgctatgaagggaaatcctccaaagatatcctgaaaagagtagctgcaaatgcattgatgtcactgctggctgtcagtagaagagcacagaaacatgctttgaaaggtgagccacatgacacatcagctgttttgatggcattatcaattcatatgttttgttgcttgttcaagttaattttctttggactcaaaatgtaaaaaacgtatagtataatctcagtgtcactaaaaataattttttttcccatacagaagcagtaaatatgcattacttttcaaataaaaagattagacatagtttgtttttgtttgtttaatatgtgatggttcttgctctaaagaacc

SEQ ID NO: 90175 - DNA, 1287 bp, Homo sapiens
cattttccgtactgtaacattaataagtaaaataatttactgattcataggtggcaccttcattggggagtactgaatttcagccacttgtgcagtcaacaacacttctacctgaagcctcccatgaccagtttgtggctcaaggtatccttttagtgaagacattctaccttcaaaaagaaaaatgacaagttggtccagacagatattttgaaagtaaatgtctaaagaacaaaattttaatgaaataagttgtagaccattatgaaatacatttagaaccaatatatcagaaattaataaaataaatgctcttaactaataaatggaatttggctcttaaataaatagtccaattcctgtgtggctccttattaggcgctcgtaggtatttgacatttgaatttgggaactgatgggtataacttaactttattttttcccttcttttgagaaaacactttgctacaagtaatccacttgaaagtaaagcgattctggttttaagtattttctaaggctatgcttccatttaaaggcacataaaatgtattgagtctttattttattagaaatgcacaatatacaacttgggacttatttttattaatggcaatatataaattttgctccttgtgctgggaactgcttccaaccctgctgtgcttcaaatttgcaactttgctttttttttttttttttaaattctagagagtatataagccttattcagtagcattaaatttttgacttgaaaggactatactatctaaaaagaaagtaattttaaacactggcatacatataagtatatgcagaaaaaatactttctgaaacatttagaaaaacttgctgaattaaaactttgaactttcattacaatatttgttccaataatttcctaaacagtgttccatattggtttttagtaattcatgttcactatatataaaattatttaactgtagaaaatactcatttgatcttcttaagaacaaaaggagcaaactcagattatttaaatggctcaggacatagggcatgaaatgaaattcgatcatgaatttcatgaacatttatctctaaaagcatgttgccttactctgatttttaacatctttattgagatataattcacataccatataattcacttgtttaaagtgtatactttattggttttaagtatattcagagttgtgcaaccgtcaccacgatcaattttaggatatttccatcatcttgcaaaaaaaccctatacccattagcagtcactccctgtctccc

SEQ ID NO: 90176 - DNA, 1075 bp, Homo sapiens
tagtttagcacacttaaaaaatagaggctagtagaaatataaatcatccataatcaattttaaagcaccatataaagcaatcattgtgtttccccaaccacatggggtaagttataatacaataaggtactttctaaaagcatcttttctaaacttgtgtatcccttctgtggactatactaaggaaaatcacatctttattaatgcctgacctttgtcatgaatcacaactttgctttcttctaatgagccaggtatttagtgggcccttataagctttcttttcccacaccgatcgttgaaaccgcaaaccaggtacctattctatttatatcagtaataaggccttcttgagtctttatcagttgaaagaatgttcagtgaaatgataaaggatttcagcatcattatccccttaacttttcttatacaaccaaaagagttgtggcaggagccagatatattagcttgtgcatagtttgtgatatcagtcttggcataggattattttcttcacagaactataaatgttgtcttgatatctgttgacaggaacattttttcacatatctctcattgccaaattgtaggcaaatatatttttaaaaataaacaagcttgctgggcgcggtggctcacgcctgtaatcccagcactttgggaggcagaggcgggcggatcacgaggtcaggagatcgagaccatcctggctaacacagtgaaaccctgcctctactaaaaatacaaaaaattagccgggcgtggtggcgggcgcctgtagtcccagctactcgggaggctgaggcaggagaatggcgtgaacccgggaggcggagcttgcagtgagccgagatcgtgccactgcactccagcctgggcaacagagtgagactccgtctcaaaaaaaaaaaaaataaacaagctttaggttatttttacttagtatctggatctaatactatataaaataaggcatttgatgtttgtttatgattgacttatttagactgaacttttttccagatttactttttagattatgtgcttagcctacattttttagctgcagctttct

SEQ ID NO: 90177 - DNA, 1074 bp, Homo sapiens
gtatacatgtgtgtgttttttttccttgtcaggattaattcagtgggaagtaatgtgacagattttgccatatggatattgatggaccttttcattttacctggcttagtgataggtataaaaaataattctgaacataatatatggaccaccttatttcatatattttaacacctattattttactattatatgtaggttgaaaaatactgcttttattgtgtttttggtgcaagtatatgatttcttggttaaagctgatcattccatagaaacattttaaatgaaatggcccctcaagagaaagatcagctttgtcccttcacgggggtgtttaggcagcaaagacctagagtattatggaataatttgtcctaggtcaggctgctataactgtgtaaggacaaaagcagagtggaaggagatgggagcatctgggacccatttgtttcctcgagaggagacaatggatctttttaaggaaattgttggataaatcagtgtctcctccttctttccctctcttcctacagggtccctgtgttcatgatgaggactctggcctatcgctcattggaaaacctgcccttcaggctcttttatatcactgccatttttatgaacatttgaatcagatggtaaagcattgttacctaggacggtgtatgtttgatttgaatttttctgcttttgatagaaattcagaaagcaatgatttaaatggtaagtacgatatctttgtatttttatttttgtaatatgtaacttgtaaaaactgttaaaaatacatatatttgttttaaaaatttgaaaaatgaaagtatacagggaaaacattcatttccagttctaccacccagagagatgtattttcttcccgtcttctttctctgtatagcctttgtttgttttatgtaattatgttcatatcttgtgtacatttttgtatttccttctttcactaaatattctgcaagcatttttctatgttataaattcttcatggaaattatttttgacatcttattaatactttataagttatgcccatcagtacagttttatagtttcttt

SEQ ID NO: 90178 - DNA, 1057 bp, Homo sapiens
cctctcagcatgtgcagttgaccagagatgtcttttgctattaattacaatatattggttatttcagagatgaccacaagatggcagtattgacctttttttttttttttttttttttttttttttttttttttacattttcaggcggcatttattcttcagaatctccttgtaattccaatgcctacagaaattataaaggattatacttggcaggtgggtgattttaaacaattatcaacctagtagatgtttcaaattaattggtgataaattttcagtataagtagtatatttcattattgatgaaactatatacaagacagcaagggcctcttaaaatagaacgtagaatttgttcttatgccgaccagacttaaaaattcttctctatagtgttcacaataatttaaagcaaataataatagttaacatatgtttactatgttttaggcacccttctagaaatgtaagacatagtaacttgtataattgtttgagttgtgaactgttactatccttattttctaagcttaggaacttttgcatagagagtttaaatagtttgtcctaaatcacacagctagtcagtggtacgcctttgctttgagtctaggcagtctcttacccactttgctgtattacttctctaatttagtaataataaacaaatttgtagatagttaaatatgtgttgatgttaacatctttttttccttttctaggttagtgcacagtgcgggttatagtgtatcttgctttgttttctgttgggttaactttctttttcatgttctgaatatcacatcagtaaatggttacctaacatttttatagcttacattaaaaaaattctagcttcatgggatatatgtacatgtttgttacataagtatattgcgtaatggtggtggggattggggttctcgtgtactcattacccaaatattgaacattgtacccagttaggtaatttataacctcagccgcctcccccactccctccttgggagtctcagtgtctgttatgtctgtctttatgtccatgtgtattcat

SEQ ID NO: 90179 - DNA, 1048 bp, Homo sapiens
ttgaccatgtatcaggcaattcttatttccaatatcaaaacaaaagcctttaatttttcacccttcagtatgctgtttatagtttttttttgtcaattaagaaagatcaagttaaggaagttttcttttgtcctgttttgctaggagctttgttttttaattcataattgtatattgcttttttctgtatcttttaagataatcacatgatttttcccttatattccattactgattgattttaaaatgttaaacaaccttgcatttctcgaaacatttcagttaggttgtgatgtattactctttttatatgttagtggatttcgtttctcaattttttagaattctgaagtttttagaattattctatttcctcatgtaaaaaagtttttcgaattttgcatcttttttctcttaaagaatttgtcaggtttttaataatcaaaatcattccgttcttatgactaaaatgggagaatgtgagattgtaagaacgtgactttttcaaccattttaaatcttttcctttatataactttcttttttggaatagctgatttgcattggtgtgattttgttctctaatgttaggtagaatttgatcgtgaaacaatcttggtttgcagttttctttttgggaagattgtaaattgtgaaatgaaatgactttttttttttttgagacagagtcttgctctgttgcccaggctggagtgcaatggcatgatctcagctcactgcaacctctgcctcccgggttcaagtgattctcctgcctcagcctcccaagtagctgggattacaggcgcctgccaccacgcacagctaatttttgtctttttagtagagacagggtttcaccaggttggccaggctggtgtcgaactcctgatctcaggtgatccacacccgtcttggcctcccaaagtgctgggattacgggtgtgagccactgcgcctggcctgaaatgactttttaaatagatctaaaatcgttcagagtttctttttatgtgtgtcagccttagtaagttatgtttttgtagaa

SEQ ID NO: 90180 - DNA, 1082 bp, Homo sapiens
agacctggattgcattgtattgtgttcatctcctaacctttgaagataagagtctatgcccttactgctgctatcatagaaagaaaaactccaggatttttatcatctgtaataatagccaaagagaaatttttaatttagttattgcattgttgaagggattattaataaacttgtaacaatttattcttagaaaattttacctcacaaaagcaaataattaggataagacatggatgaaacaaattgaatgtttatttctatccatgttataaatgagttgagacatcagtgaattgattaatagctgtgatacacctgccacaggctgttttgttttgcttttgttttgttcttaagtaaattatatcatttttctttttactctcaatttcatgaagttgattgccatgtggcggtcctttatagcagttaattgagaaggctctagcttgtcaatttaacatgcttaacttgtagcagatggttgcatttgcaacaagactgataagcaaccactgcaagcaggttttcattttattcttcatgtgactttagtataaaatgtataactttattatttaacataaaatgtgcagtttttaagctgctaggttaaatgagtttccaaaatatgaattcctttattagtttagctttaaaaattagtttatctgattaggctttccagtggtgtgctggtgcccactaatgcagccttgtgagagagctgatggttgaattttcaggatttttgtaaggtgattgttaaacacagccattcttaattatataaacttacaattaaataaattatatgaagacaaaaggtaatgaatatgcaaacatcactttctaattatgtggcaacattttactgttatctttgttcttgaggttatgcatacatatgcactacaggggtatgtattttatggaaataactacaatggagtaccactgtgcatctcttcacaacttcatgttacatggtagctccacattgtctacagtagtatatttacaccatggaaattgacaaacacaataagtcagcactctcagttacatatttatcagca

SEQ ID NO: 90181 - DNA, 1065 bp, Homo sapiens
gtttgatacataggtatacatgtgccatgttggtttgctgcacccatcaactcatttatattaggtatttctcctaatgctatccctcccccaacccccaactctgtgacaggcccgggagtgtgatgttccccgccctgtgtccaagtgatctcattgttcagttcccacctgtgagtgagaacatgcggtgtttggttttctgtctttgtgatagtttgctgagaatgatggtttccagcttcatccatgtccctgcaaaggatgtgaactcatccttttttatggctgcatagtattccatggtgtataaatgtttatttttaaaaacaactagtgtaatacactgttagctttgtttgtagtgttgttattccataggcttttgttctttgggttagttttgaatttttccccatacgtgatgtatgtactttaatatttatgagaaatgataactttgagtttatgtaaaaagatttttatggttagcacttcttgtcttgacattagtggaaactggaatgagagagttatttgaaaaaacatattccacatatttttagttttaacaacaatcacacagactacagaaaagaagactagaaaatgtggaaagccctggttaaaaaaaagatcaagaaaaactcgttaaagagtattccttcaatattgttaacatttcaaaagtatgccttataattttggtatgcactatattggggggcaatggaaatttttttttttaagtagcagctaaagattgttacaatgatagcttccacttcaatatcagtatgtgagtgtatgtgtttttcctaatgagaatataggagaaaatttgtctgcaagttgttaaatacttgtaacgaatatataatcaattacagttttgggttccggtaacatttgtgtgtgcgtgtgcacatgtctatacatataagatttttttatgtatatacaaaaacttctttattacaaacataatatgtgaatatatgcttattaaaaagaagctcaagttctccagaaatatatagtgtattataatcttgttccttttat

SEQ ID NO: 90182 - DNA, 1085 bp, Homo sapiens
ttactagaggaaaccaatgcgtgaaactaagcagatacaaggtcttgtatgtacttgctgacgtttcatccactttacagccaagttattccttgccagatcagcctgtgttacaggactgctactaagtgccgctcagtagtgccctaggcaagttggagagccatggagataaatagatggtaaaaattatagtgcattcccatcttctctttagaaattgttagccttccagagtgatccttttgtaaacatctgttctgaatattcagtttttcataagtatagtaggccagttgtctcaaataccagagttatgcaggtattttaatcccatatagctgtgttcttacttggggaactgaaaacatatcctttctttgactgccattaatataagcattgttttaattaatgaaaagaaggagaatgatactgtttttcttccttctctgtcattgcaacatgaatcttttctattattatttttaggtaacagtggttagattttcccttactgaaaaaagaaaaaaatgctgagtcgagatggataagcagggataaagaggaatagttggttgaaaaggctaggaagaatggacagacattcttttcacaatggataatttgtgtttcccaaaccttacatcaggaaaatacagcagcttatttatagacagatcattggactgaaagataaggaaataggtggaagttaactaaactattaagagaatggaaggaggaaaattatagtctttaaaatatctctgtattgtagagagtaatgttatgggtgatccaggaagaagtagggcagagggagttaacgtgcttgtgttctcaggggttgtcttctacacatgcagaaaagctgttccctgttaattaacatgctagtgtggtactccttacttgaacaaacccccagtttggagaattaacacaatagggggcatttcttgtttgtttttcgggcccaaggtcctcagtttaataaagacattctaaggcaggacacccccaggagcatagtgcaaggaaaggccagatctttctttgggtaagataagtctctattatat

SEQ ID NO: 90183 - DNA, 1050 bp, Homo sapiens
ataaatatatatagtatataaagttatgtctcccataacttgaagtccttgaagtcttttcatgttgaatttttctttcccaacctttgtaagtaaaatgcaaacaccttaggataagtttcttactgtgtttatgtcctttgtgtctgtcatgatgaattaactttaagagattatggttgtctcagccgtttgtttacttaatttatcatgattatgcttgtggcagaaagtaatataatatgtatctcctacaaactaagaaactgttagacaggagaatctttttcattctgtcttgttaaaaaaagtttcaatgaagtaaaaactaaaatagaaatgggattgtaaacagaagaaagatggatcttttggaaaaatcagtgttgctaatttaaaaatactttttaatattattttacaggaatgtttaggtgtccataatgtcactaaacccgtgtcttcactttgcaatggaattcattttctacttcatccaaaagttctgtatgaaatctctgtatttggcattcaagagcccgaaagtgaggtatgacattaaacatgagtgaaaatattacagtaacttagatactcagctaaatcaaggtgatattctaatatagtttagatagcatggtgagaaactaaaaagaaacctgtctttggtgcattggttcagttgaagtgttatttaaataaaaataaatgttacataaaatgtgggaataaaaatacaggacacacttgatttcaaaaaattcagatcagtttacttacatttttcatctaagatgtagagaactatacagtacaggtagtaagcagattatttcagttagggaaatttttactcaagggacaaatgtacattaaaggtaaaaaattagaaatattaaggaagaaaaacagaacagaatgtaagatgatgctgtggaagtacgaacatttgaaagaaagagatgttaattatagcatctttccacatgctataaaatgttccaggtgtgtcaggtgacctagcgggacatctcatttgactggtttatc

SEQ ID NO: 90184 - DNA, 1089 bp, Homo sapiens
tcaaaatgaataatccttggatttttatacatttgtttttggtatccatccagactattcacacacattgtttatttatctttaaagttttaattaataacttaaactgagagttttgtaacttttattactttgtacctttttcttatgtggatttttagaaaagactgtgtattggttaatttattttgaggacatcagcaaatttctatttagaacttagtgtctttattgcttttggaaagaataaattctgtgatgtgataatcattaactgagtaggggattttaaagacattttgggtttttaaaaatactctttaagacagaacctcctctgccctgaaacaaataagtgcttaggtgagtacttgctagtattggttatttttaataagatctcagtttgaggagttggagtaggaagaaatcccttccagtatgctttgcagtcttttgcttactaacttacttgcctcacatgtcttggttgttttaccttttcaccagctggaaatctgctcaggccagtccattactacaaggagaaagtcagaaggtgcttctccatatgttgtctcacccattgccacgagtgaaagctgaaacttaccactgctgtctggaaatcacgaaggtgaggttttgttttttcgtatgttttgtttttgagaacaaatagtagactctcttgttataccttcaaacttaatttacttgaccttttgtatgagatataagaactatatcccataaaagtagatgataattactagtcaattctggaaaatttgtactattaaattctcttaacttagtaagtccagcaattgaattgctttatttgaagttttattaagaattacatttatgttgtattaatgatggaaaaattataaggaaaattgatttccaggtattcaaaagtgatttctatgcccaggaaaccttttaggttgttgtggcctagattttatggttttaattctgttttttttaatgttattttttatttttcttttcttttgaaatatttatttttctgtcttcttaaatgataaaatatttcagcatagaatattaaatatt

SEQ ID NO: 90185 - DNA, 1052 bp, Homo sapiens
tcccaccttggcctcccaaaatgctaggattaaaggtgttagccaccgtgcctggccttgaacttgatatttatgatttttcttacttaccactgtagtttgttttttttcccctttccttttgccatgttagtaccactgtcttcttgttttctctgtgatagaattttgaattgtgtctttaagttgaagtatttctgtggcttttttttttttttgagacgaaatctcactctgtctcccaggctggagtgcagtggtgcagtcttggcgcactgcaagctccacctcccgcctcagcctctcaagtagctgggattacaggctcgtgccaccacaaccagctaattttttgtatttttagtagagacggggtttcgccatgttggccaggttagtcttgaactcctgacctcaagtgatctgcccgcctcggcctcccgaagtgctgggagccactgggtctggcctctgtggcattttgtgtggtcagttaatcacacatgtgttcaatgtcctgtgtgttcctagtggtcaggctgctacaagaggcaggtttataataaaataaatacattagccctacttttattaggggaggtagagctacaaagaagtaatcaaagaaccaggcaacttgattgtaactttaagcttactcagagttaaataatagaaagtctcatgtggcatttagctagggaattttcctacatttctccacctcggctgacatttttaggttgcttgatgagaaagtggacttaaacaaatgtaaacagtctcatggtctctgaatggtctaatttcttgaagctgcttagttagctgttgagaatatcattgcacatgaacttgacatttattgttccattctgcttcttttgtagggagagaagaatctcttagaattagtggagctggcagaccaagccttgcgtagcttttcctatcatcagcatttcccgctaataaaggaaatcatcagcatttgttcaaagatgtaatattttctttcttaatgtgattacgttattattggacacttaggg

SEQ ID NO: 90186 - DNA, 2418 bp, Homo sapiens
cctcctcccaatgcacatgaggtgatgttgctgattattttttatctaatggggtgatggatttgcactgaaacatcttcacttttagttctgatggcatgtgactaatgcttatatatgcaggacagctatcttagattaggggtgtaaattgtgattagtccattgggccatgtaaagattagctaatgacattagcatggggctttgagttgttgagatagcaagagtttcaaatacaagtacgcagggtgaaacattggaattcctttgtggtgaagcgagaaaaggaaattaatatttattgagtgctatatgccatatgctctgcttaatgcttgtttaattctcacagcagctgttatttttctgactagagtcagagagaactctcttaaactagaacacagtgcctttagagttagatccattaggatttactctcttagcacagtgtaaatcgcctttgctaatttctctttatcttcctaactcttcaggagtggaaccccaggactgacagtagccctcatgaaatatatcccatttgtgattgttaaatgccatctatttgttgatgcctgccaaatttatacttccagaccagacatataacctgaactctgaacttacctgtatccagtgtcctttttgatgtcttcacttgggtgacaataaatgtctccaactgaacatgtcccaaacttcattctttgtttccccttccaaatatgttcttcctatagtcttgcctgtctcggtaaatgtcaactttgttgttcaagttgatcgttgatcaggcaaaaaccttagagtcagccttgattcctttcttttgctcatatgtggatataatccctgagcaaaatttgtcatttctcccttgaatacctatacagaatctgaatacctgagttaagcccaccattctgtcctgcctggattactgcagtaaagtcctctgtctcttagcttccacttttgcacattaccatcagttctctacagaccaattttgatacttgtttaaaatgttccagtggctttcagcagaggacaattccttatgacgacccaaagccttaactgatctggcccaccactcctttctgactccatccctcagaaccagctccactggctttcttgctaccaaataatagtttttgtaattgctcttccctcttctataaatgctttccctcagatagccacgtggctcctgacccttccagggttctacttaaatgtcatcttattagcgaggccttcctctactactttggagaagtagcagttccctgcctccactccccattacttctctgttcctcttcatctttcctatcctgttttaaaacactttttagccacacctaacatcttaggaagtatatcgatttacactctactttcttcagtgggatgtgagcttcatgcgggcagaggttgtattttgctctctgctgggttcccaggactggagaggtacctggcatatagtggaggaacatagtaaggcctaattaatattcaccgagtgagtgaataataggtgagcagataattgagtttctctttttcctcccccgcccacaaaaaaaaggaaagttcttcacagaataatgaaatttctctttactttctaatagctgctgttttactaatctggaggtttgtcatgtctgtgtaatctaaaattttgatttctgtagtttctgatcttcatttagcaactatattcatttaaaggtatcgttgtttagctgattcagctcttagactttcaggtagttaatgattatccttgaaataggttatccatgaaataaatcatgaccaaacccacttttgtaaagacagcatttcagccgtaatagtgagtcttgtcaagagattttctctgaacgtcaaatttttagtcctttttattcctttaattgatatttagaatcctgtcacaaaactagaaccatttttttaaaaaccataattctttcagttttaaatctattgatttaaggttataatgtgtataatatttcatttgggcatattgattttatactaattaaggggctatcttctgtattttagaactatttaaaatattatattggatttccactatcccctctaaaagacaaaaccaaagaaaaaaattcgtttctgttcaaatcaatctatagctatacttgatttcgtgttattaatatgtcattaataagctctgtcatgttcagctatgggatggggaagtgttcttgtcttcagtttatcaggttattggggagatttgcgtacatgtacagaaaatacttagagaaaaaggcctcatgccttagttcaatagcagaggtatatacaaggtgcagggctcaaggagagaagaagttggtttggggaagaagaaagtag

SEQ ID NO: 90187 - DNA, 1254 bp, Homo sapiens
ctggggggtaattttgcttcccagaggatgtttggcaacgtcgggagccatttttgattgtcacacctggagtggtgctgctggcttctagtagatagaagccagaacagctcaccacaacaaagaatgttttagctcaagatgtcagaaaaccttgaggaagtgttaaggttgagaaaccctgatctagaagaacctttgcttggggttaaactctgctcctgagatgtgatcctttgggacctctattgaatgtccaaagtgatgattgatgactgtctactctgcctggttgaagactgagttttattgtcttgtgtgagccctgggagttgttcaatttaaatctcagtaatcatctttggcctgtatttacagagtatctacctataatctaagccacctaatctcagcatggtctgggtggaaacttgtttaggtctctgaaattctttctttgcatagctctcccacaattcctaaccatgtcagcttccacaggcatcttcatctcctaaagtcatcgagactgtcagactctttggatttctcttgcctgtgtttgctgtacagtaattgttttcaggtatagtaggactctcattgcttattttccttctctctggcatcacagtcctgcaatgacactatgccactttctagttgatttctggggaaggacaggagatgtccttgttattatttcatggccagaattggaagttttacgtaaagtttttaattatgtcatttaagcaactggcctatctgtgagttattaggagcttaaatgtacatttatctagagtgaaaattctggatcaactttagaataatcattcaaagtgtggagagttcaggataccttgttttttgctgtttgtatttcagtagagtagataattttagaaaatatggaattaaattttgttttttttgtaagaagtgttttgataagtaatattttgcatgagtaatcaacatgtgtacagtagtagccttaagaatgttatattacaacataatatttaagagatctatggaataccagagtatgtctccatgtaactggaaaacatatcttttttaacatttcaaaatatcataaatcatttgtcatttaatatctttcattttgaaattgtcatctgataaccttgccttccttgaagatttggcattctatctcttctgttaatgtgaattcctaatgtctggtcttccttcctctccctttcttccttcccctctccc

SEQ ID NO: 90188 - DNA, 1049 bp, Homo sapiens
ttattctcaaaatctatacattttcaacgtttgataaactcatcaggatataaataagataaccaagttttgccctttttactttatactggcaaagtaaaaatatatattccaagttaatggttctttaagtcccatgtctattttttgccacttggaggtgatggaggagaaagaagcaggaaggtatatatttggaaaacatttaaaatgtttttatcctgaggaaaactgtgtactcatactttttactcagtaagtgcttctactagctggaactatatattaattcatatactaataatgtgaaatgaagaaagatctgaactttggcatcataaagtacatatgtttatctgtctggtaagctgagaagaacagtcttagactttaatgattttgcatttaacctttccttaatttgctttaaaaagtcagattgataattataaagctatatcttggtacataaaaactaaatgttctcctgcccttttgtggtaaattatggcatgatttgtaactgttcaatatcgtaagagatttgtaagagaatttggtccagctcttctagtgaaaaaattaatctagatccttccaatctggtagtttgttttactttgattcattagaacttaacctttgggatgcggggtgggaaagtctcgtgtgaatgttcgtctcacacaggataatggaagtggagtctttgttattctgtctctgtggagaaaggaggttgctctggtgggtgtgactttgggaagtttttttgagtttaaggtgagtacaaatagtttctttagcaaatgttagcatgttcatttattcctttagttgctccagtccaagcttagcttcccaggcaactcctgtgtgggaaaatactaatttatgagaaggctcacgccttctagtactaagtagaaattattggaatacgttttctaaacctttctggtgctttgtcacatattacgtgtaaaatggatggtccctaaattcgaaaaattattttaatctatctcacagtacttgttagattattg

SEQ ID NO: 90189 - DNA, 1505 bp, Homo sapiens
acaatcgattgccaaattcaaggtcatgaagatttattttttccgctaagagctttatggctttagcttttatatttaggttgttgatccactttgaattaatttttatgtacagtatgaggtagccattcttggagagttttaagcagacgagtgcatgatctagtgtttttctgctttggtagtctctaatgttgtaactgaatgccattgactagaaggtcccatgtaatcaagtcagttagatataaacctaaatgtactaagtgaatacttatagaaaagtttgatctttgcttttgtttttacccctgtagaaggattcctactatcttaatttgttaatgtttttggaagaatgatacataaataccacatagtcagaagtctgtttctactaaagaataattttattttttctttgtttccccagacacagtttcccaaaattcttctttgtcttattgtcatgaagcaagaggtactcatcattcccagaatccttccccaggaagcagcagccctcggccttctgtggttgggcgcacaggccagcgacccagaggagatggccaggactgggatgcagcgtcctctaggtgactgctagcagtgtctctggggaaatgagaaatgccggttaacttgtgtgtgtgttaatttcagaaggagataattatttttctgtccttttttttttttttttttttgaaacattaacacaggtataggccttgtgttaaaccctggcttcatactttttttgaccatgatccacggtaaggacagataaatattacatcgcaactcagtgctcagtacttgaacatatgctctgtttatgtatatatatgtgtgtgtatgtgtcccccaaaacaaaatgttcacataatagtattctgatactatgtttgacacactgaactatattttcagttccgatttcattagaaaagaaatgattctgacccaataaattgtttttaccagctgcaaacggaatatgatcaagtttaaaagaatagctttaaatgatagatacattgttgatagtattttacacatatttttgtaagtcttataacaaatggataagtgtttactgttaaaaggaatggttggagaattttataaaataaggactccttcaaggtgaacaatttatggtatttgtttgtgtaaatacagatttttttcttttttttttttttttttttgagacaaggtctcactctcttgcctaggctggagtgcagtggcacgattatagccttgacttctgggctcaagtgatcctttcgcctcagcctcctgagtggctgggaccacagatgtgcactaccatacttggctaagccttttattttttgtagagatggggtctcactatgtttcccaggctggtctcgaactcctgggctcaagtgatcttcccatcttggcctcgtaaagtgctgagattacagacatgagtcaccatgcttggcccccagtgcttggcaccc

SEQ ID NO: 90190 - DNA, 1019 bp, Homo sapiens
ggaaaataaagaccaatttactagggctaagtccagattacaggtggatgccattaagtgatttttaataatgacatgaattctcttggaacaacatattcgagaggcaaagtgcacatgggaaagggttaggaggttgtatgatctctcagttttgagtcagtcccaaaggcagagatggcgataatttctaatgcatgcctgtagatagtgaatggtggatagtataatggaactgggctgagagaaggggtgtgatttttttggggtggggagtgaacaactgccaatcctaggtgggcagaagttgataggtgtcctctgtatgggataagaggggagtcctaatctgattcaccttgagtggggaagatcagtaaggactttaattcttagaatttgcctctgtacttttgttctgtctcatttcttaatttatttggcagatttcctagaattgtgtgctctttgacctcattgaactcgttttgcagacttgtgataatctctgagggtacagtgtttagtatgatgtcgttcctgctcttgagagggtctagtggggaatgcaaaatcaacaggcagttaacaatatcacaaataatggacaaacggaaggagcactgccctagagttgtttattggttagggaaaagatctaggaaggcttttctggagaagtgatatctcagctgagacccaaaagattgttaatggagtcattgtgtcagtaggctacttagaatctggaatagatgaactcttcttaaaaatgattaacgctatgttttgtagctctttaagaagtagtaaccacactttaatctggaacacctgtgaactattgaaggatgttatcatgcaagattttcctgctgagattttccttcaaaggccaaaaattgttcaggtcagtgccctctataattgttttagattttgaactagagaactttttgcaataaagcaaattttgcagagtaggagttcttgggaaggaactttgtactcatgttttt

SEQ ID NO: 90191 - DNA, 1871 bp, Homo sapiens
tctcggactttgtgtaaacttcgcggttcgcgtcccgaaggcaccagtggcctgcttctgaaaaaaactggtttattccgtcttcacgccgctcctgcccacagcataaataacgtagtctctttgcagtcgggaaataaaatagttttgtgccgttcgttgacaggtcatcagctggccgagatcagggagcgcgctctcaagagtattctctgcaagattgagcacaacttaatctgctacgctgatctcattcaggagaggcaactttttcttcatttgctggaatggttcaatttcccgtccgttccgatgaaggaagaggttctgaacctgttaagcagattggttaaggtagggtcattttgaaataaagaaaataatcagacgagtgacttgtttcttagtcatttaattgtagcgtttattgaaagttaaataattggggttaaaagtttttttaatcaaccagagatgtttaattttaattaatctgggtatatggttcatcttttatttgtgatactgaatcccacatggtctctgctgtgctcagaagtaacacagaacttcttttgagttttggtatgttctgtgtttttgagttatctttggaggttaatatttgtattctgtttttgttttctgacatttacatcttaaaaactagatatgtcagtatgaaagggagcactttaaaaataatgttacataaccgtgattcataaataccaatgttaagttgcttgcccatatgcttttagattggtattcttatgcctacctcaagagtagttagttatcggggtcagatatcaaagtgtaagtttaacctttcaaaactaaatcactgtacaatggtagaggaatcttaaactactttgacatcctgttgaccggttggggctgggaccataaggtgagtgtcagtggaaaaaagtaacccattaaaaaaataagagtagggattgataatgtgcatttctagcgttcagtgtgttggctcatctttcataaatgttatcaagtgttggatgtatgtctctataggtgtatgtgctcctcatggaagtgccttacttcggggcagagccatgaaggatttgtttttcagaaaaggaacatctgatataccaaaaataattttatgttttgattgctgtaagttatagagattttgatacagttattctcaagatcatcctcttcttattttagtatcccccagcagtccaacatttggttgacgttggtgcagtagagttcttatctaagcttcggtctaatgtggagccaaatctgcaggctgaaattgatggcattctggatggactttttcttcttccttcggaagttcctgcactatcttctgcctcataccaaaccaatcaaactggtaactctttggaatctgttaaatacaaatatattaattctaatggtaaattttaaggaaagggagattagatttttttaaaaaggatttctcccacctcccccaaacttatttttcttgtgttaacttacatgattttgacctttttcccctcctctactgttagtcaaaggatggtacatttgcattaattgctttttgggtcaggcctaaacgatgccagtgactttgcttttatgaggccagtttgacagattatttttttggcaataacaatgtatttttattgagcacatgagtgctcattgttcttagtgctttatatttgtatttttgaccttgttcgtcatattggagtataatgatatctgtcctagctcatgatcttgttgtggggaccaatcaaaacgacataatgcaagtatttttatatgctgcagtccatcatgatatacttgttaaaatccaagtcaaa

SEQ ID NO: 90192 - DNA, 1083 bp, Homo sapiens
agtaatagtaataattcctatttaaagtaattattactattaattcttttctgtgtccctgacacatcccagggggcctggccactgagtaggagtccgtttttcttgtcagttttttttgttgttgttctttggaggggagttccctcaatttttcttttattggatgtttactttttggctgtgggagttttgttttctaactgttctcctcaccccctcttttataatatataataatggtaataattcctatttaaagtaattattactattaatttaaaacataatctgactagtcaaaagtagtattctgattaatcagccacacctgtgttagacttgaatgtttttgttaaggaagcctaatgtgggaaaagtgtttgagaccaaaagagcaagagaaatggaaatgaaagcagtaagtgaatgggcgccttcagaaggattgctagtgcaagctgctagactggtaaggattacaggtggtcacagtgttagcagcaattgcctgacctggctgtggggtcattgcagttcattggtgggagaccgagaacaaaaaagatgccgcacttgccttctctgcagagccttctgctctgattatgtttgttctgatactgttttatcactcctaacagcgaacacactaaaatactttctaaaattgttaaaagggcatcacacttggagactggggagtgatgattatcttattttccatagcatcggactcttgagtatagagaagaaaagaaagaagacaggatatatctgaaggcctggaaggcaggcagtaatctgaacatcagtaagtcctaatggtgtcattatgccatcctgaaattttccagcagataaatttggtcatctggagaggcatccatttatatacagcagtttgtgacagtctgagattatacttaatatacacacttgtgcttaaaatacctttttgaagacaggaatgtatggctcctattagataagatttccatcaaaaacaatttcaatagttcagtgttaatctttagacaaggtatttttacccagcgctctgggtagctgattatttggtgc

SEQ ID NO: 90193 - DNA, 1034 bp, Homo sapiens
ttttcagttagttttacatgcatgttgcctttcacaagttagatatttttgctttagtagttcattacatttaagatattttaatatataaacaaattacttttaatcttaaagcaatgaagaaactattaaaacactttgctacagtacagaataaaaacaaaacatctttgttcataatttgtcaaattctgaaagaatcttacctacttggtagtttataattcatgaggtcattctttttcatagacaattaatgtggtgagatttttagggaatttgctatatttttagttaaaataattttgtttacattaaaatgttaaataattgttttttaatttgtcattgtcagctataatcatatataggtgaatggtattaaaagaactatatataagatagtattttacatttatcattctggaggtcaggatgtattatatatatatcagaaagtattacaatagctgtttctaagccaccaactgtaattataccttagccaataaggttgcagatgtggacatcattaaggatcttactagtagtaagttggggtgctgtcttttcagtgtgcaaatgatttccattatcaatgttgcccaggtctccactgatttagagttaagatacctatattaatttgttgaaaagtgtcatagttatttcataggagtctcaggcctgatacacacagtggtaaagataaaaggctgatttatttcttgtgatgtgtttccaacaccaacaaccacttcttcagtgtgaaaactgagtgtccaggctgggtgcggtggctcacacctgtaatcccaacactttgggaggccgaggtgggcggatcacttgaggtcaggagttcgagaccagcctgaccaacgtggcaaaaccccgtgtctactaaaaatacaaaaattagccaggcacggtggcacatgctgtaatcccagctacttgggaggctggaaggagaatcgcttgaacccgggaggtggagcttacagcgagccaagatcatgccattgcactcc

SEQ ID NO: 90194 - DNA, 1045 bp, Homo sapiens
agtggggaaattgttgggagattaagtgtgccagctgacggtgggggcccttgagcaaggtagcagaatggagtagatggaaacatggtgctgagtgggtagatgggagccgagtccaaggtcttctgatgtcgttccttttcttggtgaaataggaagttgggccatctgctgcgatattaaatgagggagtgttccaggggtaatgagagtgttccaggggtggagaaaagagagggaaggtgtgaaatggtaggccgggaaggagaagaatggaccagggaaaagtagtttgatttccagacagcattaaggacccacctgcgggtcatggccttgactacaaagtgagacccatcagaccagttctctttttctccagccttatttagctctatgggtgcaggcatgacataagcggagttgaatttactaatatggttttaccaagagagtttttcaggagagtagtggaagggaatagaagtatacacaaggaaatgattacagtgatgaattgtggaatataagctgagtaggaagggaagagggtcttgaaaagctggtaggcttatcactcttgtcatttagactttgaatattcaaagccggttcctaactgtatatatatatacaccagtataaaaaaaaaatttaagtcagatttgcaaaaagttattttgagcaggtaaagaggaggaggctgtctaggttctaccaaagccaaagaataatagtaaaaacaaaaagctacaaaaaaacccaatagtctcatcttttgatttattttttgtttggcagtcatggtataactgaaagccaagaaaaggccctgcatttttaatggatttactcaaccatttcctttaaaaaaaagtaagaacaaacaagctcacaggttttattcttataaaaacactgcatgttcattataggatgttttgaaaataatgtttacaaaagttctgccatccagttaacagttctgctgtactttgtggtccagttttcctccctattctttctatgtaattgaaccacatac

SEQ ID NO: 90195 - DNA, 1014 bp, Homo sapiens
ataatcttgggtaatggaacggagatctgcaacatatcttttaacaacacttttttctaaattatttctaaggttgtgctaattcttttggttgtgaaaagttgaatttttctgttgccttcgttttcatcttctagtttgtctattttaataaatggccttacattaaaaaattgtaaagaaatgtataccaccaatttagaaattgttgccttttctgtaattaaactcgggtacaaattggcataacatgaaaacctatggaactagaattattattaaagaaatattagatgatcatagcttcctgtgatagcatttttttgtgtgttacctatccttttggtaaaatgttttatctgtgatttctttagcttagtcaacattttcttgggtgaacttgattgtcaactaattttcataaatggactggattctcttgcaacattaatgtttataaaaagttttaaattgatttgaatagaaagaaaacattgttttaaagttggatttatatttttcttctatgtagttactataaaagtgtgctggatttgaccaatccttacccccactataaagagaacccgtgatgactttagtttaaaaattgtggaaattgtggagcaatttttctcacaatgtgagaaaaattctaaaccatattagataatgtggaagtcatattgtctatcatatatactgccatttaaaaataggtttttaaaatttagctaagtcttaagtaatttgccgttgctaataattttatctccttgagtcggttgttggggagagatgttatattcaataatttttagttattttgtaatgcagagtgtttattcatttcacagttctgcaatggatgtagtattttgggattgccctgtccagaaaattttcagctacacacctttaaaggaaaatgtttctatctcagatgaaacatgtaatttgggatggttcttcctttgtcacttaaaggaagagataggaaaagtctcttaccca

SEQ ID NO: 90196 - DNA, 1046 bp, Homo sapiens
tgccaccacgcccggctaatttttttgtatttttagtagagatggagtttctccatgttgaacaggctggtctcaaactcccgacttcaggtgatccgcccacctcagcctcccaaaatgctaggattacaggcatgagccaccgcacccggcctgagatattcttaaagtcctaagatatgatcagttctttacgtcttccaaatgtttatattaaatatatatatgaatatgttttaaaatacctgttaattacattattcaattcttgtaataataaacacttgcatagtattcactctgggccaggtgccgtttcagaaattttagataaattaactcttaagtgagagccctctgaggctggagctgttactactaccgcaataaacttaatcagtaaagttaaggcagtgagaagctaaatggcactgctagtaagtggcaaggcaagggtttacactcaggcagtgttatttatattctaaaggccatgtggcttatgtagactttatttcaagccacttacgttattttgaaagagttatagcatgccatattaacaaacaaaaagttttatttgctgacaaccctagctaactctcaatgcttaacatatttatgatatttctctcctctgctacttctagttactccatttttgcttactttgtagaagttgtttgacaatattgctgacatttaagtattcttgtatatttctttatattggtgatttccttatttcgttttttctcctttgctgcctttttattctaaaggtttaagagtcaaaaaatgactagattgccttaattacaatggtttgaatgagttagtttggttttctttttaaatctgtgttctctttatatcctagcctagtttctgggaggtgcaaggcactgagtgactcattgggacctgctgagtcattagagagagtgcctgagggacagaggccagactgcaacttaagctatctggaatcttacctctgctgtcttactggctgtctacatggggctacattttaactatggctt

SEQ ID NO: 90197 - DNA, 1029 bp, Homo sapiens
taatctcaagtatttggtccatgtttcacattttatttcttgtgttcaatcttaggagtttatttcaccagaaggtagaaattacatctggtctccctgacagacagagattgagaacttttgagaataattaggccatctggtgctataaatccaatggaaagttatgatcagtggatcatggcctaatctgctcttcatccattgcatctgaattatcttggcacaaaagaatgacaaggggctggatttttaaaggaaattgccacatctccccagtcattagcaggcaaaaggcatgcatgcatcagactgtgacaattagggaagacttattctcccctaaggcctattactttttgatactttttatcttaatggagaattgaaatgaacctaaattttttccaaaattgcagaaacatttgtttcaggaaaaaaaactccccaatagatggtgctggtgctgtgatttaaaccactgcatcattagtatgcaaaaaagctccagagagaggcctccgggaattcccttacatcaagttatagaaagacaagaatgtggctttatttttgctaaatgcaaattgacataattgtataatttgaaaacttcagaaatatttcttgatgttttgaggtcaagaaattactcctcgtttcattgttcatatctcaaatatctttgaaacataaatgcaaacacaattgaatgctgcaaaagatgagctgagaggccttccaagtttcttcctgcataccgcttcaagggtctattagtgaagctataatgtgaaggttatagtacaaagtataacagattcttgcttcatattgatgagaaaaaaaattgcagatgcaagaagcattttggcagaatgatgctgccactgatgttgacaatgagcacttaatatagctagacatgatactgagtgctgaacaattatctttccatttaatcattatgacaaccatacaaggtatactgttaccattttatagatgatgaatataatgttcaaaaag

SEQ ID NO: 90198 - DNA, 1250 bp, Homo sapiens
agcatgggtgcagagctgcagttcagagcctcagagaagcaggtttctcagaagaggggaggggtcggcctggtggtggcagtgaagacccaggaacacaggcacactgcttctcagggtgatgcggtgcctcacgctcggaagcgctgactggttgttggtgtgatttgtgtcacatctgtagccactgtactttaacttccatgaggagagggacaatatttgtgacacatttctctgagctcccagtgctaagtcctaaactgagccctgtgagagctcctgtgtatatttgagaatgaatattaagtgatgagacacacaaaagcccaagtataatctaggttatgaagtaggccatgaaaaaccaatgatagtattctggattttgatgccacacgcagcatttctagtgagttttacagagtcacgattttctgtgaaaatcaggtctgattggcctttttatccttgtcaatctgtgtttattttgcagagttgttccatgatggacgtaactcttttggatgaacatgggaaacccttttggtgtttcagttccccggtgtgcctgagatcgcctgccacaccctctgacagctctagcttcttgggacagacatacaacgtggactacgttgatgcggaaggaagagtgcacgtggagctggtgtggatcagagagaccgaagaataccttattgtcaacctggtcctttatcttagtatcgcaaaaatcaaccattggtttgggactgaatattagcagtaggtggcaaattattgttgttatttagttgtttatttttgactggctttgttcttggtgttgaaaattaaaataaagcaaatctgcagagtgctgtgcaatgcctttcatctcacattagaaattatgatttatgggtcatttttaagttaatgtttgaaggattcagttatattttaaaaacaaaaataacagtgaaacttcatataaaaagaagaaaaggtatttacttctcttccgcccttcgttaaaaatctaagaacttttacttaagcaaatgatcatgtgatcactctgtgtgtgtgtgtgtatgtgtgtgtaggggtgtgttcttacagataacggtttttctttttctttattggtaagaagctcaaatgagaaaatgtacttaaatattaatataaatttcattatattcactagaattagaaagtgctacattcttgacagtcagcagccatatcggtatttaataaag

SEQ ID NO: 90199 - DNA, 1147 bp, Homo sapiens
cttgtgtctgtgtgagaccgagtggtgctgcggctctccctgccacaagaggcctgtggcagcagggctagtgtgctgtgtgggtgcgagggctcctccgtgtggccaggctgccagtagctggcttggagctggcagcagagggccagggtttggcctccagctaggtgggcatgtgcacggactctcactcagttacaagcatgtgcagaggtgttggtttatttcatgtgagtttcttccactcctcttcatgttcgcctgctctccagccccttgtttctttgccatttctgcacctgctttcttcagctgtgtaattctagatatcggtttccaacactgttggcttacccacatcagaagaaccctttcctccttcagcgaccacctttccatcagtgacaggtggctatccaggctcgcctcagccagcttcccctgactcacctttgacatcacctttctgggcacttgttaatgtttctgcctctgggacacagatgcatcactctggcctcaagccagaggctgggattgctgtgcccatgttgccctcatcgctgaggccagggcttaccagggtgaggtatccttataaagtcgccgactgaacgtgcttggtttgtcatcttgcactggaagacagtgattgaaacaatcttatatcttttcaggaaatattgaaaatggacatgtgaagctcattgttatacatttaaaaaataacagagaacacctacctcttattggaaaagttggcctctcgtggaaaactgatatttttgatggctgtataaaggtaaaaacagaaccgttttcttttcttcaagtaacttgatttctatataataaaaagtctgtttatatatataaattatattgtcatatatgtatgatgtttcttttatagttctggatttattgttctggtttctgaaggttggtgcacattctgttagccattgacagccagtggattcactcatgagatgcttattgagtacctttcatttgtcactgagtatggtggagttggaggggcaggtagtctgcagcagcatttcagaacactgttgatcacagtcccctactctctcaaagcccctctgttttgtggaaagagagtggaactgaaggttggacc

SEQ ID NO: 90200 - DNA, 1029 bp, Homo sapiens
gggcgcctgtagtcccagctacttggggggctgaacccaggaggcagagcttgcagtgagttgagatcgcaccactgcactgcagcctgtgcgacagagtgagactccgtctaaaaacaaaacaaaacaaaacgctattcagtgcttactctgtaagacacaatagaaaatgtcaagggtatgaaaaacaagttatgggcctcagaggtaggagattgtttagctctttagcagcagaacctgagaagtgcaggtgatctccttatgaaattcttctttaatgtttttgagtttttttcagttatttttgtatatatcatgttattgtcttttttattgttgtaattccaaaaataggtgacttttcgttccatcttgatattatcaagtttcttgatattaattttttttctgtgtctagttcagattatactccccaagaatttataataggtaaagcattagaaacagtatactcctttctgagtggtaattacctagaaaagtcaaagcagataattcattatagcatatttattagtacttgttagtacatgttttcttggtttgtacatctgatgacttattatgaaagtgttacaaattagtgtttctcatttgatgaaatctaatcaattttaaatttcctggttgttttttcctgttttaaaactttttctatcccaggttataaagatattcttctttgtttttcctaccattgttatggtttcagcttttgcatttcggtttgttatctgtgttttgtgtaaattagaagataagttgatgttctttcccagtgtggatgtccagttgtttttgtaccatttgtgaaaagactttctttgctcatcaaatcattttgatgactttgtcaaaaatcaattgcttgtaaaagtgtaggtctatttctgaaccaatctattccattttattgatctgtgtgtcttttttttgttgttttgagacggagtctcactctgttgcccagactggagtgcagtggtgcgatctcggctcactgca

SEQ ID NO: 90201 - DNA, 1042 bp, Homo sapiens
ctgtacaaattgtttaggtacagggaccacccttactggttagggaatggtgggtgagaacactcctgaaatccaaatgcctagaccacatccaagggccaggctggcaagcagatcttcctaagaattgacagtatgaggcctgctgtgtgaactattttcagcatagctgtccatgagcactttgatgaggtgatggtgccaccctgtgaaagagaagacaggaaatagtccagttgtgtctttgaagtgtaaatagagcttgccaaagggcctgatcagcaatgcaaagtatgaagaaatgtatatttatttgatctttgtatcaggctaatgattaccaattttcagaagctgaaggaaaaatgttttgcatggtacagtatgttgtagtatttttatcagtattgagaggaagaggaatactaaagaatctaagggaggtaaatcttaaataacaaagtatgctgcttctatcatttgagtttttctaaaaatagactgtactttttagggcagttttaggttcacagcaaaactgggaggaaggtacagagatttcccatatagcttctgccccacaaaaccataacctctcccattattaatatcctgcactagagtggacaatgttgacatgtcataatcacacaaggtcctaccatagtttatggcagggtttactcttggtgttatatatttaatgagttttgacaaatattaatggtctgtattcactattacagtagtatacagagcagtttcactaccctaaaaatcctctgagcttcacctattcatccttccctcctccctaattcctggcaaccactagcctttttgctgtctccatactttttccttttttagaatatcatatggttggaatcatacagtattaaccttttcagaccagcgtctttcggttagtaataagcatttatgttttctccatgtcttttcatggcttgatagttaatttccttttagtgctgaataatatcacattgtctggatgtaccacagtttattcatctactga

SEQ ID NO: 90202 - DNA, 4813 bp, Homo sapiens
ccactgctggtcttccaccactgccttgattccttttctcttacaacccagaggaagggcatcagagttccccttctaaagtacatgactgtgtacttctctctggaaataaaaagcctcacaaattcaacgtctggcagagtactttctacttttgtacctagggtaggttacttggctacacaaataaaaatgaaatttgtgtttaggtacttagtgtctatgtcatcctctcattacaaggcaaacatcaggaacttgtgccatttctcatctgagatggcttataagacatagtttttgcagaataccaactgttctataaaaattgcttccaagacactaattatattactttcagttttaaaaatgtttattttgaaataattttacattgtacagagaactcctgtacagtctttatacagaatttattcatttataacattatttgccattaaaaaatcatttttctttctctttctctctctctctctctgtgtataatgttaatagaccccttgatgtttatacaacatgtgtgtgtgtatatacacatatatatatatatgtgtatatatgtgtatatacgcaggtcataaaatcgtcaaggggaatattaacattctgaatctcaaagtgccgggattacaagcatgagccaccacaccctggcctacctttatgtgatgtggtgtggtggctcatgtttgtacctagcaatttgaaaggctgaggcaggcagatcacttcagcccagaagttccagaccagcctgggcatcatggtgaaacccggcctctacaaaaaaatacaaaaattagctgggcatgattacatgcacctgtagtctcagctacttgagaggctgagggtgggaggatcgagagttccagggttcagtgagacatgattgtgaccctgcactccagcctgggcaacagagcaagaccctgtctcaaaaaaaaaaaaaaagaaatatgtatgtagaattctgtatgttgggatccatacgcatgtagaattatcccatcactctattcttgaggagttaggacctgttaggtgctaggtctgtctcagtggactgtctagaacttcagagaagagggctcgccattcactattgcaaacaaatacagcatagcgttgattaatttttatgtttgcattcctcatacttaaaatatgcccttaataatgatgaatacgataataatagggaaaatttttgagcactcattataggtttctgctaaatgtttcgtgttatttcacttccttttcacagcacgcctgagctgtgggtactttcacctccccatgttattgatgaggaatcagaaggtggtagagagtcaggtctgtgttctgtaaagctagtaggtggcacagtctgcactcaggtccgcgcgactccagagctgggtatgtcctgcttcctgtaatatgcttcctgtatatttttgccttttaaatgatgtgcttttagagtgtatcttcttgtgtgtgtgtgtgactgtcagtgtatttccaaagttttggcactgtaagtgtggtcagggtaggctgttgacttgctggagtaacatttaagccaattttgtgttaacgttaataaaccccttgatggttatatggttgttataacgcataagaggttaagttaaatgagggagaatgggaaactgagttaggaataattggccttttgtgattttccccccagtaaaaagatgacaaagtaggatttccaaggtggactcaaatatatttctacttcccatggttgcactactaggagtcagcagagggtgctgttgccatcagagtgtctttgtaacatttttaaaagtattatacaaatagaatgtcctctgtagtttttgagaaactctcttgtggtaccatgtggtatatttagtaaatttcagctatgtcattgcgtttgggtataaatcactttgcccccattttttaaaaaagcctttctccctatcaaggataaaatgttctgtcgtcacgtctgtggaatgtaggtggctctctgctctcttcatcctccgagagacctgtgaagcctggctcgacgctaaccaggcaggctgtagggagctgcaggaagtaaagggatgaggctgggtcttctggggttcatctattaacaaaccgttattgaatgcaggacatgggccacacagagggaagccctgcctccatgtgatccctgcctgatagggttagggacagagagaggcttggtaatccaggcacaagcatgagtggggaggggtggcatgagggatttctggaatgttctgaggaagggcacaccaggaggagctggggtggggatgaagtgaccagttgcagtgtccagacaggttactgggagggtccaggccgaggtagtagggttgagtggaaaggataaaacttcaactatgacataatttattaatagagccagaatttggtcattctgtatggacatttccaggattctatttttgaataagggattttatggatgctccaattaagtccaccaagtcattgcaatcctattaaaaaccccaatagaaatttattatcaaacttgcaaagtagcatctaaaaaatcactttggaaatgcacatatgcatatgaaatggctgagaaattttgtttcaaatttttaatgagaaagtataatcttttctatgtatacaggctacagaaaaacaatacaataaaaaatcatgtagccaccacagtatagaaatagaccagtaccacaaactttgaagcagcctgcatgtccccaacctgctctcatttgcttcttttcctgccagagggaaccaccattctgtctgttgtgttaattgttcccttgcttttccttttttttggtaattaaacatctttgtattgtgaaatgacacacagagaaatgcataagacagataattgtaaagaaaacacctgtgtgatcaccatccaggtcttaagttttgaaaatgaattgagagggggctggcttagcagatgttaaccactctgaaactacagtgaccaagaaagtacagtatcactaaagaaatagatacccaggagagtggagcaaaacatctttcacatcttttgcagttccagatttttctgtcaaattatttttgtgtacataaaccctttattcatattttaataaatcttagactcatagaaaaagtcatgagtagctatttaaattatacattatgcattatgatatatctatatatcagtgtatatcttcatcctttaaaagatacatatgtatttctttagaaagtatggaatgcgttgtgtagaataatttgccttatactggctaaaaggatctctagaattgaatatgtagggaatgcaaataatcaaaggattcgtgtttgttttcaggcagaacaatcccagtgaagtattcagagtgagttctggcaatttgatgtcatccacctcttggtcacgatattttctctgaacaaaatatcccttagttctattttcttaactctgtcccatgaactttggtacaaggtcctttgattttttttcagtgtctgttactaaaaacaaaccagaagaacccatttaactcttggtgcctgggattaggttctcaagtcacagagtgggaggaatatttccaaactgactcagtggtaaatgctcagaaataagcatcacctcattggctgaccagcaacatctcccagctcagccagtgctgcagtcatccattttgaggcaacagctcgtgtctcttagctttgagttctgacatgtctccagcgggctcagctcccaggccagtggacactaagttttgctctacttttcttcctctgttgtcctttcagatctgaggatgttctattttggcgtggttaggaggaccgtaggtcctctaattccataaaatattgctcatgcttctagacattatctccctcagtaagaagctgtgtctagggaaaggctttttgacctctcagcactacctgatagtgaataaaaaggatctgtgtcctttctttttttccttatgggtttatttgactgcttctccttggaactttgtcatactcctcctccaaggaactgggaagtgtcctttctttgtatttttatgtgttctgccactttgtcaagtcatggctatgtggaaaattttaaaaaggatctaatttcttttcaaagaaaaatgtatgatccctagacttgcacatattgttacctgcttctttgtgtattgccactaaaattaagttaaaaagaagtttagatgaagaagtattttgctatctgaattggatttatgagaggaaagagggaatgtgggtaaatagtgaaggaaatactgaaagagtgatttgtaaatgaaaacttaaggtgaacttgtaacagtgcctgtgggtttttctgtatagcttttgttttctattcttttggaaatgtaaatagatgacattggctccctaatttcagtgattcactaggaggactcccaggactcaggatatagttgcattattggttaagatttatgacagtgaaaggatacagaacaaagtcagccaagttaaaaagggcatggggtgaaatctgcaggaaaccagtgcaagctaagagtccttccccatggagtcaacacaaagtgctcttaattcctccaagaatgagttgtgaccagacatgtgaaatgttgtctatcattagacagctctaatgagagctcattagagactcagcaccccgggtttttactctgggcttgtcacataggca

SEQ ID NO: 90203 - DNA, 2294 bp, Homo sapiens
cagagttgtgagcactctggtggcttcgattgtcctctgcctggctactggagagtggcaccttcaaatttaccatttgggggtcacctatgcccatcagtgtcagctgtgaatctggggagaaatggaggtcagtccccaaatagtcgcattttctgctattcaacctcatggacaagtgaagaagttgaatctaatcattcccaccacgttggccaaatcaagcagttacttgcaagaggaacattgtgtcagtaaagttcagtatttgtagaattaatctggtatctgtgaaagtctttgaaaggaatttgaaacagcctggaactaactgcatagtttcacaactatcatatatatcttttgatatttcacaagctctaggctgtgagttcttttggtcctgtgtgctctgcatatttgggtgaattgtggtcctgctgtcaatatgaaatataagtcttattagatagtagtaacatattagcagtaataatgcattagcactgtggtgatcttatgtttgtaagaaagtgcctctatctgcaagatgaatgtgctgtgatcttcacaatgatcttgtgaaaaatgtaagcattttggttgaaatatgtattcttctcaattaacttttcagaaggaggaagaactggcttttgttatggcaaatcttcattttcatcaccttgtggagaggagcacattaggctcggctactatgtatgtatttatatgtgggtgtgttgaatttttgtacagtaaatataaagtattagaagttgatgccatcttaatatcctgagaatagctgcagagatattctgtttttaatcagtaaacacaaaccaacaggcacaattagctgtcgctaaaataattggattattcacgagtacatatttgctttatttattctgggtcaaggaatttgtacctagtaggttgttatttgtatgggtaggatagcttgattacttcaagatgccactactgtccttcaagttcttgctcttatgtgaattttcacatcttgtaaggcatgtagactcatggcccttgggctgaacctggcctgcggatgattctgtccggtctggacagtgtgtgtcttttaatgaatttgcgcgtctttaggtggcgcacaggcttcccatttcactacagctctcacccttttcctgtggacttagactcccttactcattttttttttttttaattacctgagaagctcctgagtatttttgagtttgtcaccttacgtagtcatgtttttcttgttgaataaaactttgtcttggctttgggtctgcctgggtgtttgtcctgcagatcggtattcagtgccttttcctgctgagcacttttgtcccctggacactgagaacaacacggagggcagagtggcttttatagagtggccatgctgggatcagctgcagaaacatgtgcacccgtgctgggcggtggctgcctacagaactcacatcattgcctgtttttatagaagttggtaaaagtaacattgagcagtcttttaagttcacagtattgaagattatagggaatcctatggagtttcatttgtaggaggtagtgctttgatacagatggtaattttttaaaaagtattttcaaaccaagaattttatccctggtgttgacaaatttgtatgtttcttttgttttgcttttcagcccctatgaactgcctccacatagcccctttttggatgatagccccgagtatggactgcacggctaccaactccatgttgatctgcacagcggtggggttttctacctatgtggtacatttcgcaatctcttcaccaagagaggtgaaattgattgagtttttatttcattatgaaattaaaggttgaggtgagggaaccaattttgatgtccgagttaagaattgccctcactggtcactttataatcttttggcaccagtatcctcccagacccgtgtgtcatcccagggcttgtgaaagtcctcactggaccgagtctcttcagaactggctctgtctccttcaccaccatcactctcaatgccaccttctgggggtagcccctactcatcttctctactgatgcttccttattatttttccatgctctctgctttccccagacttcttcccttctttcttaaaggaatgtggtaaatttgccagcagggcccgtgccgctccaggatgagagtaaagagaaaccagcctttctcctctacgtactgcatcactgtttgccacacctaccaaagccaggacagaggctggggc

SEQ ID NO: 90204 - DNA, 2928 bp, Homo sapiens
tgtgatatctgacattagtgcctgccatctctatggagggacagggttctttcatggtttccctggatacagacacttttttttttttttgcagctctgtaactggggaccttgtttttggctcctctccatggcgcctgctctttgagcattgttttagtgattactgagctctcttcccatgctctgaatgtaagactattcagacctcttggtgctggcaaatccaggttttattgtactctaaaaatattcttaatgttatgatgaaaaatgaattatttttcctaaatatattactgaagatactttggaaacagttaccttttaaaaaatggtacttttatttggataaatctttgaaatttcatacgggatcatgaaggaagccagctttttctaatgtagtaattaggctttatgcatttcaaaattacgtttggagaacaagtccacaaactgtactagttttgctaaacaatatgttacttggcatatcatgaaatgttacttacagatattaggacaaactggctaacattaattcaaatgatcctgaagaattaagttaaatggataatgttgaattataaagctcagttaaagacagtatttccctgaaatggtcatcaaggtcagaagtaatagatactacatagtgcccaatgctagaattcattgggaaaattcatttgatgtaatttatttctgtgaaacttccatggactccagccagcctttgatcaactgtgataaacaaaactaaaagtgttttttaggatttgttttgatcggcacttttattgcaagtttgtaagtgaatgctttcattgtgcaggaatataaatccttgtacgcatctgtgtgacagccaaaaagagcctttgtgatttttatttgggtcttttttgtttcctctatgagaagtttttcaacaacagtgaaagcctcattgatgtaatctggatttccctgtaatttatacctttctagtcagactccaaattttcttccttgccagcactttctgctctgcagcttgtgctgtcccaccctaaatttgtgagaactgctggggaaacgtcagccttagtttctgtgtctgtggctgtaaggccaagcacatgaggactcagcacattcccagagtctatttaataagtacctctacagccagattttcagagaagaaggtttctcacatccccacccagcctcctctatccacattaatgatactagcagggactgcgatttattgagcacctgccccatgccgtgtgctcttgtccccactcagcaggctggtgatttcatacacaaagaaccagcctgtgatagtcgcaaagtcactgtaggttgaagctaaggttttacctcaggtttctctgactccacagtgaggttcctgaccctgcatttatcctcctccaagtgtattctgcatatgctgggtttatttctaatttctacatcacacacgttcaccgaccgtctctccttacccagttgttgttctctgcacaagaagttattttgaagagctgaacatgggactagggtcatgtggcagctgcggatctggttttgatgcttcacagtcccttccactttgaagctggactgcagctggtgtcctttttaacttatttatttaatgtacctttgaattcctattgcctgctggcttgtgcctgaggtgctgggcaccaactgttgaatgagatgtggccccagctcctcagggatttcagtctaatgctgtgttagtgtctcctttatgaaaacactggtgatttagtttaagtttatttctgatgtgtcaactttcactatctctgagttatccttgatgataactgtgaaaggcccatctgctttccagccatctcctgagaccacccgttcttatgtcacttgaaatagtgtatctttgcttctgtgttgttttactcacttgactaggaatacacattgagagtctactttagattgtattgtgctggatttggagggaatagaacaggagacaatgctgccacttcatcactttcctggtccttcaacttcctcccggctgggtcattgagttgacagtaagagcaagacggaggggaagaaatacctagttggcttggaaatctgaatgtatccattttgccttttattcatttgtgtcctcaccctgccaacatgccacttagtttgagcacatcattaacatgctcttcaaacacatttgtgatacactaaagagaattgacaacactatggacaggaaagctcacttctctctctcctttccttggcataacgttcaaagactccgatggcattctttaattgcaaagtacaatctgagtcatttgaccatatctaccatgattggctgtgacagactcattcggatcttctgcctgcaccctggcctcctggtgggagtgtggaaggtaagacttgagtccctgtatgtactgtgtcatttccccatcacaataccacatttacttaccattatgtatgacttcaaatgtaaaatcctttaagcttttcactaactgcaatccattttaccatctcaccaacttcattttttcaagctaacatggccctctctgttccaccgaggctgctgtgctgttctgctatgatagacaactctgctatctgttgttctgctgttctgctatcatagacaacaacctcttcctgccttcatgttttccttcatgttattcctttcatgtcatgtggctttcccacttccaatcagtccacgttccttcttctcttcctttcatgctctttctctgacaacatttcccttactatgtgttcagcacgcttgtctcccaagcctgtttctgatcctgtaggtgcggcattgagtgaaatctgctcttcagggtcagctgtctacgatgttat

SEQ ID NO: 90205 - DNA, 1066 bp, Homo sapiens
caataataacagtataaaaaagaatacaaataaaaccagtacattatacataataacaacagtttgcacagcatttacattgtattaggtattataagtaatctcaagatgatttaaagaatacgggaggaggtgcataggttatatgcacatactatgccatttatataagggacttgaacgtccacagattttggtatcatggggttcctagaaccaatttcttgcggagacagagggataactagtaagtagcctaaagttttaatgaaaagcagaagtaacctacttatctgctatagtacaataagaatgttcaaggtctcttttctgggcagaacctttgtcttatttatatattgccagtacctggaaaatcatggatgttcagtgggtgttaggtgaggagaaaaagtctaaagagagtactattgttgaagtgaaaattatactgggcacattctgagaattttgactttggcttttaaggaactagatgctttagagaagatacatgaaattgcctttagcattttttttttttcaatgaggcaaacattgttagtttttttttctttctccagaatatttggtttaggttgggcaattatactgaaagaaaaaggtggaaaagaatatatcatggagcatgttgatctttccataaatgacacatcagttactgttatatggtatggcaaaaaatggccatgcctagcatcattgtcaaccttagatttatgtggcatgacaccagtttttaccgactggtataaaactcccaccaaacataggtaagtaccaatcagcagaactgttgagtgagagcatcttatatgtaaatattagttggcattacttttgtaattaaaaaataagagcagcgttttttaattttatcacatattaaatgtacattctgcattaatgcagaagaggaaaagagtgcattttatcacatttctgattaggtctaaatttaacttcctcgtatcttggggttgtctttaatggtaaagaatgatgttctagttaacaaaatttcctggatgattgatggctaacc

SEQ ID NO: 90206 - DNA, 1324 bp, Homo sapiens
ctggagcctaggagttctgggctgcagtgaaccctgatcatgccactgcattctagcctgagtaacagagcaagaccctatctctacaaaaataataataaaaaaatacacagtttcatgggggacattgaaatcctgcctgttgattcacagtgtatgaacgtgattaaaatgctgaggaagttagctcttccaacccttggctctatttatggtttatgtcatgagaattagaataaccagaacgtttcaataaagaaagtaattgaagatgagggtacagtttgcctcttgtacaggaggggtctctctacggccttctatttagagatgagcagccagttgttttctgggtaatctgcagattaagccctggtccactctggtgattttttttttctttttctgtttttgcagaatgccttcagaaatcttgctgaagatattttcctacttggatgctgtgagccttctgtgtactggatgtgtgagcaggcgcttttatcatctagccaatgacaagtaagcagaaatccaagtctctgttatgttttgatgacagtttgatggaagtcaggaaaactagtaactttttaaccatttttaagaatttaagagaattcaagagtatttttacacacaagtggaaatgtcaaatgctttaactatgaaattttcaaatatttgcatttatatgcttaaaggaatatactttgcatggaacaaaaaaatcaaacttgttattgctgtagctgttacagaatgcagcttcaggtctgttgccaggaggtcttcgctgtattccccacagaatcagacctaaccacagagtctcaagcagcactgcagggacctgctggctttgaccctagccgtgcattcgcagagcagaatgagtgctctctgctgatggccaagcagatcctaaagaaagagaaggaagagactaagttaggtgtacttagcttctcctcccaaacatgccaatcaagttaacttactctgtggggagagcgaaatggatagagagaggccaagactgtcctctcctagaggttgtacgcttggatgaagggagccaaaagagaggggttcacctgtggtcatctggtcttgcagggggtggatctaggaaggaaggggagaaacctctgcttctgtttgtcactataatcttagcctgcatctcagaattgtatcttggagggagagatggtggaatcctcctttcagtgaggatttcgtggcttacaacagaacatcttggctttttaggcccctctctcatttagcatcaaaagatcagacaaacatcattcctaca

SEQ ID NO: 90207 - DNA, 1194 bp, Homo sapiens
ttgcttaccatcaaggtttcactgtctcttcctcccttctccctgcctttcttccttccttccatcttttcttcttcccttcctttttttctttgcagaaattaagtttttcagtgagtaatctttggagtttatgaatcctttggaattttgtagaagggaatagataattcacctcatttggtaattacataatttgaatttcccacatttactttcagaaaggggccaggggtcaagctttctgcaggctctgctgccctgaggtgccatgccggaggtggacagcactgggagagctctttctcctgctgttctgggttcctggatgggtaagtagcagaagtagactgtcacttttgggggcctctaggcatggggttattagagaaagttatgatgctgtatataccaagttgctattttgagcttgctaagaataggattgtgtaggaagacagtacagcatggagcatttgatgagtcatgggcctgtcaccactatccttatgagatgaactttatgaaacgaaacttcaagaagtgacaagtaaattgaattttccttttattaaaacgttcttcaaaaatattcacttttgagttgataaagacccttgaaaaaggagaaagaaagaagattaaagtgtgttttcctgaaagctcaagagctctgttcatttctcagctttcaatatctgggagcccatttgccatggcaagattctgtgctgtgaccctcagcaccaagatccacagaagctttaaaaaattattatgtttaattgatgctcagaagtccatagatttgtactgtagtaacatttatggaacaccgattatatgctaagcctcatggggagcctgaaagcttgagatgatcacagagagacattttacactgcaggaagctaggcccacgtagtctgcatattgcagaactgtgtgattcagatataagttgcctgatttcaagttctgggcttttaatactgtatcacagcttgctcagctaacagtgtacatatctgtatacacatttcagtgtattttaaaaaaagccagaaaggatatttcattaaggacattaatttcagcttaaaaccctatgctctgggaataggctgttttacaggcatctgatatgagaaatggagcaaatattcctttggttagtccatccattaaatattt

SEQ ID NO: 90208 - DNA, 1305 bp, Homo sapiens
ataagtcatgcttttaaataattttagaatgtattacaaatttgtttactgtgttgactattgacagtaaacaaagtgtattataccttctaaagttatttatgtccttctggaacaccaggatgtgactttctttagatatagggtctctgcaggtataattagttaagatgaggtcatactggatgagggagggtcctaagtgcaatatgaatgatatccttataagaagaggcacagagacagatatgcctagagggaagattgctctgtgaagatgggggcagagattagagttatgctgacacaaactaagggacaccaaggatttctggcaaccaccagaaaaaggaatgatcctctctagagccttcagagggagcacggccctgttgacaacttgggttttggacatctggctactgagacataatacatttctgttgttctgagtcacccagtttgtgaaggtagtcttaggagacgaatgcaattaggaaatgatattttacttatgattactatgttaggaccatgttaatggagcctaagcttttctcctgtggaaatctgtgtttaaacaaaatttctaacagaagtacaaaaatatataacaggtagaattatctgattaaaggaggagagggtattgcaaaaatgtcccaattagcatttcttcctgtcctttctccctgtcttcctgccctgcagagcacagattgaaaaccattggctagaaagtcatataagaccaaaagtatattaagcaccttttactgaagctgggatggaaaggcatgtggagccagcatttttttttcctcggtgcatttttactcttacaggatctggaaaagtttaccttatgcaacttctttgttgagatgccagtggagcagctgatcactaatatttgtggagggcctaccctgtaccagctactgtgcttttttctagagagaaaaattcacaaagggaagaggaatttactctgtagctgcttggaagcatgtggagacttgtgcctgggaagcagggcagccaggtgccagtgggtgatttgagtgcgtgctgcatatcatgatgctgtcttgcggtaggctccaggctacactgtcacctggccagctgatgcctagggcaagggctcctttttcaccacttgtgtcatctaataggttgtgctcagagttgagggccatcctctgttaagaccagttgtgtgtggatttcatacttcagctttcaggggggttggttcattactttttcttccaagttcttaaggcatctctttttttgctc

SEQ ID NO: 90209 - DNA, 1122 bp, Homo sapiens
accttatgaaatccctctcattatatcgtgagctgttccctagctgtgtacccatcactgcagttagtttacagatggagggataatgccaagaatggtttacattcttgaggattatctttctgcttgtaagactccttgatttataaatagggaaagtcatgcatattttgccttctaataaaccaatggtctatgtttaagcacacaaagggagtctattacatactagttgaactacttgttttttccccctgaatctccagaactatgtcctgtgtcctctctaggtctccattacttccacttacctgttttcagaagcccagccctgttgcttagtgctgtgataatagttcttaattgaatacctataatgctagacataccacaagccttgtcacaaatagaatggtgacaatgcctgcaaaaattcttttatgtaggagaaaaagcaggaatttaaataggaaacttgaacttttaatcaatttgctgctattactaaaattagtctttacatagtgctctattagggggaagcagaatgatttttatatgatgaatcttttatcctttgtaagttgagtgaacttcctggattgatataattagagggcctgtcattatgcctggcatgggaacctgcatttcaagctgatttggaaatgtatgcattatttttggtaaagaaaagtccgctgctaaaaatagaatgattgactatggtcaaagcaggtggttattttaatatatcgctgtggaaaattagatgttgttaaggaatcagtgttcccttttaacacaaaatgtgaatatgtataaatatcacaaactgtaagaagtgtagcagaaagcgtattaagttggcttaatttgtacctgctgtaatttatttgatttgccagatatttaaaatgaagcacagtcattaggtttttaaaatattggacttattgaaagctatcagacaaaaacctgtcacttgaaaaaaagtgttttcaaactaaatttatcttgctaaatgtatcagtgtatgtctacacttaaccttgtagacgtatagattcgcataaaaacataaatagaacttgctgatttgttaattatgtggaccttaaa

SEQ ID NO: 90210 - DNA, 3400 bp, Homo sapiens
atgagcatattgtaaaatggcaggtgcataaaaatgaatacagaaaaagcaaacagtcttaagtcaaatgacagggccatggagggtggctaaatccccacctgagctcagatgccgggcttcttcagcaagctacagtttgagcaggttgtttgaagagcagggctgcttttttgagtttaggatagcaagtggaacttctcagcctgttaaatgttgacatttcagtgaatcctgaaactgaacattctatagcaaaggaaaaaacgattaggagagaaagcctaagttaaggcctcattcagtcaaagtgtgttacgtcagggagacgagtgtctgttatattttctatactccttaaatgttggaaatttttataattaaaaacatctaaaacaagcagtcaaaccaagaaactaactaaattaagcagggagataaagtaaaaaggggagatagattgcctggaggtctctctatcctgaatatcccaaaatttcaagaacacatcagaaattcctctacagacagttctcggggagaaggaacaaacacatcagaggggatacctcacactgaagccaccgcagataaacatggttctagacccctcccaatgcacatagcacttacatagatatggaatcaggatcttgtaagtgaaggtcacttttttccaaatccccagcaaatatttcaaataaaatagaatttcctttttttttttttttttctttaaggggcctcacacacgtatttgaatgtctctcattcactcccatgttcttttggcagtcagaagtatcagtgcaagtaagttctaaaggggatgagggcacttcatggctgccttctatggtccaggcttgtacctctcatcacactgccatcctaacaacccacacaacagggacacttgaccacgcacctgctagaaaaggtggggtgggtgcccaggtctacccaacttgggagtgtgtacttttcccgctatgtactaggcccttaattcatgaagcgcgaaatatgagacagattcctaaaactcacacaattttgaagaatgtatttaccatctggttccctatggccctcaaccattttcacatgcttatctcaagtcagattccaaagtatgcggagggcagctgctaatgacatatttgttagttttaattttattctgcagacattatgcagttctataatataaaatgaatacaatactaaaatctatttcctttatttacatggtgtaacatttccaataacaaacatttctaatcatgaaagatggtgttaaagcagaaatattgtcatgattgagtcaatgggagaacataaaatatgctgtatttcataatttttccgtaagaaaatgtctagtttgtttaaatgcaacaaatactgtattagattcactttataagccatacactccttcttgtctttcttttgaacacattctggaaggcagctgtgaagaacggagtagcgagtccacgccattcaacatccatcagaaaccctattttaatcatcttgggatcgattatcttcaatgataatagttcttctaggataagattcaatttctacaaatatatatcgaaaatcatattcaccacttcctgggttctgaaaaaaatgtagtgtttccaggtattattttcctttccagaacttaaataacaccgcgctcagaacctctgaccccacatcccatgattcccacacctctttcacttgcgcatacaccgttccttgcttccctggctcagagccctcaatgtagaatttcacacacgtgtgtttcagcccatcttttacatattcagtgaacctgtcgagaaaacgaaagatcagtctaagttcctttcatttaaaaatctccccagagcctcctctgaattcaagccacagtacctgacatgctgccggcgaccccgccttgtcacctccccatagcctttaacagactcaccaaagacaccgatcacctgcagaacaaggacagtgctttattttgtgttatttttttaagcttctaaagaaataatttttaacaaaccagatgattttaggaaaaaaaaatcagtaagcttaggaccttttcaaaaatgaccactcctggctcacgcctataatcccagcaatctgggaggccaagatgggtggatcacaaggtcaggagttcaagactagcctggccaactaggtgaaaccccgtctctactaaaaaatataaaaatcagctgggcatggtgatgcgcatctgtagtcccagctactcaggaagctgaggcaggagaatcgcttgaacccagtaggcagaggctgcagtgagccaagatcgtgccactgaactccagcctgggtgacagagcgagactccgtctcaaaacaaacaaacaaacaaacaaataaaaaaatgaccactccaataagaaaactgaaaaaagggttattatacaaaaatcatcccataaataatttaaacaaatatttcatgcacaaagattaaaataggtagctttatggtgtgacttgtagtttcaaagcaatgtaggttgacatgacgcagttcctgctcctcttacagaaaacaaacataacaacacagagttcagatgtttctctactaaccccttatggtttgaagataaaatgtatgaacatttttaatgaaatgtaattaattaatagcatctaatactaaaactatgagatcaaaaaatttttaaagttaccaaacacagtgaggaaaaagaaaacagataatgacatttaaaataaatcagagctacaggtgtgaatctactatttctaatgagaaaatccacatgaagtagaaatgtagtttttattgaattcaaaatgcaaatactgtggaaccctctaaaaaatataaatttgatattaaactaaaaaagtttgaccctcaactctacgaaatttatcttattttgtctgtttgtggagtatcttcagtatcacattttccaggataaaaagaagtaatatgtaagatgatattgcagaattgtatagcacaaacaaatagaacaatttactttaatctattaaacatataaatatcaacatccatcaagattttgtttttcaagcagacacagtacccagcaaagagaagggtaccccttaaaaaatgttgacaaaattgttaaagtttaattattatttgtagagttttttcaggcagcaaatgaagttacgacttcaataatatcccacttttgtatattcttgtggagttttttgttcaaaatgctgaaaaatctacgaaaggctgagtttgcgaataaaacagcaactcttcatctctttccagagatgcgtcctaacatttaatgaggttaccacccacaggtatttccgg

SEQ ID NO: 90211 - DNA, 1044 bp, Homo sapiens
atgatttttgtataataacccttttttcagttttcttattggagtggtcatttttttatttgtttgtttgtttgtttgttttgagacggagtctcgctctgtcacccaggctggagttcagtggcacgatcttggctcactgcagcctctgcctactgggttcaagcgattctcctgcctcagcttcctgagtagctgggactacagatgcgcatcaccatgcccagctgatttttatattttttagtagagacggggtttcacctagttggccaggctagtcttgaactcctgaccttgtgatccacccatcttggcctcccagattgctgggattataggcgtgagccaggagtggtcatttttgaaaaggtcctaagcttactgatttttttttcctaaaatcatctggtttgttaaaaattatttctttagaagcttaaaaaaataacacaaaataaagcactgtccttgttctgcaggtgatcggtgtctttggtgagtctgttaaaggctatggggaggtgacaaggcggggtcgccggcagcatgtcaggtactgtggcttgaattcagaggaggctctggggagatttttaaatgaaaggaacttagactgatctttcgttttctcgacaggttcactgaatatgtaaaagatgggctgaaacacacgtgtgtgaaattctacattgagggctctgagccagggaagcaaggaacggtgtatgcgcaagtgaaagaggtgtgggaatcatgggatgtggggtcagaggttctgagcgcggtgttatttaagttctggaaaggaaaataatacctggaaacactacatttttttcagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaagga

SEQ ID NO: 90212 - DNA, 1054 bp, Homo sapiens
catggttgtgtttaggacctgtttaaggcactagtctttattatagtctttattacagtctgagagagtatggagatgaggaaacagaggaggaggggggacagcagagagaggagggagggacatcagagacagagaagcaggagaaaaagggcacaaacggccaggcatggtggcttacgcctgtaatcccagcaccttgggaggccgagacagatggatcacctgaggtcaggagttcaagaccagcctggccaacatgctgaaaccccgtctctactaaaaatacaaaaaaattgctgggtgtggtggtgggcacttgtaatcaatcccagctacttgggaggctgaggcaggagaattgcttgaactcgagaggcagaggttgcagtgagccgagatcacgccattgcactccagcctgagcaataagagtgagactccgtctcaaaaaataaaaaaaaagaaaagagaaagggcacaaacaagggttgtaacttggggacactgaggcttgatgggcttccaatgagagttagccggaagctgcgtcatgctgtttccttgggacatgagcttctgtgtggagtcacctggattttgaagggttttgtgtcgtttaactgctcatcagagctctccacacactgaaacctcaattctcttgttgagacactagaagtctgcgggtgcccctcacacaggagaaatgcaagctgcccccttgaaaaacgtcctcagagttgcaaccacaggggccaagtcaagaacacttcaaagactggatgcaatccagccaagaggttggctccttccctcagccagatctcccatgtgctaccataaggagagcctcgcagagctgtggcaggtggtattggcatggatgagaaacttctgcatgggtcttagtgaatgcattggcattcctggatgaaatacattaaaaatgaaataaatccatattaataacaaataatgatacagtcacctttgatagagtaaaaatgaacacttttgtaatcctttgttatgaaaaataatgagcctatga

SEQ ID NO: 90213 - DNA, 2680 bp, Homo sapiens
aaaaaaaaaaaaaagatttctcagaagacttctttccctatagagtggaaatgtaggttacctaataatttctacaacgttcctgcaaccatgcctagaagaaaagctgcgtggaggtgacaccttcctccctctgcttcctggtcagcttagccctcatggtctcatgtccagcaccctgggcagtgaagtcagaagaggccatctgacctctggctgtgccgtacttcagagacggggtagctgatgttctctcacatgggaagcaatcagagggaaagacgagaaaggactctgataaggaaaatcataataatgaataaaggtggagggctgataatgataataaaagttacatgcagagtacactgtatgagaaaagatttcatagaataaagaaacgatttctcccttcagtgacaaatccggatcataacttttaaaacgtagtaaaactctaagacaaggttttaaaacagacatacagagtagctttactacttccccaaatagttctgctcaatataatttcaaacaaagtatttgaatgagatatttaaaaaatgcttcagagctagggatttatttcctttttgccacggaaatgattttgtcccaaagacagactctaattaagctaaaccctttaagtacactaaacaatttatcttcctttttgttctgaaaatacgttcaaatttgaaggctggtctcctataaattgtaatgaactctgacttcctatgaatacttcttcatgtcataatttctgtaaagaaccaaagactgttccaaagcccatttcaggtaagcagaaaaatcacatctgagatttctctcgggcaatgatgtcaaagggagttcatagcagcctctgtaaggggcattaaggtgaacagagacccaaattatattttgagtaggaaattatctgcactttcaaccttgagcaggcagtgactgcagctgtaacagactgacgaaccccttcggttcctcctaaccaaggctcctaatgtctcatcagatatcacagagcaccatactcatgaatatcatcatctctgcctttatggttttcaggaggaaaaaaagaaatggctctgccaatggcaaggttatttgtagtactttgttagttatagcccactctattctcagcacttaactcgcaatggcttttccacactcagagcacagtagaggctgagctagagacagctaaaccttgctgtcaccttcactggccactgtcctcgggcacacacggagcccagcagaagctgcattaaggacatctttcttcgctctcaccgggtagagtcaaataatttacctctgcagcaggttaaatgtcttcccaaagcggagccgccttctgtgtgcccacgtttattaaattaccacagatgtcgtgtgaacagatgggcgcacccctgagaggcgaggctgcgagggagagcggccgtgcagcgggggctctggagaaggagctgctcgccggcagtcctgcgaggcatctttcccattctcaccgctgcatgtttactgaatccttacaaaggcccttgtccccagaaaaaggacagcagaattagagagccgggaccagcagcaggaaaccctcggagaacaaagtggtggctgaagacataagatccgagcgtggaggtgtcctcctggccagctgttcccaatcaccatgtgactcgaggaattcactaaaaatgttaaactcttgggccgtcatggattaaagggtgctccctccccatatgtccatgtcctaatatccagaccctgtgaatgtgaccttatttggaaagggtcttttgagatgtaattaaatggatgatcttgagatgggtcatcctgtactaccagggtgaaccctaaatccaatgacagttgtccttagaagagaggtgatggagacacacccagagagaagaaggctctgcagcgagggagggaggcagaggttgcagggaggcacctgaagctgcagaggcgggagggactcttccctagaacctgcagagcaagcgctgccctgcggacaccttgctctcagacttttgtgctgcagagccgcgagcaataaacctcttcttgtaagccaggttgtggttggtcgttttggcagctgcaggagacaaacacagaccctgccctgggcctcctgaaatgcagttttaggaagctctaaagtgcttctgaggatcagataggccaggatgtaccctctgtgtcactgatcaggattagaggtttttgatgcctactgcacatcaaattacctgggaagctttaaaattacctgggatgtccaggctgcacctgcagaagtcctgactcaggcgacctggggtggatgattctcatcacaagacgtttgagatccacctaagatgctaacaagctaagatgtggatcctcttgtcccttgagtggaggggttggtttctgctgactccacagctgctgatgctggaggcggccactgtcctttgcctccatggctctgcccacattgcacactcccgttttcctgccctttctacacctgcttccaccttttcgtttaaactgaggcattattacagaacacccagatcatagatatacggcctgagttatgacagctgtgtgtatttgtacaaccccacggatgtccccc

SEQ ID NO: 90214 - DNA, 2565 bp, Homo sapiens
cccaggtgaacctaggaggccccaagcgcagctgctgtgtgctggcggggtctcctgacacctttgcctgtgatgatcacagtggcaagattaggtcagatggaccgagaaagtgagagacagaaggccttcaagtgaggctgcgggcagttcctagcccagagcccgcgaagaagacggtgatggaggctcgcagacctcatgaggtcagcctccctgcagggggatcagtgctgcgacagccatcccacccctgttcagtggccccaacggatgatagcgtttgcaatgaggcattttccctgggcgtgggtcatgtgcagggggcagaaaggagatttatatgaaattaagaagaggaatggacagagcctgatagaccgagactgcctcgtaggtgcaaacccttcatctgaagagcgtaaagacgctgagcccgcagggaacgaccgctctctgttgggcatcgcgctccacttcccgccttctaatttttcagtctttttatgactctctgccatctggtctcaaaagctgaagaacatttgtgtacagatgagaattttcctcaagcgaggcagaacagacagcagggtgtaaatattttatactttccaggatcattttctttcagaatattaagaattcatgccaacatttgagaatggatcgcgggaggaatgccgtgctgagtggaacgcttgccgtggacaaagatcgagagaaagagctggaatacattcagagctgagatttcacagggctgccacagcctttaattaaatgtggttgactcacctacccagtaacacacattttaaatgccccacacggattgctttttttaaaaaaacaatttttaaaaacaatttccaacttacaggaaaattgcaagtgcagtataaaaacccttttttcccacatcacctggaaataaactgctgatatgatgccacgttacttccacatcctttagtgtgtactttctacaaacgaggacattctcctacttggtgagccgaattgggcctcctgtgtgaaatttaaatgttgaatattgaagttctcccctctagtaccttacaatgtggctgtatttacagatagtgccttaaagaagaaattaagcaaaaatgagatcattaggatatgccctaatctaatctgatgggtgtccttaaaataagactagaaaacagtcatgcagagagggctgaccatgtgaggccacagtaagaagacggctttggtttaataacataacaaaatttatggtacagtagagaagtgtaaattgatctttgctccaaggatgtagccatcttaactgacaattctatgagttttacaattcttagggcaagtatgtgtgacttttttgctgccttcaagtataacaaggtcttgctaccttaaaatccttttcttgactctcccaaacactcctggggcctgtcccttctggttcctcctgttggttgcctaacttgtggagaaggtgatcttccggctggtgtggacttccgcccaccatcgctcatgtctctgcttcctctgctccatgaacgtgccccttacggtctccaggaacgccccctttgttcttcaattccggatgcctctgaagcagaagccactgctttcctgtcactgcccaatgccactcgtgttttggttcctgtgttagttgactgtggttgctgtaacatttgatcgggagctgggcggcttaacatggtagacatttattctcccacagttctggaggcaagaagtgtaaaatcaaggggttggcagaatgcttccctctggaggctgcaggccgggggatccttccttggctctttccagtttctgtggttccaggcacccttggtgtccctggcttgtggcagcatcaccccagtctccgccttcatcttcacgtggctatctttcatccgtgtgtccttttctgtctcttctaaggatgctcctgttggatttcgggcccctccaatgcagtatgatctcctctccagccttaccttgattacatctgcaaagatcctatttccaattaaggtcacattctgagattccaggagaacttgaattttcggggcaagatttgactcatggcagcgtctatgtggaggcttgtctctgatgcccgatgtctgtggccagtgctggattagggtgtctgtcagactgttgctctcgacccagtgtcacaccctgagtcatgccctttctcatggcttccagcactggatactccaagtatgtgtctgaatgacacacagttctcagtctccagtcctgaactgctcagaacccagtattgtcggctgccggtgccacatgccggcacacctgaccctggaatccagcatgtctgatgcaaacgtgtgttcactctgtccctccggcctcaccagccaagtccacatcccagctcctccactgtgtcagaggcatctttcactcttgcaactgtccgggctaagcttcttagtgtcatgtatgatgtggccatttgagaatttatggcaatgaaagagaaacagcaggccctatatt

SEQ ID NO: 90215 - DNA, 1135 bp, Homo sapiens
ctgccccagcctcccaagtagctgggattacaattagctactgccaccacgcccagctactttttgtattttttggtagaaggtttttactatgttggccaggctggtctcaaacttctgacctcaagtgatccgtctgccttggcctcccaaagtgctgggattacaggcgtgagccactgagcccagccaagtggggcatgagttttctcataaagccagcagggcagagtgattcctagtatagcagggcatgtgttacactcatgtcacttttagcaaatccacgttgccttttcagcaaaattcattacagagttaagaaaaacatgccctggtaattttctgttagaaggagcaaagattttgagtccaccacagtgcacatcatgtcagcatcattgctttttgtgtctttctagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagtatgcaccgtgtttgcctgtttggtgtataattgtctttaatgtttagaatctggttatttagaggattccttcaatgtgttactcatccagacccacagaggccatatgactggaggtgcgggaaataggtttgagtgtctcctttcacatcgtcacatctcattgagtaaccatgtattgtatgcttccgatatagtttctttttttcaaggaaattaagaaaggccagaaattatagtttaaggatttctaataattgtcctacttgaaatagatcttaaaaagaaagtagcggctgggcatcgtggctcacacctgtaagcccagcactttgggaggctga

SEQ ID NO: 90216 - DNA, 1045 bp, Homo sapiens
ttggaaaatcctcttgctgtagttatgaatactttttatagatgctaagattttaaaattgctggaatagataataaatttgcaattttatttttaaatgacttaccttttttcccctactgtgtcaggaaccttaaaggcggtgtttcaaggttggtgggtctcataactgctttgcttgcttttccctgaaaggggtctgtcttttcacgggagtttctctaacgtgctttgcagagtgatgcttgccttactgcaggccgctgattgttttgctaatgctttttatctttgctttgggaaactgcagatctgaagctgtcttatttatggcaacttctgtttgaggccctaatgcttatgttggtgtggaacatcaaaagaatgcttcttaacccattttcaagccccaaaaagttgatatttcactagaccttagcttttcagctgttggagaagtatgcgtttttccagaaccattgtccattcactttagtgctactcaaaagagctgctcccagaaagctctggaggataaaaacagggcttccttatctggggatttgctgttaggctgacagtgaccagctggtgacaagtgtgacgccgggcacagcagtcctgtgaggctggtctggtgtcttgctggttccgtctggtcagaattaaagcagccccccgggaaagttggcctagaatgtagaacttaaaatggcagtcctcttttttctttttggttcacatatatttaatgtaatttaggtacacttttttacatctgtcagatttgaatgaaataactgatgtttttattgaacattgtgttcatgcttttgaagaattaaactgctttttctaaaggtgacgtgggattgtgtgtatgtgaacatgaatgtctgttttcagtttctgcattatttagatgcctagcgtgtgcaagatattttatgtagcatattaattttgaatgtttttaaattattgaggttatgtccttaagtaaatataatgattaaaatgttttactctggaagaaaacaaagtt

SEQ ID NO: 90217 - DNA, 1034 bp, Homo sapiens
tgatacttgatcagcttgttagatgtagaaggtctcactgaagtttgagaatcacactaactttttaaagtagatttttgtttgtttgtttttgagacggaattttgctcttgtcacccaggctggagtgcaatggcgtgatctcggctcactgcaacatccacctgctgggttcaagcaattctcctgcctcagcctcccgagtagctgggattacaggtgcctgccaccatgcccagctaatttttgtatttttagtagagatggggtttcaccattgttggccaggcttgtcttgaactcctgacctcaggcattcgcctgcttcagcctcccaaaatgccgagattacaggtgtgagccacggcacccagcctaaagtagatgtttttactctcttcagagattttacagattaactaacttctgagtattttttaaacaactcttctttattgtgactttgcttcagtgagagcagaaccggaagaatgtgggacaagaacttgctggcctttttgagaggccataagcagatgaaatgaaaggaaatacatgagcatttttctggatgtatctttcttgtgcttttggtttagtggaagtaaagagtgtccttagggatttcttttgtcatgtgtctgtataaccatcggccgatctccaggttgaagaatgtacactgtggtctaaagttttgagatgttgcctgcttaaaatatctagttgaatagtgaaataaaatgcagtaaagattattagcttgaacctgccctaaggaaagcatagtgttaagttaccaaattaagatatttgtagacttagaaatcatgcattttaatctaacataaatgtttctatcacatttgcttacatagagaatattagtcgtagcaataccccttcttggttatagttttgaaagcattcttgtagaagttatttggtcctcacagtgtctccatgttagacctgccaagggaggtaggtacattgcagctgggaagtgttaagcacccggctcacagacgtgc

SEQ ID NO: 90218 - DNA, 1026 bp, Homo sapiens
ttttggtggtaggagatatgtactttgagggagtaagcttcattcatctgacaagtttatttgccccgatattttcatcccatacttcacaaaggcaaagtgtcttagggtcatcagggaggcctgccgttacacatgcctgatcccatccttgtttccagctgtgggtcaggtttcaggccctgactgtggcacttctgcttcacctgcccactgggcttccccctggccagcctttaaacacactgtatttttgacagcttcagcctgaagttgaaatagtttatgactctaaaactgggagactgcagggcttaactgaagatatcatacacgtaagagatacatgcacaatctcaaatggaatttgagaggacagaagggaagaatcagtcttcagctcctccctgaattacgtgtcgcaatctgagtctaataaatgtgtgtgcacatcagcatgtacagagagctgtcatgggtgctgttcgaaactttggaactctagatagaaaatatctcttggcacttaatctgctactaatttttgctgttaaatcagatggatcaaactttgtgtttaatagctaaatgttgaatctgaaatggtaattactgaattataattttaaaaagtctcaaagtcagcattttggaagtggtactttcatagatttttaaattccataatgtgccttatcttttcattgcaggatgacagaccaaagttaaacaagcctccggtaagtgtgaccatctcaagtatctctggatgttctcgttgtatttaatacttgtcaaactgaaggcagagggtttttatttacctgactgatgccagcacaggtctttctagataaatgaatatgtaacctactggctcagcaagtattttttatttacggaaacctgtcagtatgatttgttaggatggcgtgtgtgtaatttttttaaggctgtcagtaaactacttttttcatcataattatcaatatataccatttgaagagctactttttatggtagcac

SEQ ID NO: 90219 - DNA, 1516 bp, Homo sapiens
tcttccattcagttgtgcaaaccaaacattggctccagtggcacttcctgtctctcccaccatccttaccgtccggaagccctctcgtccactctgcctcacaccatgcacacccttgcacctgcagctgcccccaccctaccctctggagtggctgcagagaacagccttccctcaccctctcttgcccttttgtctgctgtccactctgaagcctgggttatattttaaaattaaatctgatcgcgttacctcccccacttagatccttaccatggcctctctcattgctcacaggacaaagatcagaatccttggagaggcgcaaaagcagcacacggcctggccctttctcctaccctggggccctgtgaggccttctctcccaggtcctgaattcgctgttccccgcccctgcaacaccttccccagacacctcttggcccttgttgactgcagctcccaccttgtggtacagctcagcagggcccgtcctgacccctttgtgtgggtgacattcctgtgtcatattcttcatggcactaaactctttcacctgaggacatttcctttcacttgcagtggcatggtcatagttattcatgtttcatctctccggctgtgaactccccgaggcgggagccgtcgctatcttggctccgactgtggctgccacgtggagacgttcatgtgtgtttgttgggtgaattaactcaagtgcataataacaaaaacaaatggaaatcttcctctggaaagacggaagaccgttagggtcagctcacgtggaaacagctttgcatctccatgcccatccccacttctgggtcctccttactgacccgcgacatcctctccccacctttctccctctctctgggcactacagctggtcacttcccacacatggtcgcatgagtagaggcttagcaaggagtgcgttatggaggacagatttctgctactgacttcgccgaagtggatccacagcttccatttggctcaggctctttgggagaatttcacttcttttgttacctctaatcttacctatgtgtaaccacacattttggtctttttcttaaatcttttagataatcatcagataagtttacttacctgttattctactactttctgccttgccttttcttcaggccacccccaagtgctataacctgcccaaaggttaggacataacaccgctgccacacgtttatctctgggcataaccacgatggcataaacaccagcattcccaatttttctttgtctcttcggaatgctgacaggcaaagaagagcattttctttagtctccaaatgtgtggctcacgcctgtaatcccaacactttgtgaggccgaggcaggtggattacctgaggtcaggagttcaagaccagcctgaccaatctggtgaaatcccgtctctactaaaaatacaaaaattagccgggtgtggtggcaggagcctgtagtcccagctactccagaggctgagacaggagaattgctt

SEQ ID NO: 90220 - DNA, 1013 bp, Homo sapiens
ttgtatgggaaagtggactccttattttcatttcagccacgtgtgcactctctcgctgttacttattactgaagtagggagcatttgggaactggagaatggcgtgcaaatgaagaaggccttctagggattggctgtgccatgtgaacagtcctgggcgtgccatccatggagcatgccaatattgcccagaagttttgggtcagcttcttttttgtgtgaccttggtggaaaccactgagctccatggtattaagtgggccacgtgtcttctcagcgaggttcttatgtaggtatgaaggaaggaagcctgttgtgatccccgggggagctgtgagtgtagagctggctctgaaagccttggcatctctcctgcaggaagaatcccaggagcaggtgaatcccacctgcattgagcattttttcagtttaaagcaaatccttactgctagagtatatttagaaagaggcagggccagggccgtggctaggccagcttcgtaggtgatgagctctgtgttggccatcagccttaagtgtgttgatttttcacagcaggtcactcagcagtgtttatctgaaaatactggcttggtgctattaattaaggatgaaatgaaaagcttgtttctgtgttagcattgtctaaaggactgtaaatagtgcttaattcattatggatatttggtgcccagtgaagaataatttaccaagtttgtaagaacagtattttcttcctttttaaactcttttatttcttaggaaaccagggctgtacctcttagatcattgaatagtgcagaggtgcaggaagtgccgtttattgggatgactggtgttgggcagaggggtgaccttaccctccagtcagtcactcagcacacaggggcttcttcccttgactgtcttcctagcaaagatgacctcgtctttccttgaagatattgataccattcagctaacacttcattttctgccatatttgtgttcctttcatttttgtgtgtacgtat

SEQ ID NO: 90221 - DNA, 1041 bp, Homo sapiens
gatttcctcatttttctgctcccctgaatagtagaagcctctgaaagggttgttaagcctggtctccaatccacctcctccattcccttttaaaccacacctgttcaccacagcttctcttgccaaggtctcccagggtgccttgtgtcagctctcagttctccaacacagtggctcagcagactctgacatagatgctcaccctcctgggttgccatcctctcctggttccctcctccctccacctcctgtctccttttcccacttctcttctgtccgacctccttattggagggcccccctggggcctgggcttttccgctttggcaggctcacacagtagcatggctttaatgtgctaatgaatcctggattgtcacatcctggccagaaagacctctgtcctgaactggctcttgtatccctgaggctacatcacagttagatgtccagtaggcttctcaccctaacgtgggaaacacacctgctccctctgcatgtccccatctcagcagatggcagttccattctcccagctgctcaggccaaaagcctgggggttgtgctcctctcttctcttgctctcatacccacatccagtccaccaggacattctgtgggcctaactttcataatgtcagaatctcaccaattttttaccatgtctactgctgctcccctggttggagcctccatcttctctcgcgtggtcccctcctgcccccgacagcatattctcaccataatagagtgacattttaaagtcagatggggtcagtccgtatactctgtttaaacccttcaagggctgattacactgccccattttaagacttaggatatggctgcagttgtcaggaaagtgtagttctggcagagggacacatacgtatgtccatgtagcagaatagagaggccagagatagactcgcacaaagatttccacctcattgttgacagagatggaaaagcaagtcgatagaggaaggatagccttttcagcacataattctggaacaactggacatcaataaccaaaaa

SEQ ID NO: 90222 - DNA, 1046 bp, Homo sapiens
gttcccaggctgcctccttattgtatagagggatcctaatatacggaatcctctttccttccatgtttttaggttcccacctgcaattacctccttatggtagatctttgtaagtgggattcttgggtgaaaggatgtacacttctacttttttttttttttttttttttgagatggggtcttgctgtgttgcccaggccgtggtgtgatctcagctcactgcagccttgacctcctgggctcaaccagtcctccctctggaatagctgggaccacaggcatgagccaccatgcccagctaatttttgtattttttgtagaaatgtagtctcttgttgcccaggctggtctcgaactcctaggctcaagtgatctgccccctttggcctcccagagtgctgggattacaggcatgagccactctaaattttgatggatgttaccagagcaccctggggtggcacaccagtgtgtgcatttctcggttcttaggagtggaggaacttggttgcgcctcattcacctcccttcctgaatttggctgtgtacttctgttaaaaagggaaatgtatggaataattttttatcccctttagcttataaattctcttaaaagtgaagctgtggcaagtaataccttgtctattctatgaaagaatttcattgtctgaaggctcaaagcatcagaaaagtgaccggaggcagcagctgactacatgggaaactgagtagcaggctcagagccatttctggagtctcaagagtgtcctttctagcaggttttgttgtagggacttgctctttgttattttcctttgaacatggctgcctacattgcatagaccagtgctttccaaggcttggggatagaggaacagagtatgggtgttgaaattcattgcccttaattctgaaaaacagaacattttaatcaagtgtgcttcctttcctattacccttggacctagttttcttgggaacatagtcttgagtgtatatagtaactgggtatctgtgccttttactgagttccaacatggggaccg

SEQ ID NO: 90223 - DNA, 1001 bp, Homo sapiens
tgctgccaataggaaactcccgcgattcgctgcctagttcgccgccctcacaagactggactctgcacaggccatccatgcccgctggtgcacctcgctctctcgcacgcttaacccgcggggacgcccccgacctcccacctcagccctcgccacagttagtcccgcccttccgcgcagactccgtggagtcctgtcacgctctccgcgcgctgcggcagccgggagattgtgaagggcacctccggcagccaattaacacccgcatactgggcgggaccacgcttgggcaggcggagggggtcgaccgaaggcggggacttttgagtgacaaggatgatggccaaccgtcggaggcccttctactgcgccccgcccctgagccggccgcccagcccccagtggggttcccggcgcggggaatgtcccgggtggagctggctgagtcgcgcgctctgctccacccgacggggctgtgtgtgctgggcctggctcgcggcgaaccgagatggcagagcagtcggacgaggccgtgaagtactacaccctagaggagattcagaagcacaaccacagcaagagcacctggctgatcctgcaccacaaggtgtacgatttgaccaaatttctggaagaggtgagttggggatgagcggcttggggcgcagggagcgtgggccgggtttgggggttcactggcatgacctgtctttcgcggcccggagtccgcatacctacgcctaggcgcgccccccgagttcgctcacctgcgcgtgtacgcctgggcgcgcttccgagtccgcacacctgcgcgtgcaagcctgggcgccccccaccgccccaagtccgcacacctgcgcgctcacacctgggagcgctccccgagtccgcacacctgctagtgtacacctgggcgctctcctcgagtccgcacacctgcgcgtgcacacctggggagcgctccctgagtccgcacacctgcgcgtgtacacctgggagcg

SEQ ID NO: 90224 - DNA, 1044 bp, Homo sapiens
tatcttagtaaaacttgtaccaaaaatcctagaaaatcattagaagaccttaaaggtaaatggcagggatacttaactgctgaagtttgcaaactaacttgtttgtatcatcccattctaaaacaatatcaaatattgtgtgctgacttggtattggaactctattggtaagataatttactacctttttttgctgtttatttttaaaggcctgattgctgagacactcagtcaggaaagtatgaatgattctaggcagcagtctctgttcttcatcacacttccagatttaaacaaactctgtgctgtcagaataatactgagtaataaggtggcagatactgagattaggactatacaaatgaagatgtgcaggtaaaaaaatacatcttataactaagacttttaaaactttgagacctataaaagctgttttagaggaattttctataaagcaaaatactcattcactcaacttgtgtttataattttaaaataaaggaagtcagattttgttttgaccaggtatattggattatatttaaggagggatttaaaatacttgcaatagaattatctcactgttgagtttttatatctgtgacctcttatgtgctttttaaaagtttaaaatctccacagacattcatgaattaaattcaggctcccagaaacttagaggtcctaattaatcaatatttatggaatacctactgttttccagtaggtatttccagtaggtggggcacttagagatcctataaacatcttagattagtatagtttcttaattctcaagtcagtatgagacactgtggagtatttctctaggatctgtctcaaaatatctgatcccacatagtcgttgaaaaacagcttaagagggccgggcgtggtggctcacacctgtaattccagtgctttgggaggccaaggtgagcggatcacgaggtcaggagttcgacaccagcctggccaacatggtgaaaccccatctctactaaaaataaaacaaattagctgggcatggtggcaggcacctgt

SEQ ID NO: 90225 - DNA, 1510 bp, Homo sapiens
aaaataagagttgtgacatacagggattgagaaggacttggagcactttaggggagacctgtcgggggaccatctgcccagcatgaatgagccagtcccatgaaacctggggttttggctgcagctctctgctctctgctgtggtgcccttgaggtgggagttgagactcaacatgtagggcagggcttagacactggaccaagttgaggactagctaaaactggaatggggttgaagcagctttccataagacataaccaccagtgtgccatgtcagtttaccattgccacggcaatacccgggagttactgcctttttctatggcaatgacctgacaaccccaaagttactgccttttacctggaaatttctccataaaccacctcttagtccacatgtaattaaaagtaggtataaatatgactgagcagtgacgtgacatgcagcccgcggtctgtacggacgcgccctcgcttcttcctctttctcgactccatcttcgcagtagtggcagctgggaccgcggttcagtcaccaatatgcagctctttgtccgcgcccaggagctacacacccttgaggtgactggccaggaaatggtcgcccagatcaaggctcatgtagcctcactggagggcattgccccggaagatcaagtcgtgctcctggcaggtgcaccgctggaggatgaggccactctgggccagtgcggcgtggaggccttgactgccctggaagtagcaggccgcatgcttggaggtaaagtccatggttccctggcccgtgctggaaaagtgagaggtcagactcctaaggtggccaaacaggagaagaagaagaagaagaggaagaagaagacaggtcaggctacgcggcggatgcagtacaaccggcgctttgtcaatgtcgtgcccacctttagcaagaagaagggacccaatgccaactcttaagtcctttgtaattctagctttctctaataaaaaaaaagccacttagttcagtcaaaaaaaaataataataaaataaataaataagactgcagaactgccttgaactgctaacctctgtctctgcaggaacagtcacgaagctgtcacactgctgcttcagttaagctgtttcctctggcttgcccttgaattctttcctgggcaaagccaagaacctcacaggataagccccactttggggctcacctactctgcatccccctcacaccaggctggcagtcagttcatggcctgggtttggaatccaggtgattgtaggcagcaggtcctaggacctgacccccagtgctcctcccctggcctcgtggccatgttatctctgactttctcagaatgcaggcagaccacactaggattcattccatctcccacggtctaggaaaacatttgaaagacaaagattaatgactagggttagggatccgggaaggaaggcgaaaaacaagaggaaagaatttgttggtgggtgtcagatggtatctggagcctgcagga

SEQ ID NO: 90226 - DNA, 1012 bp, Homo sapiens
ggcagggaatttcacagtgttcttttatacaatgtctggaatctatgaataacatcggtttttaagtcatgagttgatttttaactactaggtttaggccaggcaggcccgggtccggttttgggcctggcgccgggctgcctgtctttgatttcacttccttgttttttttttgtttgtttttaaacaggtactgagtgtaaaacaatatgagagggtctctctcttccctcagtacaaacagtttttaaaatctttaacccaaagcacacgtgatgggtctgtcctatttccaatcagcctgttcaactgcagcagccacagagggtgagcctggaatgtggcaacgttacgggagcctcttctccctcaaggacaccttttcagaatccctcgttgcttcttgtccacaaacagaaactcgcaaaatgggtggctatccagagtgtgtctgcgtggccggagaagagaggcgaaatcaggaggatgatggaagttgctgctgcagatgttaagcagttggggggctctgtggaactggtggatatcggaaaacaaaaggtaggaggcaacattctttgcattgcaggaccgtagacagattctgcctgaggggttgacaagacgccacaagttcttaaaagatcttttgcttcacataccccactcacctttaaaacaaaaaaggaagggcctgatttggatggtaagttctgtacgtgactgcttcagttggattggggcaaaggttttgtggcactcagcatttttctccaggaaggagaactgctgacagttactcaggactaagttaatgtaacagtcattctgagagaatggctgagattcccctcccagcaatccataagctttcaaactaggaagttacactttattcaagtccatttaaaaattataaagactccccccaacccccggctccccctcacacacagtgctgcgtccttgagccttatttttttattttttttatttttttgagacagagtct

SEQ ID NO: 90227 - DNA, 1030 bp, Homo sapiens
gtggccggcacctgtaatcccagctacttgggcggttgagacctaagaatcgcttgagcctgggaggcagaggttgcaatgagctgggatcacgccactgcgctccagcctgggtgacagagcaagattctgtctcaaaaaaaaaaaaaaaaaatttaccaaactgcctgcaattggcaaacatgtacatgtgctctggagtacaagaaagtaagaaagtaaatcttaattagtgactccattgaacagtgtgctcttaaactctacaatagaggttgattgataaggacagataaggaagctcaaggtcttttaataatctccaccttaagcactgaatttcttaaacaaaggctgtccttggttcctttcctctccatgctcagctccctgatggctcggagatcccgctccctcctattctgctcggcaggctgggctccgacccacagaagaagaccgtgtgcatttacgggcacctggatgtgcagcctgcagccctggaggacggctgggacagcgagcccttcaccctggtggagcgagacggtgagcgccgcgcgcctatgcgtgcccagaggaaaggcactgacttttggaaagtcattgctagtccgtttttctgtttccagtacagactgtttttattttattttatttattttattactttttaaaaatctttttttgagacagagtctcactctgtagctcaggctggagggcaatggcaagatctcaattcactgcaacctccgcctcccggggttcaagcgattctcctgcctcagcctccccagtagctgggattacgggcgcccatcaccacgcctggctagtttttttatttttagtagagacggggtttcaccatgctggccaggctggtcttgatctcctgacctcaagtgatcccccccacctcagcctcccaaagtgctgggattacaggcttgagccaccacgccgggcacagactgtttttaacgtaagctagaaatggaggtttcttacaggtgcctctgttgct

SEQ ID NO: 90228 - DNA, 1008 bp, Homo sapiens
gcccacgatccgagcttgacgtttactaccggggcactaggggaccaggattggtctctgggctgggcagtcagactgaagctgcacttgagaaccggggtgctgaattctgaaggcaagcagggctcagggcccccaagctgggatgggggatgctccccaggaagaaggcagagtgtgtctgggctcgggaggagtcaccccacacctgggtgttggctcacgacaccagccaacacaatgatgtgttcctctctaccaggtataactacatagagggaaccaagatgctggccgcgtacctgtatgaggtctcccagctgaaggactaggccaagccctctgtgtgccatctccaatgagaaggaatcctgccctcacctcacccttttccaacttgcccagggaagtggaggttccctctttcctttccctcttgtcaggtcatccatgactttagagaacagacacaagtgtatccagctgtccacgggtggagctacccgttgggcttatgagtgacctggagtgacagctgagtcaccctgggtaagttctcagagtggtcaggatggcttgacctgcagaagatacccaaggtccaaaagcacaaggtctgcggaaagttctggttgtcggccgggcaccacggctcacacctataatcgagcactttgggaggccaagacaggaggatcacttgaggccaggagtctgagacaagcctaggcaacaaaacaagactctgtctctacaaaaagtttaagaaatgagccagacatggtggtgtatgcctgtagtcccagccactcagaaggctgaggcaggaggatcgcttgagaccaagagtttgagcctgcggtgagctgtgaatgcaccacggcactcaagcctgggcaatgtagcaagatcctgtctctacaagaaattttttaaaaatgagccaagtgtggtggtgcatgcctgtagttccagctactcaggacactgacgtaggagggttgcttg

SEQ ID NO: 90229 - DNA, 1060 bp, Homo sapiens
cggggtgcagtggccgctgacctctgtcggttgcgctgggttttgagtagccatttatttcattggggagttttggaataggacatcccacatccgtggacacacatgtagaatacttttataagtaattacagtcttaatagtgatttgagttacagctttgcagtctatgcctggtgacatcctagtcgtagtatgtatctgttttgtggtgaagtgctggtccatttagaacactgtagacaggggccctaacatatactcatcagaaccttattaagaagagcttatatgtcatttggcatactcactgtgcttcatttagtacagcaatcttgtgtagtaggaattattccctttttacaaactgagactcactttgctatatacaaaattactgctactggtacaaggtaaagctttcttcttgcgtgacatgtaaggcaggtgtgataattgctcacaacacagttgctactggtgcatttttttttaaactttatttcggaataaattaagatttacagaaaagttgcaaacaataggacagttccattggtaccttttaagcagagcaaagtggctccacttcaaaaacactggttcttgctttatgccaaacacccttctaggtgttggaaatagtaatatacttccctagaggattttgagatctggttgaatagacacataaataaatatatataatacctttttctgcttactaaaatagagatgtgggagcacagtggaagttacggctgattgatggtggggagtggtgaaagcttcttgcaggatatgtgatttgagataggtctcaaggactagtgggtattcacctggttgaagggacattttccccaacattcattccgattaggtttgttttattagagtagaactcgctaatcttaataaaatatactctcctagtttgattcttctctttctcatctcctttaagaaggtggtttgtatcccagatagtgagaagaagcctagtttctaaatctatgaataggcgaataaattaagctgtatgtttctaattgatagt

SEQ ID NO: 90230 - DNA, 1048 bp, Homo sapiens
atgtcttgcgtcttgaaaagttaatcttcctaaagcagggctgtgtctcagtgactccctactggcaccaatgaataaaatccagctcttaatatggagccttctgtgatctggacctggtcgaccagctgccagttttctaagtcagtctgtggtagaaagccagtgccgtggccctctggatggctgagagctttcttacgtgctcgtggtttgtgttttagggctttgccagatcgctgccttctccttgagatatttaactgttcctacttgccccctcaacaaacgacaaacagttttaatttcctcaaggttaggctcaaatgatatttttgctatctgagttaaatattctgcttgggagtatgattccttgctcacgtatactctgtagatcttagtttgcattgtgcacatgatcatgtatggccttgtattgaggtccttggtgtgtatgtcatgtggcccccacagaatcttaccccaatgcatgagtacatttgtatgactacagttcctttcatgtggtagcattcaatatttatttgttgaatgtttgttgttatttcttgatatagtgagatattgggttatttcattaatttagaaattcagttgtgaaataacaaatgtggaaacttttttccttttgttttagaattcttggagccattatttagaagattaaggctctcattattttgcttcttagttgtcattctttttgtctgtaaaaatatgagtcagatgccctcaacagagtgttcgctctaagcaaatgtgtgtgtgtgtgtgtgtgtgcctgtgtatgtgcgtacgtatgtatgtcttccctaagtaatgtggtggtgtgtgttccctttatgtatttggaaagtggaactcctgctggtgcctagtgaaagggacagtcgtgcactgcagcagtgtttgcagatgaagacgtggtagactgggcatggaaagggagttcctgctgttttagactaagcattaaaatgtttttaagcagaacttctgttacagattttttaaacattgtatc

SEQ ID NO: 90231 - DNA, 1825 bp, Homo sapiens
gaaatcactttttctaccaaagataccatagtatttcttctggagtcaacaatagggtgacatggtgttcctaaaatcctacttcatactttttgataaaagactttagacatgtaatcaaattcatctcagtataaagggtgtttcattggggctaacttcatgatactttttcatctagttttagactaatacgtgtgtctttatattcaagatttaataccatgtttgtttacttcacaggttatgagtgccagtgagccgccttagatagaagcatcgtcagcactttattaatgatggatagtgagaataaacccgaaaatgatgaggatgaaaagataaacaaagaagcacaagacttgacaaagctttcatcccataatgaagacggtgggcctgtatctgatgtgatagcaagtttccctgagaattctatgggcaaaagaggtttttcagaatcatcgaactctgatagtgttgttataggagaagacagaaataaacatgcttccaaacgcaggaaattagatgaggcagagccccttaaatctggaaagcaaggtatttgtagattagaaacttctgagagctcagtcacagaagggggtattgcattagatgaaacagggaaggagacctttctgagtgactgcacagttggaggcacatgtctcccaaatgccctctccccttcttgcaattttagcactattgatgttgtttctctgaaaacagacactgaaaaaacatctgctcaggaaatggtttcccttgatctggaaagagaatctcctttccccccgaaagaaattagtgttagttgtaccattgggaatgtagatacagttctcaaatgcagcatctgtgggcatttgttttcttcttgctctgacttggaaaaacatgctgagtctcacatgcagcagcctaaggaacatacctgttgtcactgcagccacaaagcagagagcagctcagcactacatatgcatatcaaacaagcacatgggccacagaaggtcttttcctgtgatctttgtggttttcagtgttcagaagaaaacttgttgaatgcacattatcttggcaaaacacatctccgtcgtcagaatctggctgctcgtggaggatttgtacagatcttaacaaaacaaccttttcctaaaaaatcacgtacaatggcaacaaaaaatgttcactcaaaaccaagaacttctaaatcaatagcaaagaatagtgattcaaaaggattacgaaatgtgggaagcacgtttaaagatttcagaggaagtatttctaaacaaagtggtagtagcagtgagcttcttgttgaaatgatgccttccagaaatactttgtcacaggaagtagagattgttgaagaacatgttacttcccttggtctagctcagaatcctgaaaaccagagtagaaagctagacaccttagtaacctcagagggtctcttagagaaattggaatctacaaaaaatacccttcaggcagcacacggtaacagtgtaacctcgaggccaagacctgagcgaaatattctcgtgttgggtaatagctttcgtcgacgaagcagcactttcaccttgaagggccaggcaaagaaaaggtttaatcttttaggaattaaaagaggtacaagtgaaactcagaggatgtatatgaaacacttgagaacacagatgaaaacacacgatgcagaatcagtgctgaaacacctggaagcgtgcagcagtgtgcagagagtgtgtgtgactacctcagaaacccaggaggcagagcagggccaggggagtgcccgtcctccgga

SEQ ID NO: 90232 - DNA, 1983 bp, Homo sapiens
acaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttttacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggtatgtagctctgcagcaagccaagtcagtgaggacatggggccatttgttcccatccagatatgcagccctacctgtggctgctcattggctttccacccggttcacatttcactgccgtgtgctgctctgcttgtctgcaataagtcattgttgacacttaacatttttaagggtaattaagccctagtgatttcaaaggcaggttagctgacaagtttcttttaattttgtcaaaaagcctagtccctctgatgccttttaaaaactgctgtctgttggcggcttttcagttgtttctgagtcctaattatttgattttccaaagtctgtattaagtggcaccttataatttcagaagacatgttaagtgacttttaaggaatggagtaatcaaattttcttacaatatcagg

SEQ ID NO: 90233 - DNA, 1094 bp, Homo sapiens
gtgagtaaattcaaagccggagaaatatgaggaaacaaggaggtggccacagagaaatgtatttgatgataaatatgcttttaaaaatatcagctgccctgagtgcatttatgttttaaaaatgttttctttgaagtgttgagtgactttaagatgtatttttgtgaattataagaaaaatatttaaaattatgtagctcatctcatcgacttagtactgctcagcagtctcacttttgagtttgaatcttaggattgttagtggaagttaggaagactcactgaaacaaagtcttcagagtaaaataattatggaatcaggtctattcaagttataaatgaatgcaagtattccattttgggtacagaaattcttaattaggttaaaggtatgatttaagatttagtcctcttttctaagctattggtgatgtattattcaaaatcaaatcatattttatgttaaatttactcaggatcaaaaccattcaagtgcaagatatgccattttgcaacagctcagcttggagatgccagaaaccatgtgaaaaggcaccttgggatgagggaatacaagtgtcatgtctgtgggtgagtaaattgaagccatctctgctgcgtgaaccaggaagcatgtgcaggatagccattgtttcggaattcaaaaccgataggagtaagagtggctaaaattatgcatgcgtaccctcctttccattgttatggtaaattccttaaatacagttatgacattcttctcccacttctaatcctgtactgaagatgagcaattttatgggctacaaggtcaatttgaacctgtaatctgtaaattgactaaattataggatgttcattcacattgccagagagaactataaattccatttaaagacatacaaaaatacataatatagctttaggaatgtatatgtatttttttttcttttgctgtactgcttcaatttttatcacagtagtagctctttggatccattggacttattctgtaaggaaagcaacaaaagatttaatttcagatggctggttactgattattacagggatgatgctgaagagaactgttgttatgc

SEQ ID NO: 90234 - DNA, 1027 bp, Homo sapiens
agcacttttatgaaccatggtctgtggaattgatggttcagtgacttgcagctaaagtagatgaagatgaccctttgccctaaagtcccctgaagatgagtgggagaatgagttttgttgctactgattttagctgcaagggtcaggtgtcaaatggttcattttaattgctgcaggtcttggaagtttaaaagatatctcatctattgtttttaccatatgagttataggaaaggagaaggccctgactccagtgaaaatttgctattaggtggcagtaagcagtttttctctcatttctgagaagtaagtaaacaatttttgcatactgttgtcaatagagatctaattccatttattttttaattagggttactaagaccctagaaagagaagaagaaagcttttcacagaacagtttctaatgtgtctggtatcaaaaagaatacacaattgatcggcattagttgtataatttgaacagtgcccaccctgctcgctaactgcttacctcatacaactgaaatactgtatgagtagttcatatatttgatcctggagatacagaattgtacatgattatacatatatcgagttttatactgtcttcagagagagagctatgtgtatgtgtgcgtttgtagaacaagcattctagagtccagaattgtattttttagaattatgacagcattgaatttcatcagactaggaaataattgttctctttgtatttttacaatgaaatttgatttaaaagttaggtagcaataattttaacagtgacgctgagagttctgaagaattgcagtaaactgaagagtacttactgatctttgtagttggaacagaatggtagtgaattaggtacccttcagtgttgcagaaaaagtatcataggttgttccctatttcatgtgtttcaaagggatagggcagtgtgtaggttaaaaattaaagtaaaaaacataaaaaagtgcaaggattggttatcagattactggcactagagagtatttatacattg

SEQ ID NO: 90235 - DNA, 4147 bp, Homo sapiens
gtagttaatatcttagtctctgccttttagaattttcttaatgagctcttcattatttgagttttaaggagttatttctcaaatagtcttgattaataatataaaaaaattgggcagtcacatttttaaagtgaaattattactcagaatactgtactctttttcttagtaacctcttggttttcttgaagaagaaaactaatactttatggtgaaattgatggaaacaacaaacagtattgagctcaatattaatgtctcagattatttgtaatttacctctttttcagatctttatattagatgattttggatgctcatcaactgcacgttttgtgtttttcattaacacgtagttttagggttgtgacaaaaactgccttttaaagttttgtataagttgtatgaacctagactgattttctttgaatcttcaggatcagttttaagataccattacccccttttgccctgccccactggcaaatcttaactaccgtatatcttgggtttaagttagtttgacagaagaagctgaatgtattagatgcctaattcctattaggtcgttaggattaagagttcagaatttaagttttgtgtactcaaggtttacctgctcatgtcatggtaaaaatttcaaaaatgtattgctttgtacatcatgttttaagtacatgttatggataacttcaggttaagagccatttattttactttcacttttgggggaatctttttttttttttttttttgaaaagttgagtttcttacttgttaaaaatatccaaatgtgatcgagagaggaattttatagaatataggtgtgtttatatttaggcacttgatggatagttaacatgaaaatctgttatgactctgacatagggcttagtgagagagaaagtaagaaataatagaaactatacctattttttatagttaatgcttttatttaataattttgtgtttagaaaataggccaaatgcatatttttattacatccatgatctttacctttatttctttcagtagtcaaaaacgtaaaaatctcgatgacttacaaaagttattttaggcaccatgtcttgttaaattcttttaagtttattttattctctatgtacatataaggtagtatacctggtactctaaatagtatttatgcagtgcattgtggtctaataaatagccttgattaacttttatctcacttgttgatttccatagctttgtggattgcttaccttatccttcttatccccattttactgatgggaaacttaatattcaaaatgttttcagtgatgtacttaaattatttgactagtaatggtagaccactctttcttccttttaactatttcttttctatatttctccactttttgtaatatctgtttttgttcctgactttagtttgtactttttttttctctctaggttgttttcactgcatgtaggaaatgtaacttatctactttctcctaccatccacttttattttctgcttttgcccacatttacatttttttaaaaaattgcttacacattgctttactttcatattctgatattgtctctctctgtctctccccaatactttccctattttatatttcccacttattaagtgttgttttaaatagttttattttttcccactcattcatgtgttgattattgcatttacttgtgggttacaaactgaacatatttgtataatagcaggaggtaagggtctaaaagtataaagattatatcatcccattaaggtgagagggatataattgataaactagggttattgtttttgttctgcagtgttagttttttttaaagagttgtagaaaactaataattggcctgtgatttcagtaaacctaagaaatgataaccaagtttgatatgccattattgagaagcgcagaccctggtgtgcatgatttaggagttgcattgtttactgattgatttacctaagtctcgtcttgattcttgtgtatggagttaaatagttgaaatgaatttacctaatcaggagagaataagggcattttctaaatctgtgacatctgggttcatgaaaagattccagacattttaaaattgtgtattaatgtgcttatgaactgtttattcctagttggtttaagaaatcttaaatagaaagttactaatgcagtaaaactctttgtgtgtgtgtgtgtgtgtgtgtgtgtgtgtgtgtgtggcattacctagtttttgtgcattagaagggatctctatgtagatgattataatgtcactttctgacctttgcagcttgaataattgtaaatcattgcttcataacgtgtcagagaatgtctgtactaggcaattaaatggcagaatataatagaccaaattattgcctgtcatgttttcaacaacacagttagtatttgagttacacttaatcattacgtgcattagcaacttcattggaatccagcttcaggctgagcatgaaatacattacattatttaaacctctaatggtacaagtcatttatttgtgttgaagtgtacaacatgcagagtttcataaagcaaggaacacttgagagcttaatttatccaaatcaaagtctaaatgcagataaacacaagtggcaaaaattagtaatttttataggctggaaatatttaaaaatacatggttgtgggtaattgtaggcagcaggaataaattaaaatcactatttttagtctgctgtgagaactaaagctgtgtatacctaaatcattaaaagcaccatggaattgcatttttagctgaacaattagttacacccatcatatctacagatatatccaaataaaataagtatttggtttagctggttgttttggttaaagagatatagataggaaatgtttattctataatgtggcatgaattatgcttataacagtataaagtgcaacatctctcagttttgtaaaaaatatttagattaacattaaaatgctctcccattgtaaatgatacgttatatattttatccatataatattttaatattttttgttgaatatttttgtctttagcttgaaattttaaaaatgctatgtgatgattgctgtctctctacctcagttaggaacaaaaaattaacattatttgtgtattcctctgatgttagaatccttgagataccttttatgtactgaatgaacatttacgatttttaaaactgtacaaatgactttattatgggaaagcctaggagtgatcttggttatactattcacatataaaacttgttttctcagatatcatcctcgtgtattttccagtgaactgtttggtgaagccgggagagtgctggggtgttaggacagcagagtggaaactgaggcagcccccagctcctcctcacaggggaaggacagctcttgtctccattatatcctggtttatttttctgtggtagtggtttttaaaatttttgccacagaagggtggggtcgtagatgtattccatggccagtaagtatgatcaacctataacaaaatagaaataaactaaatattatcatttcttggtgtagtagttgaaaacattggcttctgtgtctaaagtcttttccagtgaaacaatcatgttctagtgacttaactcgttgcttcttcttcttcttttttttttaaagtggcttccttgtgattttaaaatgcaattgtgatggctggatgtggtggctcatgcctgtaatcccagcactttgggaggctgaggtgggagaatcgcttgagcccaggaatttgagatcagcctgagcaacatagggagaccctgtctttacaaaaaataaaaataattagctgtgtgtggtggtgcatttctgtagttccagctgtttgaggggctgcagagggaagctcttccgagcccaggagtttgaggctacagtgagctatgatggtgccactgccctccagcctgggcaacagagcgggaccccgtctctaaaaaaaaaatcttcttgtagagtctcaggattctgtaaccttcctgatccccacagtagaatattaggtgggtagccattctcctgatttcctttgcctgttccgtatttttttttcttgttaaccttcctctccctgttctg

SEQ ID NO: 90236 - DNA, 1132 bp, Homo sapiens
catataacttaatgcagcatagttccaaataataattaagaggacatatgcagttacgtagccgtgctacctatgtccacatgtaactaataccatggtaccagatgctgtaattgtttccatacttgatcctctggatgggcaatttcagttgggacaggaaaccattaatttttaaaaagtatgtactgtgtagtaatctacttactttcctacatcttagtcctggggtacttgtcttgtttctaatcgcttccgtggtctgtgtttctggagtgttctccctccgcacccttgatcccctgtcacttttcttctgagaccctgtctcctctttcccctgccttagcattagtataccaaagtctgttgtctaagtagcaaagtactgagaaatagcagtttcaagcactgtagaatatgctactatctagatatacaaatttttagaaagttatttttggtttgctatttccactcaattttaaaaagtcctatttactgctgaggtactataagaatatattgagctgggctcaagggatggttgtttttgaaggaccaataaagtgttaatttgcatcataattacgctgtcaccattacatgtgttaatggggtactggaaaattcttataaaatctggctaaatgtaagatggtctctagtctattttagaagtgctgctgtaagtgaaataggtgaaagtggtcttatgtcaacacatctggtaattatcattataatattagaaaataagtatgattttttacattgtggctagggacattgatagtcaaatgcttcacaacataaatttgtgctagtctgaaaaattggaatgtgtttaaatattaaagacattttagtattcaccactaaaatttattttaaaaatagggttttagaacttacactgttgcctggtccaatccatctagtggacaggtaaagaaatttgggtcaagagcttaagtgacttttcacaaatggagacaagaacccaggacttgtgactctcgggtcagggctgtttctattttatcccactggcattctaattagctttaatgtagctcttaaacttttcagtctcactatttttagctaccattctttttaacaagggaaa

SEQ ID NO: 90237 - DNA, 1016 bp, Homo sapiens
tatactgagtacagaccagtgaaatctgtcacagagcccttaatctctcctgtcagattttaattgacttcctgtaggtaaagatgacttcatggaaagtttgctcaagaatttgatatcatcaagtagagcagcttttccattcaagtacagtatagtcccccttttttctacccttttaaagaggcttttgaaaatattattcagagctataatgtaggaaatcacttaaaattacagcagaaaaatatctaaagatcaaagttaagtacctttttatagcgttgccaaaatattcagcatatttctgtttcctatcattatctaaaacacatttgattgttggaagacagcagtatgattatatttctagaaataaagggttttaatacttgctagggtttttattcatcgagcaatttcaaaatacatcgtagccttttcctgtttaaactaaatataaaataaaaatatatatcatggaaacgttactgtggaacttacggtattttaatctttattatttgtttttgcttattacatgaatattgcttatattttccccccatgctgagaacttaaactaaggcagttagatgtaaaaatcatgaaggaccagcagagggcaatattatgttactctaacacttctactggggtaagttttgtgattgaaacaatacaaaaggttttcaggggtgggtgctatatttttctccattagtttcatattacaacttcccgaggtgcttcctcccttggtctgaaaaatcaaaacaaagaactattggcaaaactttcctaagtcagaaccaatgcacataacacagtttagtttctccttcggtaaattacattttctcagtttcagtcacctctcacatatagggtatgttaggtgtttatagctgatcattagtgagtttggaataaatttaagcttgcatttcaaatcagtcatataagctatgactggacatgttccataaaaacaagggaggttattagcaaagctt

SEQ ID NO: 90238 - DNA, 1190 bp, Homo sapiens
ttctcagttgtctatattttgagtaacaaaagaatattgtgtccattaaacctgccatttgccaactgaagttagtaatagtaacttaggtttaaacacctagaaaatgatgggcctttttatgtctatggtttataaaattataattttgtaatctcagtatattattaatatatatttgcagaactattgtgaaatattactaaccataaaagttgaatctatttttgactcagatctttagtatagggacaatgggtttttagcaattaaatgctaaatatatttaacatgtatcgatatgcttatatttattgaatcttcatatattgattcatagtgattagtttcaatttcagtaatgtcttttacaaaatagcgatactacaaactaacatgttggaaaaaagctcatgcttatacattatttaaagcatcagtagattatcaaaaactaacgtaattatgcacacttagtgtttccttatgataacttattgaaatgatgtatgctatttgaaataaaatgatgattttagctattttttagaaaaaaatgaattgacattgttggcttatgtgttatcatgaacatgctaatatattattcattggactcctttttttgagtgaaatttatgtccatcgatataattttaatgagtgctcaattacagacttttaagtatcaatacttcaaaatatttagttttacattagcaataacagacatgaaatcgttgcattgacaatcgtaggtcttgataattcaaggaataattctgctgctgatcatttctactaaaaaagagaaattggtagtaggcatactattagaaatttgttattgaaggaccatttgaggaagtataaaatacaggataatattttaatttcttgacatcaagaatgaccttattatttaccagtaggtatagttagtcctattagtctccctctaatctgattaaggcagtaaacatggcagcacctctggcatttaagtagaattattatttttaatggtttttctgacagaaaaataaaggcaatgttttggccagactttaaacaaatttctttgatttcatttctatgaaaattctttcagtgccaaactgaaaaatatagtgcaaacactgtggttatacctctagtttataatttggtaactaaaggaactcacttgc

SEQ ID NO: 90239 - DNA, 3021 bp, Homo sapiens
ttactcttaaaatttctatattatgtgacaaatatttttaattattaaactgtgtagaaaatgcattattataagaatccttaatatattctgtaagttactgcatctctaaattcagtcattttattttagcctttaagttgaaacactgtgagtcattaacacttgtgttggctaagtttcatggcttctactaagcattatttcaaatgcaacacacaaatatacatatatattagtatatatgtccttcactaatctggatccacacctattttagaacataatttaatcaagttaaaataatatggatacaaatttattatttgaaaaaatatacattaccttatggagtacttaaaatctgccttgcaactggactggtatctatccactagattatagaaatcacttgcacgcatagcatggatgataagtaccagtattgactcttatcccttattcataaatataactgtatgatgtctgagtaaatgattctgaatttattgtgtatgtgtgggttttgcatgcaacaaaaaattggaaaggggctaaacattttcccctctcctcagactactatgtaatttgtctatctactttcagtgaatatttgtttttctttatttgaggtgtgtgggtgtgagtgcacacacatgcatctgttcatgctcacgtgtataaaactgatgtgatttttatgtcctgcagatattggtacaatcagtcggttcaaggtttagcttgttttattttacaaatgaaaacgtcggttttgtgtgatacgatgagactgcaatattagatccttttaaaatcaactgccaatttatatggctggctacaactgcttattctattattaataagcatttttgctcaactatataaattataaaaataatgctaagattctaggagaattttatatttataatttgtataaaaattttataatttcttgaagacaaatgaattacttttgtattttttattgctgcttctgtatacatttatcattataatagaggcagattaggaaatgggccacaattgtaactaattaaaagaaattttactcacacatttgttaaaggatagttgaaatattcagatgcatctttgtgaatcaaaggacttacaattcaaaactttagttaggttactttacataaaaataactgatttatttttctaagacactaacatattaatgtgagggattttttggtgtgcagttcattttttgggggtatatgttagcgttcacatacatacatacgtacatacatacatttatacacattaaaagaaaatcctttttttgttgaagaccttaaaggacaaaggatttttgaccccaccctgagactgtgcaatgtaagtttacaaaaggatcaaggagcacagattttaataatgcaaacaatattagtcctgtcccctctggcgtcacgaacctggacatactgattgtatactttgattcttaaaccatggagatgtatgagatgccctagggagcacctggccaggctaagaacatttcagtgattacaaggatagtgcctagagggcaattaagggacagggcaggagatctacagtaatgagtccctgtagcacctgatgaaccacagaaagggaagcagagaattaggatcaaatgtagctgagtgaggaagattgttgagtaatgtatagattatttaccaagaataggatttttatactttgatatttatgtaatcaggcagattaaaaaatcccatcacttaatgtatttgacatatccctttaggtgaatttaataatttaagttttatgaataaatgccattgttgttatcctgtattgcttattactgtgcttaatactgtgttgtattgcttattactgtgatatacttcctttgaatgaacattttatttttctccctattgagtttgtaggtgtgtttttattttactaatataaagtaattccagccaagtgttgaactagtttttttttttttttttaatttaagtgtctgtgtagtcttcctgtttgcttacgtattatttttccatagttgtttgtatctacagtggaaggcacagttttcttgatttagttcaagcccgtggaaactaaaattgagggtaatttcttgaaatattttttgtataattatgaaaaaatgatagtagaaggaaaattttgtatagtatgtataatttacacaggagtcttaaatagatttaaaatcaggtgatttcactgctgaattttctgactcatctttcttaaaaacagattaatggcataatacacatatttgtgtcattttctgtttgtccagaaaatgcattattgtgtagggaaaaaaagagagagtgaaaagggaaactgctttgagcgtgagatttgatgtgataaacctggttacttaaccattcgtctcctgtagccctgctgttgtgtacaggtattaatggatgggctctcctacctcattgatctttgcgatggtgtatgctcaactatacagatgagagctgagagagaactaactggctgtaaagtgttcacctccacgttggttcctggctttctttcctcggcattgtctgaatcacttcttataccccactgcagcagcagtgtttacgctgtacttgttccatgttccatcaaatactgtcgtccaccctgggaggtctgcagtgctgctgcttgcgtgaccacgagggggagtcagggagtgtccctggaattcctccccatcctctccttcctccctgtcttctcagcctcttgctctctacttctccttttcctttcttcttcttcttcttcttcttcttcttcttctccctcctttcttttttctctttccatttcctcctctttcctttccctcctttccccctttcttcctctcccttcctttcccttctcttcttcatgtggaactgaaaatattattgctatcttacatccttctccaattgaacatcactacaatagaagcag

SEQ ID NO: 90240 - DNA, 1080 bp, Homo sapiens
atatatcattgtggtttagatttttatttttcaaagattggattttgatgatttcatttttatctttgaaaattcttttgtgtttgatgagataaatccatttcattttaattaaaaatgcttaacctatgtagagctggttgaacaccatgtaggatgctagtgattacagaatctatgcatataaaatatatctatttatgaaattgaaaacaattatgaggtaaaaaagatacatttatgtttaattttgaaattgacctttgacttcagttttacttagctaaaattcgtggctaaatttgtatatatctgaatattctaagaagtttgtttatataattgaatggtagaatcatcttaaaattaccctgacaatggttactggagctatggtctgtgattgtgcttgagaaacaaatagataaaacatttgtgactcttttaatgattatatttcttgatagctttcataagaaagcacataatttgtgacaacttcagtaaaaagacacagcagcaaaactttttgagttagcggcaaagtaaatggggcaggttttgcattttgaacagaaatgttatgagctgtgattgaatttgtcgtgaaagtgtgtcagtattaataaaagtatttaggtacaagttttctgggctttgtagcctttttaaggttaaggattggttaacgtgaaaagtcacttctgtgcatttggtagtatacagaaaatgacaaatatatttctatgcattttggattattatgccatttcttatttcaaaccctttttgtcaggacaccgggcaaaacaatgatgctttgaggacgtaattaaagatattgttcaaagaacaactttctgcatatttgaattattactgtcatcaaaatcatacaaatatggaaatatgattgccagaagcacataaatcaatgatcagcatggcctcaaaatccaataaatatgtagagttaaatactttaaaatgcaaattgcatctgatgatttgcatatggtagagtttaaaggaaatttgttgcttaacaacctctaaggtagcagttagggctgtgggtaa

SEQ ID NO: 90241 - DNA, 1014 bp, Homo sapiens
gcccaaaccacttcacacatgaagtattttagtcactttaaaaaagtgactttaaatccaatggctgatttctaaaatagtgcttaataagttgaagaaatagccttaaaaatcctggtattggtgattgctttttccccttctgctgctcctccagctgtctctctgtctctctctctctttctctctctttttttttactttctgcatttcttaccctctcttatagcatagaatcccagtgcatctgtttttggcgctgcgtatctgtgtgttgctgctcattagcaccaggcagtaggaatagacaagatcatgccctgttcacagaaaggagcctggttgattgagtgcaaaatttcaattttggtgtagaaagatcaggagacctcggtttattgagcctaggcttgagttcgggttctgccaatttcatgtaattataagatcccagccactttatttcaccaggtttcacctctgctttctcctccgcaataaggagattgttcaaggagtaaatcataaaaggatttgaattatttagcactttgctaagcaaatagtgaacagtaaattcatttttttcctgcctattgtatttttaagtttttcctctgttagtgttagtttggctacacagagcagaaatactgatgtaaagtggctttagtgtacatttatttctagctcccataaaataattgtggagttactcagagttggtctggtgcttcttagtgttattagagatcattagccatctttctgccccactgccctcagagcagggccttcactttccacattatctcatggtccaaggtagctgctggggaaccagctattgtatctgtgtccttggctgagagcatggtggtggggcagggaagcgatcaccttcctcccttaaaagagcccatgtgagagtcccatacaatactttggattacagttcattgaccagagctgagtacaagttacagtggtgatgagaaatacgtgttttggctg

SEQ ID NO: 90242 - DNA, 1027 bp, Homo sapiens
ggatgctagccaagtcggttttcttatttgatgtaacataagaacatattacaatggctgtgctgtttttctatctacagttctgggttttttacttattttggtttacagtttaaaaaagacaaattcagtcttgtttctagtggcatttgttagaaaaatctctcatgggttggcttggtgcacttttatgctgacaggcgcattttccatcagggcgattgcgctttgttgtgtgttgtgtgcatgcttgtggtgtgctgggggatctttctgtgcatgtatgcacacttgtgtctggaagagatacgcggcaggttctttttctggttttgagtggatggtgctgggctctaacatttgcttctgcctgttcattggttagctgttgttagtatgtccttgctaaactactggtttagctttctgaagatgtaattgtaaccaggtgtgtgagggcagggtagaaagcagttttatggagcttttgttctaatagcatataacaaatcactggaaatgtgagtcatcagcaaaaggctttataaagcaaaaggtagaaaaatgtgcagcattgcaaattttcctgggtaaaaaagtggatatggcagtcagagacttacgcttttgatttgggttattcttttatgtatattttttgcaattaataatatcttttatagtttataggattccattttcttcctcagagaaataggattattctagaacaacaaactattaggtctgatattaaatatttaaaactaacatttgctgtggggtggtttgtgtttggtttctttgactaaacaggattagaaatgtttgaatttcttctgtttttgctctgaagaacactttatgtctgaattttgagatgctatgcaatgctccttttttcttctctttcatactgttcttattttaaagcaaagcctaaccatgggctgttagctttgtgtcccttgtgtgaatgaatgaatcacacttgtagaacatacaaactatttttgcttgaatacaa

SEQ ID NO: 90243 - DNA, 1845 bp, Homo sapiens
ccgccaccatgcccgggtaatttttctatttttgtagagatggggtttcaccctgttggccaggttggtcttgaactcctgacctcaggtgatttgcccactttgacctcccaaagtgctgggattcacagacgtgagccactgtgctggcctatatctttctattttatttaggtccttcatttctttcatcagtgttttctggttttctgcatacagatcttgcacatactttgttcgatttaagtggaagtattttatttttcttggtcttattataaattgtgctttaataaagttcatttccactagctgatttctgctatataaaaatacatgtcatgtgaccttgtgttctaggatgaattaattctggtagcttttttgtaaactatactgtaccaacgtttgagagtacattcttgttattgttagcttgcgaagagtcattgcattgtcatccccttgcattgtggttgcagtcaatgaaagttagaaataattgattgcagctgcatggctatttaatggcaatgcaaagcaactgtccatatctcttgattctgccacaaatgctttatatactcaccattttatgtttatgtgttctgagtgatagtattgtgttttagaaatctctaagcagtgttgccatttaatcaaatcatttatggtaggattagatagaattgaaagcttccacttcaggatttcctttccactggcttgcctcaggagctgaagttgcccatgtcaaaaggaaaatgtcttacaaaggaagcataaatcattatgttgttctgaccttcatattccttactttttcagagatgcggtatttgtaggttgtgatggcagataacagctgggggcttgagagatagggcaggacaggttcaggcataagtgggcccaggtgggatgctgccatggtgggaacctcatccagatgtcattgtgaggacactgggcaccaagctgtgcaggcagtataggaaaatgtggaaacagacaccaaaaggaggtacctccgaaaacctaacctgggtatgtgaattttttgcttagtttacctctaaaaaaaagctaaattgccaaacgcttgtgatgttatcttggatcaatacctgttaacagagatacagattcattatgctaaacttaaaaaaaaattctcctatatataatggcacacatggtttctttgttaaattatgtcaactgcattctttaagagaaattttagaattccctagactcttaataaaggaccctatggaagaataattcctttacaaggaaacatgcataaaattaacaaagttagaaagatgtaattaaccacatggtttcttgagatctcaagggaaataatactaacacaattaacagaacctacctcattagaaataaaagagaaaacattttgggggaaatgtcatccagctggattagtttttttttgtttttttgggggttttttttggtgtttattatttttgccaggaagtttaaaacataatggccttttagccattatgatatttgattatgtcttatgattttgaaaatcagaaagaatgttaggacaggtatccatatccttgagatttgaagtatttgtgatttcttttggcagttgaagaaaaatggagcataaagtcaggaaaatttgtaggacaaagtggcttccaaaatttagatctatttttcttgtatagtttagctagcatttcattaatattttcctgtattgccaaataattagcaaagtggtagtcattaatttactttgagtacccaatcatatattagcctattttgatttttatttagagtcaaact

SEQ ID NO: 90244 - DNA, 1005 bp, Homo sapiens
atagagaaagtgatttcattgtactttcatattcaggccttcagttttccaggcattgtctctgagcttaaattatttaaattttaatgtcaaatttaacatggctgttcgttttatagaatataaacgttatgattgctttcatatttgagatcatagagaaatcatataatacatgccagtgtcatgtatttgtgccatagaattgttttatatatactatgtttactggctaacatttaagcagaaagcacatcttgaaaaaaacctacttaattaaaaattaaatgatgaattaaaacttagattattcaaaactaataagctacattaccaagaccagcaattaatacactacaatatattcaggaaagatgctaacattttaacatttgttttatgttagaattgcaatttgcagtgcatgctgttttgaaacatttattttgaagagctcagcatgtctgagttaaggcataaatcaatgacctaggatttttaatggttatagaatttatcatagattataattctcgagaatacaaacagcacagaagaaaaaatccaattgtttttaaatcagtggcaacatcatatcagcatatttgattacatttattcattgtaatgtgcaggtcaacagtgcagagatgcattcaattgacatcatcctaaaagcgatctattattttatttgataagattgtttttcctttgttcatgcataatggatataaatcataatcctgacagttaccaagggtttgaacttcagggactttctacaaatgaatattaactaaaactaaggacttctgcagttaagaaaatatgagccatttagaaacattctatctagtgattcaataaagcagaactttaagtgtacattttattttaagatggacatatcaacatctagacttataaccagcatagctgagttagtcatttgtctctcacctgatggttcataccgttgtccttctgagctggttgtatgta

SEQ ID NO: 90245 - DNA, 1631 bp, Homo sapiens
agctattttggagaagatagttgtaacctgagctgtgtctaagggattttagacagttttgagactttaaaaatgtctcctggtaccggtgttggagtgaccagtttcatttgttggcagaggagtggagaattagggaggtacacaaggatgaggcgagctactccagtgagtattttacaagttaatccttactgtcctgcttgctggccttggtccttaatttgctagatttggacaaatctaagcagacattttccatttgttttataggtttatgttgaatcgttttcctgttttgtgtgggattttctacagttaaaatattaaaaggaatattaaatcatactttaagtaataggtccagtagtatgacatagattttctaacatctttgtaatacttattttattgaaaaactagaaataatttgtgagagttggttctctggagacaaaattatatgcacatgtttctcttagtaaattaaagttgcccctaaaatgtgagtttgtattacttaaatgatcattgcccttgacatttacaataagattagtgctgtgttcccatagcataaatatggttaccatgcttaaaaaaacacttcaaacttgtaaacttatttatactttacagtcagttcttttcctaaggacatttggatagtaaactatgtttcgttgaatggaaaatattttgttctactttgtgaggtttattaaatttaatattctgctattttctaaatcctcaaattatcgcagagggagggtccatgtgaagtaagttttaaaatacattagtatacctacatttgaaacctttcactttcttcggagaaagttctagataaagccacctaactagtttacggtgagcagtttctacactgccacttatttggcattttctttaggtcaagactgtctttactgctttctaataagatggtagaaagctgctgaacatgtgcttttcgcaaagagtatcagaggtgtgatgtcactgcatggtgatgccagcactttgcactttcctccatcaagggcaggtggagctaactttattatttcatttcctctagtcttctcctcagttctctctcccttgatccccacctccccccaattctagatctcagctataatttctcgattaaagttcattcttctcagccttaactttattctataaaatagtttctgtgatgacagaggagacttagtccccaaactctgttagtttacagtggtagagatactcattttaggagaggagagaagtataattgggaccaaatgtaaatgttttttgtctaggagtttagccttggtcatcttaaagatgaaagtactggtttgcttctggaacctgttcttttttccattaagattcatctgtcaaacattggagcgtatttattagtattccggtggtaccagacatttagtgggagctctggactgaattgtgtccctgaaaaatttgtaagttgaattcttaattaccaaacgtgacagtatttggagatagggcctatagggggtagttaaggttaaatgagatcttaagggtggggtcctcatactgtagaataaagacaacagacagctgtctctctcctcctc

SEQ ID NO: 90246 - DNA, 1007 bp, Homo sapiens
agagtgttagcttctgttgtctgaggctccaggctgtggtgttctgttagggcagcccgagcagactgagacagtaggcaattatcacctgtgctgtttggcaccaaaactagcttgccccttggatcagtgtgttgagcatctcatcgcaaagaaataactattattgcaaactgtgagttagcaacttctttcaaagattggtcatcctgtgatgtttttattttcctttatgtaatatttccgactacctataagtttagctctggagttgaattctgtgtttcatgctatgtatgtataccatagacagacaggcacaagtcataaggcacctgggatcaagaaacaaacgagtaccagaaagcttctcttgcttccttctggtaatcaccgaggcctcacttcccccaactaccatggaaggtaactattacagttaattttttattcaacagttttgacattggttgtatttcttccacatgatggtttttgaattgaatctaatctcagaccctgatttttgcctcttaaaatatttttttctttcattctagctgcttttatattcttggcctttgaactgttaataatttaggctcgccctgtcaccccttcccccaacatgcagtttgtgcattgcattgtaaagagagactattttacagattttaggaaatcgatttcataagcccttataaataaataaaatgtttgcatcagctttattttgtgaatcttgaatttcaaacttaaaagtagagtttgtggtttaatttgcttatgttttagcttggtatgcacatagtgctctgtggggtgccatttcagctaccattattatactgaaaatatctataacggagacatgcctgcgaatattctatttttgaatgctcttctaatgaggtattagatcagaggtggcattacattttggaggggctgctgataactgcagtttgtatattataatattacattgccttttcagttggtaccca

SEQ ID NO: 90247 - DNA, 1028 bp, Homo sapiens
attatcagtgtttatactgaaaaacacatattacagtattatcagtatttttctaaatatagatattttactgattcttctaatatagtgaatattctgctttgagtagaaaaagactgtaaggcatgtggatatttttgaaaatattaaatattttgagttctaaattgagatacatttagttcttctatgcattgtttccagtgcatgtaaatgagttttatatattggttaaatggtttatcaatcagaagcagcatagcatatactcacatttatttatatataaatacatatttccctataaacattgatatgcatacgtatattcaggcacacatagatacatgtacatatacactgatacatagacatgtacatgggtatattacaagcagttggctatacgcagttgtatctgttggtcaagcagtctttctaagactattttaaatgcatgggaagaggagatatttggaacacagggcaagaacaagaccaagtggaacccacaagcatgacctggagccgatgaacatgggcagaaacccatgtctgttcttactgcttcagaccctgatggtataggtttccatagaatttggggctcttcttccaggagcataacttacacatgcctggtctagtggttggagaaactcctgatggaggtggagcagttgcagggctagcccctgctcacccaaatgaggtgactcagcagagaggcgaggtggtgtgagagctacaagtgactgctgcttgtagcagccttcttcatttctcacaagaacctgcctcatgtcccacccaactagatgtgtaaggaaagagaattctgagaaatgtagttcacagcctagatgagacgacccattacagagctaccacagagagttttagatctctctctctctctccccatgtgtgtctctgtctctgtctctctctctctcttttctgagatggagtttcactcttgttgcccaggctggagtgcaatggtgcaatctcggctcaccgcaacc

SEQ ID NO: 90248 - DNA, 1561 bp, Homo sapiens
ggaggttaatggaggattgataaatatagacatggtgttttgacttgagaaaaatacatttttttttttaaaccagaaagtccaacaggctgataaggtacccttgaattaagctcagggaaggtaggtagatttcactttttgtctgcttctacttgttgaggtgactgagtagagactgttgagagagattctgaggctgcctgtgatgtcatggggacaaaagcccacgataaatcagtggcagcatgcacactgactggccatctctgatttggttgaataggactgtctttggaaatttgatgaaaatgctgaattgtgcagatgctgtttattctagaatggctccttaaacttattagatgccttaaaacaacttattcagatagataataattgtaattaaaacgtcttgtacctctattccacatctatagctttatgaatatgtattggtagattagactttttgaatatagctcgctctattttgaatgtagtttgtttataaaaaacatttttttagtgtagcaaaactcagaatttatgttgatgaaattggattttttgtcctttattaacgattaaataagtagggatatatttaaaaattaatagcatgtgtcttgtaaatagaaaacaaatactggacatttttgacaatatgaaaattaaaagaaacaggttaaataaggtcttggtgtgagatgtgaactttcttttgcaggtgagaacaaactatgcatataaaatacgaaactatggttactatgtatagatcaaagagcggtctacattgtatcctagtactctatttgcactgaattgtctatgagccagtgtccttgtcagctactaaagatcattttctgttttcctttttcaactaaagattagggctgaagtagagccaagtatctcattctatttccttctccactgtctcttcccccttcttaagggtattcatatacatatcagtgcactgtggttagtcattgtcatggaagttttggatatggtgtgagatggtaatatgttgacaatgaattatgcaaaaatgagaattctaccgcaaaaattctttaatttcaaattgttgcagaatttttataggattcttcacctttttcattctagttcactgtcttttctgctatttactagacttttgttcaaagctttcacttttgttttggaaaaaacaggaatcgcttttattattgttctttgagaaatgttgtattcattgttcacctatctgtaataaactcttagaattaactgcaattgacaatgattgccttaaatcctggtgggtgggatgatccatgttacctggatttggtcagatgggaataatgtgtattaccccatgaatttggatgctcattcgtttgttgttcattcactcaacatgtatttatttagggcctcatttgtttcaggtgtgtggttcagctctgaacagcactgaccaagtctccacctggaactcaccttcaagtttaggggtgtcagaaaatgagcagcagcaacaaaaacaatgtgagagaat

SEQ ID NO: 90249 - DNA, 1081 bp, Homo sapiens
tattgttggaaaaaatgtaattgcaaaaattaacttgtcatacaccatagctcagcaaagtcacttcttataagtctgtggtcacagtatgttttttgcagttcagcatctggctctgtgggatactgatggcttctaggaagcaaagtaccagggtgaacaattaaatgcaaaatgacagcataaaatatgcttgtggttatatgaaagacacatttatgaattttgcagatcactgtcatttttgcattcatattttctcttgctttgttagcttaataattttagtataatttatttttcctttttagaagtgaacaatgctgttttgattttcctggtacttgttaatatcttccttgtttgtcagttttgaagactagtaactcttttactgtcttctggcatgatgctttcaactttatttttaaatcaaagaatttttaaaaattgcatagccattgtattattggtaaaattttttatgattattagtattatcatatgtgggttgaacaatattcaccacctggaaataagatttgtcagcacttagttttctcatagtatcaggtaatgttttgaagtgtttttttacaatgccaattctcagatttcttggggggtagaacagtctgacataaggagtcaaataggatgtgcccaaagttggtaaattttttttgctttttcttgcataaatctcctctgctcacggtggaactggtgggagttctagacagggcgtcgctctggatagccaggttcccaggcagccttgcactgctccattgtctctgctccctgggtagccctgcctgtctgcctggactgtctacagtgcttttccttacaaaacctacacgtgaaccagttacctttaccagtcatcttccacgtcccgctgccttactttctttttacttgtacttacagtatccccttttcctggaatacttcctaatgatttgggtaaatccactctgaacttgaaatgtggttcacactgcctgttctctgaagactttctgatctctcagcagtccacggtaacttgtgcttccatgtcgtattttgtgga

SEQ ID NO: 90250 - DNA, 1044 bp, Homo sapiens
accatcaccctgtacaattcttcgaagacccttggcaaccttgacctttggctaaaattattgttagtctataaatgtattcattttctcactattttccaaagtggctataggattatagaaagaatgatgtattatataaaaagcttttccaatgtagaaactacaaaagggaaggtttaaatgagcattttgttcagctggtcatgaagtaaaagcataaggaggatataaaagtccaatcatcccccttaagaatttttgatgttgaacaatattttaggtttgtttttctgaataacttgtacattaatatctttaaattgaaaaataactttattaaaaggtattcactgactgttcagacttacacttaaatcttaattatgagatattccatctcttattctgttattttactacctctttagaaggagagaagaatattttttatcttgatttttcttgaaactctgtaggctctcctgtgtttttggcattgatttagcaatttatgtaaaaataatggaatttacagattttgagtcagtgtaagtggaactgtataataatttgtccaaaagggaatgggctaatctacaatcataagcttcctttaatttagaaagacggtaccgttggtaagatgcatttcgggcgagtcactcatggattgtactagtcgaattccatcccatctgattctatgatctgataatcctgtgggttggctagtcatgaatttttttaggcaagtttatcatatttcactaaagtcaaactaaatggttcacctacttctaaaaagtgaacaaaaacaattctatcctcatttcttagagtgaaatttctaagcctgttgaggttaaacccacttaatgaaatgcaaacacattttcaatgactaattaggagtaatgaagtcagaaaactttaattttgacatcttggattttgagaagatgagtgtagtaagcactgctaattagttttcaagttcttttttatccctaatgtttaggcagcctttattccaaatggtca

SEQ ID NO: 90251 - DNA, 1017 bp, Homo sapiens
tgtttaaataaaatacaggttaactcattggagcttaaattttaggttttagcttgctttagacttattacctagtgggcttcattgagtcctagaatgcattgattttcactttaaaataatgcagtttcatcacttcattaattttttcccttaacatttttgcttaattagtactatttctgtactgagatttttttaacatataaaatgtagatacaactgttctatgatggctgtttttgccaaaaacatgcctgcccaggatgcctttgtcagttgttttcatggcatttgcttggtggaaaagttgtgggggttatgtagaaataaaaacgagaataaatttctgcagccgatctaaatacatatttttaaagtcaagaattatgtttcccattaaataaacgttctcatttatggtctccgttcatatagtgatgggtcctattagctgtcattatccttctattctcattaggagagaaaaatagtccaggctcctaaaagtatcttcatgagaagtatcagctcctaattagcagtgactgtaatcttttggaacacagggttaacacttcctagataagttgctattataaagtttcttcatcttttaaaagccattcctgctagtaaaactaggtcgaaatgaaaaagtagacagttttttcttttatcaaatgcagttttgtaataaaattgtacgatgagcttgcacaagctttttaaaatatcattgctgccactgaatacatctataatttatttattcaagaatgttggaggcatttttgatttatttgtttttagagaagttttgttaagcaagataatgagcagagctggtgttaatcatttactatgcaactctaaagaatgaaaattttgcatatctttagcactgttggggaaaataaattcactcagtgctaatggtctatctgtgtaatttttgaaaatactatcttactctggagaaatgtaacacaccattgtgctttgctaaaagctaaa

SEQ ID NO: 90252 - DNA, 1120 bp, Homo sapiens
gcaaatgtgattattgctagaactcccaaatcagctcggtaccagttttatagttgtctctgggaaaacttgcctggggaaacttggctgagaaccattcttttgtcccagtagcagtagctggaaggcagctgcatcacaggaagtttgagattattgatggtcaagtgatgtcaaaagagtgattgtgacatataagatggcttatggaagtccttcagtggataatatgtaaaaccaaggcagtaaaccagttgagaaaaatacatgtatggatggtgaaatcaggaatacgtttctatagtcaggtcgggagcattttgtatatatacatatatacacacatacatacacacacttatgtggacttatgttcacgctcgtgtgtgaatgtgtgtatatgtgtatctacatttgtgacgtgttataaatataaatgtatatatggaaatatatacatatacatatacataagtaaatacatgcatacaaataatttggataatcatatatttacttctaaattgttggctatagcctaaaacaactgttttatgttatttggactagactgtaatgaaaaacagctagaatctaaatgatttataagctctctgaataaaattgatgaaaggatggtgttctatgttaagtttagagccagattaaccaaaaaagaataattgtaaaaacaaaggacagtgtggtgtattatagatatagaatctatatctgattctctttcagtatatatatatttttcatgcctgatttgcacatttcaaacaatagtaaatttccttggttgtcagatatacatacctaagcttggtgacaagaagggatactccttggcatgaaaaccgcccctcagatatcagtcatagaagaaaattgctatttaagagcctgcgaacccctttgtgggtgttacttggaatctgtcatgctctatgaaaaagctgcccagttggattttacaattatttgctactataggattaaaaatgaaaacctagaatgagttaaagtttacaaaggaaaaccagtgtggttcttgcctagaattttacaccaagtgggaaagatgaaataacaattagcagaaagcttgaagtgc

SEQ ID NO: 90253 - DNA, 1541 bp, Homo sapiens
atgtaaagtcatgattggataatgaaaattatcttttttagattacatcattttaggaagagtgatagagtattttttagaaatttgtttgttcgttttgcttacttgtagaatgtagctgcagtagctcaaagtatccatttgctcacatttttctcctgtgtactccaagagcagtgatgcatcattcctgtcatccaggcctcttgtctgcttagtccctgtttctagctcataaattctgtggtctggctaaaaaacaatgtggttaccttgtgcataggaggtcttgaatgtatattcagttaatggctgaactggtataattatgggtcttaaggccaattaggatactttttttaatagtccagcaatagatagggaaacccttaggtaatgaaccagcaaaggcggtggatggatggaagatgatagattcaggggtgtgaggaggcagaacttgacggctgaataatgcaagcgttgatggaattggaggagtgaagatttgctttacatttgtagtgtggctgactagccagtggctgactagtgttctgttaaccaaaatagagaacgctggagaagaagcaagttacaggggttagggattacaatgtgggagggaaggtgacacatttggtttagttgtgttgaattttaaatgaccacaagatactcaaaatatatattttaacaaggcaatagcaccaattttctcttctctttgatactgaactcggaaggggattgatgtggttggtcaggatttatcttgtcttgtcagatctgtgtgtgtgtgtgtgtattttcatgtacacaagatgtctcgattcttgcttaatggtttggttctttagttgtaagataatatgatggtaatgtctaactttcatatttataaaataggagattctgagagttttaaaattactaaatcagataaggaccactgtaaagttgtatttgaaatatataatattccttttttaggacaggtagtgataaaatcctaatgagttgtcatgttttaagatctgtgaagttccctaattggtattcatacaggtatttttaatggaaataacttcttgcaatctaaaatgttgtgaaagaaactttactatattccttctgccattatctctagaacattttcttttcttagatatgttgtgtctgttgcttctaaaagaataggtatattgtgatttattaaaggcttcctgcttataagacatactttttaaaatatttgaacatttttgaaattgtgatgtgttttagagttaattggtacattaatttgttttttcttttaaaacttttagaaaagcttttattaaatcaattaactgcctcaaaatggatggtctcttagaataacataaatactgtatgttaaattattataatgtactacataagacattcattgttctcatgggaccttttgattagttgattccaattttggctctcaagttatttcttatataggaatttagtgtttgaacttcggcctcaaacactgatttttg

SEQ ID NO: 90254 - DNA, 1062 bp, Homo sapiens
ctgcaggtttttccgtattgtttatttaacatgctcattaataggtaagagaagtaggtgagaaaaattctttcctgaagtcttgattaaacaatataatatgaacctgcttacaaacatatttaggatgttagataatgtatttcatcttatatgttataaaaatgaagtctttaataatttcagttttatattatctaacatattttacatgttaacaacaaattatagtatgccccaggtttctgacactttaaaaataaaatatatttattttgattttgtttatgataaaactggtgcaatctatctcaattggctgttctttaagaaatgatcatctttatttttaagcataattattcttgataactgattgtgtggtatttatttttgtctgacttgtttcataggtcattaatttttagtttttctcttcatcatataagtattttcttttaaaaatattgtgtatacttaatcccagcaaatcttaaaaaaaaatctctatgcttatatcaattactagatttgtcattcattagcttggataattcacattcatttaggaaagtaatgtagtggttttatttttgaacagttttatttcagtagtagtttcatttttcttactttctatgaggctataatctttcattaggcaagaagtatggagtggtggagagacttctgtataaaggtcaccaggcatgaattctacttttgcattttcagcttctttgccccattttcttgaaaaagtcaaagtcacttatcttgtctgagccccactttcgtcctctttcagggtgatctgattatgcccaaactgcatgctcatacactcttgggtagccattgaggagacatataaaactgttgtataaactatacatctgtaactataagcaatatattatttgttgcttttttaaattacagattttacttatagaaaaacaaccctataaatcatctaaatctaaatcccatgtcagagtgaatttggttgatgttggcttcttttcatgtatatatttgttcatgtatatgtcagaatac

SEQ ID NO: 90255 - DNA, 2748 bp, Homo sapiens
gtgagccaccgcgcccggtcagcttatatatttttttaaccgaggatgattttgaggcttttaccttatttgtactttaagccaaatttaaagaattagtacttcttttaagtccagtgttggttgaataaatattttgcatttgaacacaattgagctgtgttatagtattaaaactttttccatttttctccatgataataaaaattattatttcactaaatattcagcactagagacactcagcacgttaggacattgtattaggcaaaagctttttctccctatttcctctagtttgtttccctgtgccatgtaatatttttgcttcaattcttaaaacctaagtattttaattaataattttgttttctattaaaaactgcactgtggattctaagttcccatctcttaatttgtacttggtcgtgtaaataagctgtgctttgcagctttgggtttttaacctttgctctttgctattagctttatgtttttttaattatagacaatggaggacagtagggaagttatgacttaaattcatttattatcactgtgttcttttttaaggaaatgaaaaatgttattttgtcaaaaccaagcagaaacaaatacagaatttttgtacttttttttgctcagcatttaatattatcacagtttttttatgtgataatttcattttagtgattgatgttggtaccagttgtttatagttgtaaagtgtgtattgtccatagttgttattacctaatatttaagtagaatgattgttattttcagtgtatgtaagtgcattatttgaataaagaagtcatggtcatttgttcttaaacctgagattctgtaatattatatgaaattaaacaaaataaattagacatttagacatgaaaagaaaagaagcatgtttttagaagttgttttgcttttggcttttgtcacaagtcttttctgcaaggatacagtactttacagtcttatgtggctcatttgtgcaaacatgtccagatgaattcagtgtttaatgttgagaatcttataacatgccaatttgatttgtagcctttcatatcatagaatgctaattaaaatcatatttttgcatatgtcatgtctttcatgtacatatgcaaatagatgctgttgcctttcagctattagtaattaactttatgaaggacagctgtaatacataattaacaaaaatgtttgcaagcccttttacactgaaagttacagcagtaaattttttttctgcttatccagagagccattttagttttgatgcttctgaatgtttctgatctaagttttaaataatcgcatgacgtaaataaattgatactgcactgtgttcaggggtagaatggcattcatgtactgctgattcctgtccatttcatatttatgtcaacaaaattgaattaagtaagctgatttgtgtataaaataagatagtatgtcaggtaatactttttgtttgtttttgttattgatatctaggtacttcaatataattttttgtgctatagatacagtaaacatttgtattatttttaaaaacctctcttcaagttattaccatgtttttaaggaagctccatgaaagctattctttttctcttttacggtcctttaaatatttaataaaatgacattttctcaaactcatttcatgattgaagtgtgcgatgacctaggggctgtgcatgttatactgaggtattgcttcatctttcttaccaactggaagtgaagacagggattgaagaactacaatcattgtgctcttttgctcactgttagtgtatccaagtcaaaactgaaccagtcaatttagatgtagacttcttttgaagtcctacagtatatttaatctgtatgcaagctttggtgtagcaagagtgccactgtaatacgctttttatgttatgtttgcatatatatattattcttaagttctctttgtacagatttctagtggagagtcaagttttagttttataattacttttgtttattttttagggttgcttttgtaatgaagaagcacttaaatactcatctactaggcaagcatggagttggcaccccaaaagaaaggtaattttcattctttttttttcatttaaaaatacaatttgatttttattttaggctttatttaatgacatgacttctagacttttttttcacatcagttaatcatgtttctatttgtggtactcttttgtcaaatatcatattttatgccatcgtttcacaaaaatttaacatattttaattaaaacttgagtctagaagtagttgaaagcatttggaggactttgaatttgtgaaacaaccttgaaatactagaagaattaaattggagggaattaccttctgaaaatgcattcgagtgtgataaaacaaatatgtaaaactcaactttgttttattatatattcttattttgaggttttaaaataacagttttgaattcttactctagacttaaagattgctgatattaagaagaaatacatcttgtgtcatcccccaaataatactacagttgccatgtcatgaaaaataacactacaattattatgtcatcaactgccaggttttcttttttcttgcttctgtatcataattagcttcatcgcatagacttaattatattaggtgaactgaaatatagcagtgtcagctaccaggtgaacatggctacttctgatattttaaatctttaaaatg

SEQ ID NO: 90256 - DNA, 1063 bp, Homo sapiens
gtaattctttgggtaatgtagatgatctgtggttgcttcgtcagcaatgtgttattactaacaataatattttctaacttctgcttcataagttttgcagatgaaagttaacaaaagtcagcatctgtgctgcagaatctcaggattgcaggcagatacttatggctcctctgcggggtggagagccttctcttcaagcttctctcttggttgggttcctcagctcttaggaagcaatgtcaccggtactcctgcatcagttacatcatcaaatgcgacatcaaatatctggattccatgtatttgtcagataatttactttgatgtcacgattccttctttcttctattcatttcttaatgtcctttcagttttagctttcagttatttccattgctagagaactgcttttcttcattgacttgtttcgttttcttcctttcgtaaattgactccgctcatttagcacacagctatgacaatgacttaaatttaagactgttttaagaagtaacctcataaaagttacatgtttattgtgaaggtagtatttaggatgctgttcatggaaatacatctttcttttaagactcagaagaattatttctctctggtctttattccagagaaagttgtacttgtctctaacacttcgttagcctttgatactagcaaatcatgtatatgattgagttttcctctttatgtttactgttgggaagctcatggccaaaattgtgatccatctctagtcagcaggatagccttaaaggcatgcattttatttactactgttatttccagttttatttattttttccttatggggaagtcccattttatgtccgcaatatattttaaaaacctcccataaatcaaagctcatgtaattcaagggcagttttgcaatagaaattgtttttgagtaaaaccaatatttttctggaagtgcatatatctttagccatttggttttgggggcgttgtattgagcattgtgcatccctgtgattaggcatattttaattgtgcttgctctgttgtaggaaactgctgtgcactt

SEQ ID NO: 90257 - DNA, 1040 bp, Homo sapiens
gaaatattttgaaattatgaattttgttgttacaatattgaggtactcttacttaaacaaaagtaatgttccttctacattaattgatagttttaccatggtttcccttgtatgttgataatttttgacatcacacttgtatgtgggaaaaatagacaagcatgtaaattatgaactaaaccaccagttcagttctgggcattctcaccaaatgttttgccatgtactgaattgtgtatgagaggaagagttgagcagagacctttaaactctttctttgaaagctgaaagtgacttggatttaagtttctgttgtaaattccccacatttcgtaaatgacgggtacatgctttgaccctggtatcatccagtaccagtgtaataaaagtcacatgcaaaagcaatggagtgttatagagccattatatagtgagagtcctccacatgtggcatttcataccagcctcccgctgtgcacacgcgcacacacgcacacgtgcccttgcagcacatgaacgagtctctggaaagtaattttggaacatgagcattgagagcatgcaaatcggctgctcttttctccctcaggtggcagacttagtctgtgtgcagatggtatttagtatattttttaatgtgttattttcattctagaaaaaaatcttaattttatcatggtgacttgaagttattttattcgttctagagaaagtgtttctgcagtactgaatataatagaactgtcatccaaatattgatacatttttttccaggctgaagaagtctagatatatttttgtgttttatatcttcagtatattaatggctttaaacaaaataaatagctctttgtgcatgactgatagagcgttaggttttgttactcaatgaaataggcttgtggattagccccaggtcatgatcagtgcaaaaagcaggcaaatgcacttgttttaatatctatttgattgagatcccaagctgcatttttctatatagcagagatgtgtcacacgaggttgtaagtatgttcagtata

SEQ ID NO: 90258 - DNA, 1049 bp, Homo sapiens
tcatattatttttattttcagattttttccaataaacaaaagtttagtcacattgttccctcttccacattttttccagttgttgagatcttcagtcttttttgcttgctttcttgtagatttgcttaacggaaatgaacgtttaacctcttgcctcttaaaattcatattctccttgccatctatggccttcctaattatttaaattatttttagaaaaatgaacagttcaaaaagaattatacgaagataattgtttttctcgtgatgggagaagcctaaagccaatcttagtcatttctcattggaagcatatataaactcagtttgttttatatactgaaagtttttgattagtttgcttcctaggtagaatggaagcccagtgtctcaggaaatgtttctgaaattaatacgatttttacattgaatgtctctgataacttgacttcatttgtcagtgatttgccctatcactgataacttttatgtcatttgtcaggttattgtttcaggatggaaataattatgaccattatttgtaactcaaacatagcttgttaacagacagattcattataccgtttttttttaaactctataaaatgtttcaaagagtctcttccataaatttaaagcaatcctagacatttaggcactttgttaggttttctttccccgttagaaaataagcagtccatactcttagtgatattctataatttctttttggaatacttggaaatagtaatataatgatcattagtgcttatgaatttttgtcttgatcatcaattatcaactaatttttaaattgtttttctcttgagtatgattaatgattgtgtacctgaaaaatgtaaaacattcagtttgtcacattcctttgtcaaggtatatgagattaattttataaatcagtatatatgagattaatttcataaggcttcatttatatttttctttcattatcagtgtgttttcatggaaatctagacttactgtttatattttatatatacttcgagtatcacaaacgtgggccatga

SEQ ID NO: 90259 - DNA, 1128 bp, Homo sapiens
gactgtccaatcaaagtttttgtaagcatgccatgtgacaaatgcctggcatattcagtaaggaacatattaattattctaattaacacatgacttcagagaagtctttcgttaatcagcacatggatcttggttatttgtacccttttgggaaaatttcacactcagatgcaaaaataccaggctaaatacattgctttgtttgtatgtggagaggatattcatcacaatggtactatacatctaagaaaacagaaagtaattaaaatgctgattactatagccagtctctaaaacgtctgattatttgtatttcatatgtgctcacatttctgagaagttagcttttgtaccacaacctaccatgattatctgatattctccggaaggttagccgagttgtttcctatattacttaggaaaaaatttcttttcacaattgaaaatgtcagcatcaatttaaagtaacactaagcatgtgcttgctttctgaatattatcctcctccacctccttccaaccaccctgccgaggatctggctgtgacagtttgattagatcatcaatcctcactgttaacagcacttttcctgaacacctgggctgccaggtcacatctgaattcagctaccgttgtttcagtgacccgacgtgcattcaccatagcaattgacattatgtgcacaaattaaaagttaccttataacaacagtttactttaaaaaatgacctcttttttccccccatgttgaagttctgctgtgttataggaggtgcatttttgtatgatgaaagactattttagaacatagtcacacaccttgatgaaggtgtttcctttttctttttacttgggctttcatttcagaacttctataatgaaaataatcgtctttcatcttactcttctgctatttaaaaatctttgattgcatttttaagatttgattacattttggatttaagcctaagtaaataattgaatttctcatatattgcggaaaatctttctgctttctgctcctaaattctccagttgaactgtcacaatagtctgatttacacttttctatttatagttgtagtgataaagataaatacctacttacattttcaatgcaaattgtc

SEQ ID NO: 90260 - DNA, 1012 bp, Homo sapiens
tatcatattatatttctggttactttggctgatgttgactttgaggtgaaaaattagatatttcaccttctgattcaacccctctggttcattttctgaaagagctgagtggaattttctttccaaaattaagatttcattaattaacaagagcttttatttgtggaaataaaaatcagaaagaccttttgggtcagttagcgtcctctgtcagattttcacttgccctgtctactctttatttgtagtccattttgtcataagaattgggtacttcccttaggaaaaattctgtttctataaatgcatttaaaaacctttctgaatgtttatggctcttaatcttgacccatttcttactttgttatgccacaatattattggcattttgtttggtggctttgatttatttaaacctagaatttggcgttttatttgtgtgttttaatagaatagtgatacaattggatatgacatttgtcatttaaattgatatccataaaattcaatacacaaagtattattctaataagtacctaatctgtataaattgctgaaagtattcacttttaacttgcaaatatattaatgattttgagttttgatcaatatttgcgtcaataaagacatgaacttattaaattggtggtataatttatgtactagataataaataaggaattattttctatagacctttattccattgcatttcttttccttttgtctgttaaaattgctaaggatctcattgattccctcatatgtttgtgcacaaaaaatttatctttgaataaaatcttgttgttattttatgttaattataattagggttgattttttattgatctgaaagtttaatatgttcagaaatttcagcaaatatcttgaatgcagactctaagagtttccatcttagctgatacaatgccagtttagttggtagtgaggctcacagctcaagtagggatatcatgctggttttataggagaaacatgttacaggtaaaac

SEQ ID NO: 90261 - DNA, 1075 bp, Homo sapiens
cactctagcggcccttcatagctattgtattctggatttcaattcggcactttatgtattagctaaaaatttcatgaccagatcttttgaagtatacaaagtaaatcttcaaggtgatagtttatccaagtgtaaatgtgttgcactaggtcagcttggaattttgagatgacttttggcatcattgcatacatctggtttgtgtactgtgctgtgcacgtttggtgagtccgcctgtgcccatgtctcccttgtgtgttagtagcaggagtcataactggagaagcagtgccagcagcaaacgcaggcattctctctcgagcatagcgccatcccggaacctgtgactgcttgtccatgggtcaagttgtctcatatttgatttattaaaatgagttgttcttctattctggacatgtggataattaggtttgtgtgctacattttttttgactttgtaatttctgtattcttcagacattgtagtatttgtttcttacattgtacctacatatattacacatgcaatatgtgtttattaacctgagtttgattttttgcacatgcacataaaatggctacttgaagatttttattttagcttatccagtgaaatttgttcactgtccttcttttgactaaaataagcgaagctccttttacacacagatgtattttaattcagcagctgcattcttacacttttttaaaaacacactttggctaaatcaaaaatcaaatgcaaaatatagcacagagaaatatcacacatatttgtggccctctctggaggactgaggaatagattacattcactcatatgtggcctgtttccaatcctgataagtcattattcaatacatttcaataatacaactttaaaacatatttttcattgtatttaactggttttaaggccattgaacagtaaaaaaaaaaaaaaagctaaacatgaataaagactaaagcattttaccatgactcttgataaatcataaagaaaacaatttttctctctgtctccctcctgcccttctgcgctgagacatgtcacagctggaaacatggcttgttt

SEQ ID NO: 90262 - DNA, 2044 bp, Homo sapiens
aaaagaggtatagtcagtcttctaggttatccctagactcaagtatccagcttgctttgtaaaaatgtcagcgtcattaggaactatgaatccttcatgttatctcctacgtttgtaccttattactaacgttgcagtcctaaaattgtgaactttctttttcgtgaaaatttacattttggattacagtttaatattatgttcctgaggtgagattcatagtccttattcttaagattagattaagatagcttagtcttacatgatttagatttctttggtctttgtgttattttggtcagacatttatgcattaatattttttggaaaggttgcctaagatttttttattctgttggatactaggctgtaggctctttcagatcctagcttaccttattcatggctaaattgcccgcaccacttagcaaatgtggtagaaacgacaggtgcctaataaaaggatctttgatttaactcagtagccaatttcactttctttgtgttggcccataaatttacagcctctttgaaactccattataacattgttaagtgcacttctcatatttgaagtaaattattttataatttgcttatataaaacaaagtatttcaaaaatttttaaattcctactactgtgtttaaatctttttaataatgatttatgacacttaatggagtaacaatattgttcatattgatgctttcagctgcgtttccttctatcctcgtattgttccttgttaggtcattagtttgtttttgaaaaacagtgacgcctttttgaccctggaagtttttccctagtgatgtgtgtgtgtgtgtgtgtgtgtgagattccttttcattttctttgacctgttgagtgtgtcatttagacaaatgtttgcttattttatatactatattgttcccttttcggctatgctatttatttatttattattttttgagacagaatatcgctctgttgcccaggatggagtgcagtgttggaatctcggctcattgcaacttctgcctcctgggttcaagtgattctcatgcctcagtctcccaagtagctggggcatgaaccaacacgcccagctaatttttgtatttttagtagagacagggtttctgcatgttggccaggcttctctcgaactcctgacctcagatgacctgcccgtcttggcctccaaagtgctggaattacaggcatgagccaccgtgcctggcccttctgtgttatttaatactaacttttcatgggctctatagatataagtatgtttctcacatctatccacttaaggagttgagcttcctgcatgagacatagtaatgcttaaccaaaaatactttgacgaatgagtatattgggcatatgtgttttatatttctattttttgtagtattttctcttaattactactttttgagtgcttcctgcttcatcttctttggaaactaaccctgttaaaataaaccaaatatttatataaataaaacatatgtaagttctaaactttctatatttctagatcgtttatatttattcagtcatattaagattacagagttaaaaatgaaaaattgcatagtttttaccttaacacaaatttgattccagtggagacatatatatatcttctcttagaataaaatgaacaaaagtgtaccttatccacacttcatctttactttttcatttgtttaaaaatgatgattaaaagtgtattacagaagataacagcacaatgaaagaattctcttacctatatgcttcctatgcatgggactagcaaatctgatcttatttaatactatgatttattctcagtgtctgtaaacttatactcatactggagggaatgagattatgcttggagaatcccaaaatcttgctttaattttttttcctttttctgctatcttggtttatgctagaactatgcaagaaatatgtattgaatttatcaagagtacacagatcttaccttacagcataacagcagccccttgaagggataagccatgttccacttgtgttta

SEQ ID NO: 90263 - DNA, 1036 bp, Homo sapiens
tgtggtgactttgggctacttttgtttcttttttttttttttattttttattttttgttgctgttgttgttgagacggggtttttctcttgtcactcaggctggagtgcagtggcgcaatctcggctcactgcaacctccgcctcccggtttcaagcaattctcctgcctcagcctcccaagtagctgggattacaggcgcctgccacaacacccagataattttttgtatttttagtagatacggggtttcgctatattgggcaagctggtctcgaactcctgacctcgtgatccgcccgcctgtgcctcccagagtgctgggattacagtcgtgagctactgcaccccgccgtttctttgcttttctaagcacagctttttcatctcttaaaaggtagttgtaatgtttaccttatagaggcattttgaggtgtaaatgagaccacatctgtacagttccacagagtatcttctttagatgagaaagtgtgtggtcaggggtgggggacggggagttgtcagactctgtgccttgagaccctgggttcacagccatgagcaaagcaaaacagtagcggtgccctgtccgctgcacctccgtgctcttcagtctttagtgcattcctgcctacacctgtgcacctgcttagacagtcatccttccagcgatgtcctgagaaagagacgaaggagattccctgagacttaccaccatgggtagcatgcttctggaggaaatgagtgccagcttcaagaaaagataataagattgaaatctcctgtttatgtactgtggaatattgaaaagttggctgtgtagagtttgatttccatttagtgcatgtaagataagctaacaaaacattttgtttttactggtctttgaaccttttattaatgaataagtataacttattttcataaggaggctaatcctttcagaagaaagccttttgactatgaggccatatgttaaaattagagggaaaaatagccccattcatgaaattatacctgaagctgtggaataggtg

SEQ ID NO: 90264 - DNA, 1435 bp, Homo sapiens
taatgttcagacctgtgtttcataaaatcattaatttaactcgagatggatttttgtaggaaagtagaaagataattaaggaggaagcaaatcttttcatgagaaagtataggataggtttcacagcgttgtcctgagaaggagaattgcttgatattggaatagattgccatttgaatctaaaaaatacatttatctgtgaaaagataaattacttactttgagatgttatttatgtgtttgcttgtctcttttccttatcagattttatgtacctggaggataggccctgtgtcctatttatctttgtatttccagaacacaggataggacctggccccatggtagatgtttaaaagatgtttgtttaattgataaattaatagtagagatacttgaacttttttccttccagtagctcacaaatagtgtcatacctaagaaaacgagaaacaaatggtgtcctctcaacacagttaagatattcaatactcccttcatggctactgcctagctttgtcttattaaaagagaatatggccaggtacagtggctaacgcctgtaatctcaacattttgggagatcgaggctggaggattgcttgagcccaggagtttgagaccagcctgggcaacattacaagaccctgtctcttttaaaagataaaataatccatcaggtgtggtggtgcgtgcctgtgaacctagcttcccagaaggaggatcccttgagcctgggagttcaaggatgcagtgagctatgattacaccatcgcactctagccttggcagcaaagcaagaccccatctcttaaaaaaaacgaagaagaagaagaagaagaagaaaattcataggtctccatcacccagaccactttgaatgcttttatttgtatgaaaatcacatgcctatatttgttgagaagtatgtaattgttaaataactaaagtttgacccagaataatttgtaacttagatactaaattgcagaacctctatattattattattattattattattattatgtcttagacaagcaaaaaatgaaatcgtctattttcagcaagttcataatatttatacagatacaatttactcattatctttctactaacatttttgttgctgccaaagtaagttttaaaccatgtttttagattcatcaaaccgtaccagtgtgttaattctgtaatttttgttttgggtatcatagtggggataagaagtaggttaattaataccagatgactttttcagcattctttcatctcagtgttacggttttttaggactgtgataagtcattggcatttcattcatttaatggactattgcaaaaatattcattataagacatggcagctgtaaaaatagtaacacttatgtattaccattatgttttgtgtgattgtgtttcatattttataaata

SEQ ID NO: 90265 - DNA, 1041 bp, Homo sapiens
atgtttgtactgctatatatatttagttatttcattgacttttatattcgtgttatattcaataccctttcatgtttttcatttaaaaaatatttttatttcattatttccttactgtaaatggtaatgattttgtgaatatggatatttaactatgaatctgtaaattaaatcctactcttgaggataaattgaagtttttaattctgaatttatgactttcaagtcacatagagttacagattaattcagtgttttcataggtgcttagtgagaatagaatatctttccatgatttaaagattaatatttcattagatattaattgtgaatagtattttctttgatacccactggataagacttagaactttaggaattttctttaaaagttctctaaaattgtttaaatttgttattaaaatcttcattttggttttatccaatacataattcctttgttaactacaaataatggatggaaacattgttggttattttaagcagtgaggaaacctaggtcctagagcagagtattttatgaccggtaactttacagaacacacgccagagctctcactcaggaaagctggctgcacgttggatcgagtgtggcacacacagttccctgggtctacagatgctgtaagtagccagatatgtctgggagcagccaaatgtttttctgagaattttaacaacagtgataggagagaaataaaaaaaaattaaatcatacatttatgaaaccctgatgttaaccttatagaataaatgtataattgcagttctgctgtttttactataaagctgtagctatctttttgttttgtttgccgaagtaccaagatataaaatgcatttatgtagtactgtatcgaagttatttattactttaatacatgatagtgggtccacataatttgtcaaattttaattggttttgtcacttgtcagagtcaaatctcccaaattgtcaaataaatttattttagaatcatacatcctaaaatttgataattctgaagtttttcttcttca

SEQ ID NO: 90266 - DNA, 1086 bp, Homo sapiens
cttccagtcagttttgattatgcacttaataatattataaagaaacttagtttaatattttgaatgctggaaggtacataataaatgataatgttattccacatggccttttgttgcaggtattgaaaaattagtataaatgatctatatccagtatttattgatgtctatctgaatttatcttttcaaaataacttagaatatatgagaagtagattaaatctgcaaatctgttttgtaaaaaattcataattgcacacatccaattttaaaaataaatttcttttgtagtgaaagtacgctaaattaatatgtaattgcttgctctatgaggtttttcccaatgatacctcacatatgtgtgtattctctagttttatttgtgtttcattgccagttacctcaaagacattgcttagtggaggcatgtgtcagaaacagtgaaaaacttgatagtattttattaactacttattctcagttgcatcacagtttaactttaaaaccataaaacttgtttttatgttaattcaatctttgtattttcccttgaacttacgatttaccaaggaacaaataactccctacaacatgatctttcaatatgtctgcatgtcagaatattatgatttagagcaggctgtgatctatgtcgggttctactgtgtctatgttgaattggtctactgcactaaaatcgcatcttggtgatgctccagtgcacaaatgccccaagatatttactctagaagtgtagtgtaactgcggctctttggactaaggtctctgaaagggtcaattttgtactgaactctgggattactgggtaatacatctcaacctttctagctaatcttaccttgagctcaaatggttccttagatcatcctgacatgctagaaggccgagatgatgacaaagtccaagacaatgaaatgcctaagtgtggaaagctgcccttcctaactgcagcaaatcacacacagtcaccatcagagaggacagtccattctaaatctagcatatgtactcaaatttcttgaaattatgtatccataatagatacataaagacctataggataag

SEQ ID NO: 90267 - DNA, 1475 bp, Homo sapiens
caatacagactgtccagggggctgacacaaaacatcttccattctaagatttacttttatcacctgtcagggacccttgattcaagggcacaggagaagatcctcacgtgtggttgaacagtgttggccagcttaataaccaccagcccgcccaaaagaatgtgggtgtgtgtttccatgagacgcggtcagcccgtctgacggacagttgacacacaaagagcaccgcactatgacgacagcccttctgctgttcatcctctggctttccttatcaatggggcctgagatgcagtatgtttcttaatggtgatttgagccaagattactgcttgtaacggaaagtgtgaaaagcaaaacaatttaaactaataggtactgttatgtaggagggaaacaggaggaaaggaaatttcatccttgttctgcttgtttgaaaagcacatgtacaggtagccctgttgacttacagataacattgtttgagagtagccaatatcttacttagatttatgcatccgtttgcctttaaaatgacaaaggatttcaaagcagcacttttgccaatatgcaccaaacctgtttgatcagtctgccatcagtttttccttaacaggtatatatcttttcatataatgtatgtcatcttcaaaccattagcaaatatttagcaaacttaaattcttatttcaaatttgtgatattttctttccaactttacagtctagaagtcaggtctatatttttgtctgcatattgagactaacaaacacaaaactccttctatatttctgtagtatattttcctgaagaaattacccataaaagagaagaagaattaccaaattatgtattagagtaatagtattgaacatgtaactgattgatgagttacaaattgactattatatacagatttgaatcatctgtggttgtataaattgacatggacttaagctatcaagagctcagatgtctgagccttgcttagcataggattttatgtaccatgatatttttgtggcattatatttttccctgtcatcctgtatgtaattcaaacttgcttaatattacacaatgtaatctattgtgtggtcaaagaaaatatgaaagaaccatttataatttattacaatataatactaggttaatatgaactatagagaatatatatgacattattccttagaaggactgtttttaaatttaaattttgtcacataaagattttcatgtaagtttaaataaaataagctacattaaacagagttttttaagaggttatgttaaactacgaaaccaagaaaatgcagctcagagatcttagatgacctttaatttataccattgacttaggcagtggagttcatgatgtcatccttttaccccacttcaaatatcagcagaatctatgaaaaatgaatagtttgaagacacctaccaacactattgcgataaagaaaatagcagtg

SEQ ID NO: 90268 - DNA, 1056 bp, Homo sapiens
atttctagaagcacgatttaaggcttttgatagtatgactggaaaggttgtgattttttttcctctgatcagtactgtgctttggtagattcatttatgcatacaagtatttcacagtatttcaggttttcttggtttgaaaatgtattatacgttttactaaggttgagatcatattactcgtccgttattcaagttatctccctgaaatagcctcacttctgtttaggaccgcatttgagccagctggatcccatccatgttatacctctgtcaggtactacatttaagaggatggtgttttctaactatattgttactgttctataaataaaagacttatgacattgaaatccagtgatagctaccagatttccctttgaaatgcttaatgtgcattataaaggagtaatttttaatctttatttaaaacttcggaataatttgattattaatgaaagtaaatggtttgaacactttctgttcctgggacagcttcaccattctgtgtacctatgaataggctttcttttactactgaacaaaaggcaagttcaccttgaccgggagtataaaaaatttgcaaaagtttgaatacttctgaagtgagagacttcgaatgaaatatggttcgaacagatatctttactttcttgttgatgtgatgaaaaaaagatttaaaaatgagcagatagttaagtttctaaggattgtttttgttgcgtacgatagtaggaacaggatcccatatctgcctcacataaatgtatttgttcacagcataaatgaatttgaatatgtattattttcatagatttaataagtctttaagatgatcacatatttcctaagaagaaaattgtttattttcatatttatctcactggtttattttcataatattttactgttcaaaatatttaacttctagttttatgtttttatttgtataatatcaatagataaaaattattcctgtggagtattcctatatttgccattattaacacttaatctgcaggcagcttaccatcattagaaactgaaatattattt

SEQ ID NO: 90269 - DNA, 1103 bp, Homo sapiens
tttttctatcatttttgtaatttggtttccttatgttaaaattttttaatccaaatggtatttatttttgtatggtgtaggacaataagtcacttattttttcctataaaataagcagttgaatggacaccatttattatatagcccatcatttcctaattgatgaaatgacatctgtgtttcttatatacatggatctttgtgctgtctgttctgttctagtggtgcatgtggtccagcactccaaatgacatgcatctatttgctaaacatcgttgataacatgttcccttttaggcagaggaatttgaggttctttattcttgtagcttttaaccgattttaaatttaaacagcacaaatgttcagtaatctaaaattatcagactctttccttatgggtcctttagtgagaacataagttataaaggagtatatatcttaagctgtcttacataaattgtgaaacaagctccgagtttatatattggagcacattcttccaacctacagtgagctttaaagcaacatatatggaggcttatattcccctctactttgaacattttttgtcttttttttaggatttatttttgcccagaaaatttataaatcataattaatcctggtaaataaatgtaattaacttcttgagtttaatttacataaagattttcttcggattattctatatgcattttggaatcatattacaaagatacagtagaaaccccctttcaaccaaagttttatataaacgtataatattgtatagagtaattctttttgtggatgtgagtttttaaagtatactataaacaggccaaaaaaaaaagaaattgcatacctgcctaattaactttgcacacatgatacacacctcacatgtgctcatacatatactgtaactgtttgggaatctatttttagtcagatgaattgctgttgcttttcatgtataataggaaaagcgccgataatgactcacatagttgaactcatttgtgtttaatataaaaactagtggtaggaagaaaaaaagaacaagtacctaccgtattacctgaacatacttaatgttatttaccttaatcctcatgatg

SEQ ID NO: 90270 - DNA, 1078 bp, Homo sapiens
ctgtttagttactgagagatactggcttatttttgtcctagatacagccttcttgaaaacaaaataatctgttttccaagttatctctttcttcccttccctgaatgttaggattcattgcttatattattctccatttaaatatgcatcatacattgaaatgtatttattttggcaattttaatttcttcatatgattggtgattgtctttgatgatgtttcatgcctagcattttacataaggaaataatattggtggtaccaaagaatctccattcctgataaacagtactaattaagtacagtagtagctttttgttttctctccccagtgtcagtaaacaatggtgaatttaggaggtgtctgtaatgctgtagaaaacatgttggagatctgcagaattaagggggtaatttggaacggtttacccagcttgaagaattcaaaaaaaaattgttccttttccttttaactgtcataaaagtggacatttgtgtcagtcaccttcagatgttttcctgtgttatttcagacatgacccagagctgttactctaaggataattacacatttaagagactctacagtcctatcctttgcttagaatgtgctagtgtctctgatacgtaaattttaaagggaaagctggctgtggtgtacttgaaaacataccaacattctggccttgaaaacagaaaacctaggttaggattctgccttaaccactcaccagccatacagcctgtgtagccagctcatcattgtgatatttaccttcttctctgtgaattgtgtagcagtcttgacctcagagggtcatgcttgccttcgaagtcgccaagtcagtggaggtacctggcatacattaggtgcttactcttttatttcctcttacagtgattgttagttcacaatagggaatttatatataaagcaagtttgacaattcggtagtgactcatgagagaaagaagcttgtgtgcatacattcactgtcttgcatgtatttagtctaagatctcagggaaatgtaacacccagattgacagagcctttgcccaaagcaagttgaaaat

SEQ ID NO: 90271 - DNA, 1058 bp, Homo sapiens
gagccgcgccagcgcttccttcccggctcccttccctgctgcgccaaggtcacccagccacgtggcattctcttacctcatggcaggcagcactgcgatcttatcagagctcacatttgcagccttcgtgaactggattttgaaagttaaaacagttaaaaaaaaaaagtaaacaaaattgaaaatcgtgatcttatcccctctgacagcttcatttatcaaaattttaagggaaaaaattgattgtgaaaagttatagtggggacggtatgattttatcaggtaattgatgtggtttttacttttatatagactttttatcaactaattcaatataacttacatattttaaaaatttgcacaccctcacacacatattttgacccccacctaaacagcagttttagatgaggaaacaaagatcatgttgcccactcgtgttgctactactgcagaacaagttactgttccagctgaagccgtttactaaagaatagcatgacaagtctttcaaattatcagggaaatttagatacattgtttcattagctttgaaatgtagttcagaatatgaagtaatgcacattattactctttgcaatttcatttatttctatttgcagtgaggaaaattactatttcgcaagtttttatcttaaatgattttaaacttacagaaaagtttgcagaaatagtacagagagttccatatatccttcacccaactttcccaaatgttaacatcaaacataaccatactacttacgaaagcctgagaatttagcattaatacgttgccattttctatgctgtattctcgtattcagagtttatcatttttccactcacatcctccttcattcccagaattcagcccaggaaccaacattccttttagttgccatgtcttcttggtcttctccagtccaggacagattttcagtaccttggcactcttaaggaacatggatttgttattttgtagaatgtctcttaatttggaatagtgtgatgtttactcatgatttaattgaagtcatttaagaaaataccagaag

SEQ ID NO: 90272 - DNA, 1132 bp, Homo sapiens
cagatagttctcttgcaattttaatatactatttggtagtattagaagttgacttcatctaaagctttattattttaaaacacaccaaactcataactcttctcatttatcaggtatctcagtcccatagtttgacattctttatgttggtaactaagtatttattgagtctattgacattttcttagagcatctggtcaacactgaaatgtggtacttcttggtgttttacaaataaaccaccgacaggattaggcttttttagattaaccttgttgttcagacaaagcaagcttcttgctgaaatcggggaccagatagaatccccctcatgcacatttaattgtaatcaattctttcagcttggaagtgctcttgccatttaaaggagtgttggaaatagtgtgtgctacggggtggcaatgtggccgcagctcatgtaacttgtaaacacggatgattaatctgaattgcatgaaggcaagggggagggtacttggttttgtaaaacttgaataatcagagaggtgagaagaggagatcgatggaagcaccgagcaggcagaagagactgtaggcaataatgtgtaccagggaggagctcagaagttgaattgtgcggcacatacagtaaaagctgaaaaaggaagataatccaacagctggctctttagaagaggctgaataatactttaggtttctgtttgttgtcttttaatggtttcctaatgtattatctccatccatatttctggccttttctccctgtatgtaattttttaaaaaagttttttctttttgtgatgtgtgcttttagatcatgatccagaactcaatcaaagaagtaattttggttttagatataattctgtgatggcacttaatatattttcttttacttttcactccaatttctctatctgcttctaaggaagtatgttacgaagacattttaaagatatttgatgctcagtttgaacatattaaatttttaaatatcttttttacattgaaaaggacaattgaaatccagagctatctatttttattatttatggcaggatcagtttgggtgtgtttatcttctaggcattaagatgtcaagatattcgcctgttacattaatatgcat

SEQ ID NO: 90273 - DNA, 1081 bp, Homo sapiens
cacaatacccatggctcacatgtgatattattattatctgcataatgctcatattcaggacttctgcagttgtgtttcatgaatagattgtcattttaattcatgacctcttttttaccaatcccagcgcattatgcttatgagcgggccccataaaattcagaattcttacattgctcctttggcttcttttagaacatttgaccttatttatgaccttcttttgtccatatagtcatcataattgtcttgatatgtctttccacatattagggtgatcttatccccagcatcatgctctgagcacgaattggttacctctgtatttagggccgttatagtaaccaaattttcgtcatatactggtgaaaaatctacaatgtagactttctgtatctgctgcctttgggtgaatttccaggtagtatttattagagtgatctttccacctatttcttgactctgactgtgatattaaccttttgtaattaagacgctctgtctctttgacacatagtgtacccttttagatcgtcttaattttttttttacctccaaccattttttaaaattttatccatttactcgtgtaccacttcgttggtacctttcaaatgttaaatgctgtcccatttatccttagtaaccatgctgaatttttctgtcctttttaatatttaggttttattggatgaatgtagattgcaccttctctaagtgtgtcttaaataattgccacttaagggaattaagaactacaagggaaggaaaatgctgacccatagactaaagcagagggagaaaacgttcccactgggtccaattttctaagaaggaccatcaggatagtggctagggcctgaaattatggtctgaatgacctctagaaaatgatctgttcacaaaggaacttgcctgtgtttgcaggaagcaaatagggataggtagcagtcaccccactgaagacagacagctcactctcttgtccttggttaggttataaaagctcaagaagagaaaacagtcattaagagcatagagatagagttgacattgcagggtaagacataatctaaggtgt

SEQ ID NO: 90274 - DNA, 1319 bp, Homo sapiens
tttctacaaattatgctagatattacctgtatctcatccaaaagaatgtggattgctaccagaaataaactagggtgttaggaagtaatatttccccccttcttagttagcatgtcacctgaagttcaaaagtggattatatataatccatctaattatacgaggcgcctgtagaaatgtgtttagtgtttagttcttttgattaaagtgctgcttgatatttacatcccaccaaaggcacctactcaaaatgtaagtaagcttactagcttttatgttcttacaggaaataaaatctgttactaatttttttaatttaaaaagtctgttaatttacaccgatttataatttgtcttggattccttagctgagaagtatagttcatcactgactgttctattacctgacagcaattgataaagtatccatgcacaaagtgtcagaaaaggttaatatttattgatttttatggtgctacaaccagtgtagttttgccatcaaagatgtatggccaccagcaatggaatctgtagaattgcaggatgcacactagattttattctaacctatgccagtattctagatttttttaaatgacagatgtttaactaaatacaaaaagccctaaatgtgcagtgactctgaacctgtgacttgaattcagtattttaatatgaaacataagaacagcacttaaaatctaaaaattcatccttgctttgcagacagcaatcacatttagctttttcttccacttaactctatgctgttgatccgaatagatgcccaagcaagtgatagctgagattatgaacaataaagagcttgcatctttataaacaaactatataattagcagagaaggggggaagcctctgtttacttttaaaggagttccaaagaagcagtttgagtgccacgtcactattcaagtatctgcaaacaaaaaacctcagggcccagaatcatgcattcattctctggttgcagactggggatagaagtgaggagtgtgcatttttttgttgttgttgatttccacctgtatttccctgacagaaatgtactccttggtttacccataacagccagcgacgactcgtatgcatttgcttgcctgaatatacccacagtttgtattagttgcctatttccagtagttaacaggtgagataagacagtttatgaattacttttttaacccgggtagaagtgtatcaaaacctgttgccttatctttaagaccctggacttgtaagtgtgaatcaaaactaaaactctccacctgcatttgagatttttaaaagcgggagttgga

SEQ ID NO: 90275 - DNA, 1053 bp, Homo sapiens
accaagttaatttatcatttttacatgtgattctgaaatatttttatctgtattgaaaattatatttcttaaaaaaataattctctctcatcacatccatatgacatcaatcctaaggaaagatcaagtttaccttttaggagaaagaggacagatatttaagaaaatatgctgggagtttaaaataagcttgtgtaagaatgctatgtaaaaatacagataactaattagaaattagagaaaacaacagttagaatgtctggccttaaaataagatttcaaattagagttaatgtattccaaaaataaaagtcagaaataaagaagaaatactagaacttttaaggtgttttatataaaggtttcatttcagtatgcaaattagacagcacactagtgtgtaaaaagaaaggacaatctaaagcttgggaagcaaactgtggaaaaatcaaggaagtctacagccagccatggtgtccacttacaaaaacaaacagagaagaacgcgaagaaaactagaaatggaattgtgtggctaatagggcaagaaaatttgagatagtacagaagaaactatttatgatattttcagtaggtacatttctttctgacaaacacacatttgaaataaatatttataatgaatggttggaaatttgtaaaaagtagaggcatattagcaaatgaaaagcccttcgaactatgagctagtgggtctggaacccaggcattttgctcatggtcaggattcaggggaatcacttaacctcactgtacttaagtttccttgaatacgaaatgaaagaaacaactttatattaatagatgagcttgctggctcttcctgctgtcatacacgataattctgtaaaattacaaataatgctagatcacaaccctaatctcctggtaatctctttcatggttttcatttgttcacgtctttgagattatgaggaaagcaaaatccctgttactgaaatatcaatactttcctcaaaatccctgttagtaaaatatcagtacttttctgaaaggtggcccacacttttg

SEQ ID NO: 90276 - DNA, 1045 bp, Homo sapiens
tcacatggaggtcaatgccctcttgaacagtagcatagaccttatttagaagtctcatttatcaaggtatgaaaacttacaagcagggctgaggtagaaagaaagtgttgttttgatgctgatttcctcttatccaaggaaggagaaagtttgggtcactgatacaattgttctaccgttacagatacctaaaaatcttgtttgctttaatcttcaacaaaatcattacgataacattgccacttctgtaaatgaaagcttctgtagggcatttcctgcctgtctgttttgctgcgcgttaagaagctttggaattaagttctctctaaacccagggaggtctcccattttcttgctaatgggaatactcccaacacacatgcttcatgctctctcacctgactctccagggttttcatacttttaacaggatatggtttttaatgaggcttctagaagctttagaaacttctttaatgattttgttttgaccttttgctactgcctttactgggaccgaattgattgtctcaactgaaaatttgctgccaaaatttggattttaatattttcagatgcaactttttttttccttttgttgattctggaatgggcacatattaaatattacaatgaagaataatagtcttagttcccttcatgtggtagcagggcagcacacaagagtctaaataacttctctattatgaccactactactgtgatacccccagtgcctccaaatgttcaaatgtactgaacttttcttttttctctatgatacagacattttaaatagacgtaagcagaacatgttcactgcaccaattacttgtaaacagtggaaatccccacaaggcaatgagaagggaaggcaggagtaacaaaggcttgcccttggtgtggggccaagcccttcactttctctcctccctgttcttggtttcttgactcattaagtcaacattgtccctctgttgatttgcctaaactgttttgcacagagatcttgtagaaaattggcaaactgcagaacactgagcgt

SEQ ID NO: 90277 - DNA, 1021 bp, Homo sapiens
tgtcacatccccacttcctcatcacatccagctctccgtcctgcttgcattcctcctgacatccaccagcctgtccttgctggcctcggtgtggcccacgtgtgcccacaacagagaccctgctcttgacgtcctctattccaaggggataataaggtttttggcagccattctgttttattggtttatataaaacttcataagctaaaatctcttcatccttcttccccaaactgtactcattttgtttttaaaccaaaatataagactacagttgtctttctccaatgtcatgagctcctttgtcatttttccattctagtgtacacacactgtgtcctgacataatatgtgcagcaagcattacattgctgctgatgttgagatgaaggtttgtatcagtgggtgtcgtgatgtgatgaagggacagtggtgaatttagtcagggttggtttcatggaggagaggcgtgttgagccgtgactggaaggaaggaaggaatatgcctgggagaaggatgggctgctggggtggatgtagtgtcttgtccagggctttcatggctggacggtgtgatctcatctgcattctcagcattggtcttcaggttgcagttcttgaaacatgacttcatcaatagctagggagaatctgacaaagtcgtaatcactaaattttgtgagataattacatagatcatagtgtttttcctttaaattgagaaatattgtcaagcagactgggatactcatgtcagcagtcaacatattttcttgtagaaaagctacttgtgaagccaagttataatcagaatgttgctttctgagtttaaaaccagaagagagtaagtgagttgaacttaagagaaagtcctgactctgatagcctgggccataacctgcagctttaggccccacccagtggcctaggactgtggacgtgggactccaggatgcctcctaccctgagtgcagctgaaggttgccttttctcatgccccgtgaggttgtcgttcttcgct

SEQ ID NO: 90278 - DNA, 1020 bp, Homo sapiens
tatatatatatgtgtgtgtgtgtgtataaacattataaatacataacttatcacagtctgttggtgtcagcattttaccagtttgagcaaagtgtagaaactttgtttccatttgctctccttgaccatctctcatttataaaattatatagaataactacatgcattgagaccatgttagacagtgttctaatttttgcttcagtcaccaaacataatttagagaactcaggaggagactgtgtgacatatacatactaagtagtcgccttgaagtaaccagtaacaggttttctagtgtttatttgattatttctgtcaatgtaggctagtggtgtaggccaacacgcgtttccagaaatgcagccctgttggaggcgattacaacaaacatcaatgactgaatatccttttgcacatctccagttttataattattacatatggctaatattataaaagtcatcatcataactgaaacaaacatgcgatatgtttgtctgcacaggccgccataacaaaatgagggccttaagcaacagaaatgtattgtctcacagttatagaggccagaagtctgcgatcaaggtgttggtcaggccatgcttcctctgaagtcactaggatggaacagttccaggcgtctctgctcctggtgggcccttggcttgtggcagcgtaactccagtcttcacatggcattctttgtgtgtgtctgtatctgtccaaattttcctgtctttaaaatgacactagacatgttgaattagggagctgcagtactccagtatgatttcttcttaactaattaacatctacaatgaccctgttcccaaatacaggtcattttctgaggtggtggggattagaactttaacacatgaatttttgagggacacaatcaacccatgacatatggcaattcaattaatttatcatagtatatataagtattcagatgtatattctgatagctaatatgaaaggaatttgtaagctctacaactgtgcagatgtgcg

SEQ ID NO: 90279 - DNA, 1034 bp, Homo sapiens
catctcactttttccccccaagtatcaaattacgctcggcaactttacctgattatgttaatcatgctaaatatgaaactgtctttctttgaggcattggaatttacagaagctatatttatgcctttcagtagcattcactacagcttacatagtgaaaactaccaatgatgaagtagattatttttttaaaaattctgtaaattgtttagtaccccacatggaagttgggggatggggcatgaggggacactaatttgagatcatcagagttcttcatgcaatgaaagttgtgcatctctgatattatcactttaagtatggggtaaatcattatgaccttagtaactcccaaggtctatcctatgtatacagtacatatagtgacaattacagctctcgagattcttccgctcatctccttctttgctgtgtctttgggaggacaagaatgagaaatagtttcaaatgaaaatattagtgaaatcttagttgatatcgatctactgatttttatgtacactgtatagaactgccagcagattctgggactgtgcccattaatacatacttacgtcatgcaggattttgtcttaatatgctcagtctttatgtaaagcgtaattctgaactcatttgagtaatgtacatttagcataagcagagttgtaggctggcattattaaaatgcatagagctgacatcctgggcttctgctgaaatatgcttttaattgaagcagagttatggcgatatattacccacgtgagtctgattatagctcagcattggcttgtacagtagctccttgctccagaaaaccttgtagtagcccatatgttgtggttaggcatttaaatattctgtagtatgtatatctgaattgtttgatcggtgtaatctaagcatatgttatcttgggaaagatgcatcttgtagccaagtcggtttgaaaataattttttagtgataattgtatttaccagtgattaaaggtcattcataaagatataagttgtttgatcgaaattcta

SEQ ID NO: 90280 - DNA, 1013 bp, Homo sapiens
attctgtcacatgttcgtgtcatgtgggtttccgatatggaacatcagattatttaaaattggtggattaactaaatcgagaattttcccctgatctatgaggaaaacatctctactgacaagttgaagccctttgaactcttccagataggcttacatgctaatgcataggcttctgtgtctctgaggagcagtataggctggacaggcagaaaagagaaaaggattgctgtatcctatggcatagacttttaaccatttagtcaattgtgattttgtttaaatctccatgtttatgtgtttttaatttaacttgtttgctttctgatgcatttgatggctttgctgatggtctggataatacttgcagtagctctttatatgactgtttatgtttcaaagccaacaagaaacatctgtgagttaaaatcaagcaacttgtattcatgtagatcagcgtcagcaatgccttcctcttacctcagcagtcagatggtggtgagagcctaaaaccaaccagtcatcagcgaagctgtgcctgcctacaaattccacactgccaccacacacatcctggtaagatgtttgtatggaacatctcctcagagaagggaccatgcaagcaggtcacattccatgtgagtttccttcttgtatgtttcatggcgatgtttagtagcctatctcacacacgttttcacatcaaagatggctcattttaagccccttcttgactttaagtctaaacagatgttaataaagaataggagaggaagaagattaatcttataagcctgtgactgagtggaaagtatagatgtctcacatcttggcaggctccacagaaggtgaggcagtagagggagcagtgcctgttgatcggccaccgaaagtgttcctcactggagagtcccctctctgcgagatccccacagtcagaatacgttcttcttcttttgatgtttgtgccagtatgactcggagtaagttactagtttcattggcatttgccg

SEQ ID NO: 90281 - DNA, 1105 bp, Homo sapiens
ggcctcagttgagtgacaggttctgtcaaatgctcataactcaatatcactctgctcgagacccgagggccaccaaggaaagtgtaatggagcatttggacttccaagaagcttacgatctgttcctggttcagacaagattaagtaactttgtggaaggctaagaacatgatgaggttcatagagtatgttcagtcatgtgacagagggtaaatgttctcaagtacttacttcaacagagagggagactatgaggctagaggggtcccgaaaggcttcctacggagggcactgtcgctcggccctggaggagcgcaggatgtgactggggaggacgcggcgtggaccagccaagccacacacatggagacccaagcgttgatctctgagaagagtcctgagcatggtggtttcatttcaaatgtggattgttttccagttacaattttactttgctttaagctataaaaactataaacatatgctacaaatttattctaaaatatatgccacatgaaattgaaacttacccaaatgctggtatgaggcttgtaggatttagtggctttgtaactgaactctgaaatagcacattttcccatattccactttttctgttggcttaaaatgggaattcagcacacagccaataatttgagtgcttatgatgggcttcttcacaagatttatctaagagaaaggtgagtacttggttttcagagagctaccaatacagcaggacacctccattgttaaaggtgatctaggagtagtattgaaaacatgtgcctacaaatgtgcggactttttagcattctctaaggtttccttcttttgcgaacttttcaacatcatgtgtctttaaaggtttggaaattgcctgcctttatgatgtgttaaccttttctacacagcgtcctattgaagacaatctaaccttaaagcccgttattgaaaatacctccactggtaaaacccagacattctatagtctctttctcaaagcaccactgttgaatctttgctttatatgaaattaacttacctccttcaaaataagaaaatccaataattattattggcgattatggaatacttaccgagt

SEQ ID NO: 90282 - DNA, 1052 bp, Homo sapiens
tttcctatatcatattaattcaacttctttttgttgatgtcgttgacatgaggaaagtctggagtctactaagtgtttattaataggaactatgagaacaaactttagactaatctttgagttcctggctaattattacaaccacctaaattagtgttatccttagggaaagcaaacaaaaataaggaggaaagccagtcttccaactaataaccgatgttaaaattcggaattaagagaaaaagaaatgtgtggctctaaatcattccattctggaggcctttagagaggatcgagcagaagggaccttctggcgctgttctgagctgccactcactgctgggacaggagccacacgtggggcccaactctgcctgttgctttgggccattgaacagccagggtagtacaaaaaactgtcattgcttgacagtgaaacaggaaggaagcaaatggaccccgtggccttcctaaccttagaccacactttttccaggcagagcgtatggaattgtgactgccaacatcagagttctagtctagccctgccaccagactatggactgatatgtttccctgattgaacttcagttataatctttgtaaaatgaaaataatttcttgttgactggctcatagaatacttatgaggatggaatatgaaagcagtgtgtgtactgcagcatcctgtgtgaacatacagcatttttgccatctccatgtcactgtgtgtcctcagcattggcactcattgtatgcagacacatccactgcccctcacagcacacagcagtttcaccataagacagacttcggcatacaaactaataaatacaaatgcagtctagtgttgatttttctgctgacgtttgacaacttactgtgaaataggaataaatgtgagctctcggtgggaatagttaacatactttaggatgctagatgcactgccagaaaactttaactacgtcatgtactctgttaccaaaggaagtattttgacatattatagtgaaatggcactactgttaaattaagaattgtcaccaaaa

SEQ ID NO: 90283 - DNA, 1271 bp, Homo sapiens
gtgctttccttagctacccctcaccggggtggtaaatacgcctctcctcggccccaccgcacttagagatggcttctggcagcgctgggatgggcaaatgacctcaagctcctgagggcctctatcagcggtgttccacattattgatagcagcagagatattgacagtctgtgcttggaaggaaaataggagtttgatatgacatattgtgtgtctcagcaagactcataaataattttgacaagtttttgtatgcatgggaaagtccttgattcagcctcccataaaaataaacttctattatggaatgtatttgtcaagtgactgcttgatggatggagctgcatttaccccttggcagttcgatgagttgtagatgcacagcttaccagagaggatttacgggcagtacagaaataattattcagtatgaaatgcatagttcctctacctgaattttcattttttattatatttcgtttctgttgcatttctggtctaaaacaaaagaacttgccttttttttctctagagctattgtttggttgagggtttatattaaagcctgtgaagaatctgattcagcccagaccctgtcccaaacttagctggcgtattttcattgaatgcagagttttagggttatttcttgagagatttacaaatatatatatataaaatatgctctttggaaaattcatttctattgagattgaaaaccttggacattgactgccttattttttttctgaggttatcacagcttatttacttacttaaatgtaattattcatccacatttctgctacagaaagcagaatttgtacttaaattcttgtctcctcactctgaaaccttaaaacatgtcatccccgccaccccccccacccaccccccgccgccaacttagaattactttcttatcatacacactctaagtgagtatccttcagtaagctggaaacttaaggaagtatcaaatccccaccctcctgggatgctgcccagcttatcgcacgagagctcttgctggtcatgtctggtcatcctgcaacaaacctcagacttgggaatgtatgtttgaggagactaaagtgaacagcgggtctatgggagttttgattcttcgttagaacatagtactgactttttagaaggatttccatttgttgaatctccgttaaaataaagtcctggatccaaacaaactgcggtgaaatcagacactgagagaggcatgtcggatgaacggaccctccgtgctgtcttg

SEQ ID NO: 90284 - DNA, 1039 bp, Homo sapiens
atccatttaagtttttttcccaaaatcagaaaacacttgtcagtatttaataaatttttgttgaacaaaagaatgaatattggatttattttggtctcagtattcttatcatgtcaaaataagctctacttaagtagtaccattttaataaattgaatgtatcttaaactcgcattataattccactttgaaaaggcttataaggagaaatgaaaaattattgaggcaaatttggtatatttgtttgaaatacttccaagaaatataatttgttgaaagtataaattagcccaatgacaaatagactttttctagcaagtgtttaggaagatttttttaatagcctagtaaaatttacatagtcattgagaataggagaatttaaattcctgttttgtgtttaaatatttatcatgtgacatattaaaactcttctttttaaacctgcaaaaacaagtttcacctggttattgatatatttaaatattaaagtaaacctgtaacactagcactctgttacagctgtttgacatgacagttgagctgtcacattgtagaatgtatcgtcaatacattctgtttatggtgtccttgggcacctgtgctgaaatccattttccgacactttttgagttagctgaatgaacatcacagggcttgaagcccacctgctatacacatagtgtatgtacacatagtgtatgtacacatagtgtatgtacacatagtgtatgtacacatagtgtatgtacacatagtgtatgtacacatagtgtatgtacacatagtgtatgtacacatagtgtatgtacacatagtgtacgtacacatagtgtatagcaggctctgggggtatctacagtgtacaatgctgaaatgatttgtaatcattttaaccccaaatattttcttttccagtgttactacactttgccaacgactcatagacatgacatcaaataaaagcatttttttccaaattattgaaaatctgaattagactagcaataatagaaaggttggaagcagttctgccccc

SEQ ID NO: 90285 - DNA, 1046 bp, Homo sapiens
tttttagagacagggtctcactgcgttagccaggctggtctcaaactcctgacatcaaggtatcctcctgcttccacctcccaaagtgctggaattacaggcatgagccgtcatgcctggcccattatacattcttaaagaggactcacaagtcaatgtaaaagggaaatattatttaatatttaataaattttgtgagacttactaggatagcagtttgacagagtctatttagaaccttattggatatagttcacaaagataaaagttgatgcactaaagagttaaatttttttaattataaaattctatacggaaataaaattaaaccaaattctgatgagagaactttctcataatttgaataaaagaactaacaaaataactgattaatagatataactatataagctacattctgtatgtcagaagttcccagaataaaaaggcaactagaatactgagaaagtattttgtcctcaaacaacacattaaaattttatatatttttatataaagagctcattatcattaaatcaataggaaaaacactacaaactcaataaaaacaggtagaaaagatggcagatcaatcataaaatagaaaatagaaattttataaacaaatgtctggaaaggtatttattataactagtaacttaacaaatgcaaacttttttaaaagaaaaaaatgatatacccttttgtctatcaaagtcacaataaaagatacataaacacttggtgtaacgtgcatctgctgcaggtaatggtgctcattggttcctagtttttggacattaacttgatgatgtgaatcaggtgccttaaattttttcttttaatgagagcaagagaaagaaagtgagagaactattttcacagtgctatttactgaaagtagcccaaatatcaaggggttggggccacacagtcactttgactgtcattcacctgtgagtctgctgtatcacatagtggcttagagcactcctcagacagagctgggtttaaattctggatattgtttcacattgtacatggcc

SEQ ID NO: 90286 - DNA, 1154 bp, Homo sapiens
ctactacatactgggcttaatacaccatgttacctgtgtaacaacctgcacatctttcacatgtaccctggaacttaaaataaaataaaattaccacttagcatatgtcatatattaataaaaagccttgaattaactattcatatgctaccattaattgtaattaacagacataattattataaactggtattagtgatatatcctaattataattaatagtatgtatattacatgtaatataactaataatgtatcatataagttaattagtaattaatggtagcaaattttaataactacctgtctaagtaaatcagagactgaatcagccaaattcttgggggctaactaatcaaagctaccctctgatttaactgccgacagctgaccacttcatcgtgaccacccactccttcatcccacagtggcaggaagtcagctttctctaattatagtcggctttctctaattatagttgtgaatcgtcagctactctagctatctgagcacctacatgaatgcaagtattggtggtatagagtaatttagtcattccccacattcaatagaacctactttaaagtgggaaactcttctttagattactatatttagcttatttcatgtactactgttgtagttgcactttgaaatagttcagttatttaccattgtaattttactagtttgtggtgcgttggttttgatcaatctgcaacaaatattgagctccctcttcagaacgcactgtgctaagttatggggcaagtttcgatctagaggcctgggtttgaggaagaaaacaagaaggaaaaaggagagcatgtgggagtctcaagcttatcctcaaaatgtatgtgagttcatgattaagtttgaaactaagattttgtttgtagactttcaagagaaaagccaaagaagttaggctatttggaggatttcaattatgttttcaagaactcctatttgggtttctgaaaaagagcctaaaactggtgtgctggtttcaggggtgtatttgaaattctgttcatttgttaagagggagaattctgttaggactgattaacttactcgcagatactgttcctttatcatctatgtctgttgattaattcattatgtaatcctatcctttaatcacacca

SEQ ID NO: 90287 - DNA, 1038 bp, Homo sapiens
acttaggagttaaacgtgtatttaaaatccatgtttcaattactgtatcacctaatcttccaagcatacacatggaatactgttcctttgtgtggcagctgtaaaaatcctaagcagtttttactgtcaagaaaactctgaataaacaggggctgttaacttaggcagatatctgaggttatttggtggcaatcaagaactcgcagcacttcaactaatgggttatgatcagaaactgttcctaatagccagctagacggatctgaatatgaagatttctataattttgttgtcagcttgtgatgtactctagtgctaattatttggaacaattatgttttcctaataacaaaagaagaagcagtgaattaagcaggcttaccttcacatctttagataacagtttaaatgcacttgccattaagaaataacatttctttttgccttacggagccctaattatttaagatgcttgtcttttaaaatctaccgcttccacttcttctaaacctgttcgatgtgtcagtttacactgatgatttcagtaactagtattttctcagtcttaggtttatgcctgtacctccatagactgcttacttcatttagttattcaaaaaccataattagtgcagtaattaacgtgtggatccttcaaaggaagactgctagaatcatgggacgtgtctcatcattcttactgatgtgtggatgataaagagactgaggctgctgtgacaacaggacttgtattactgcacagtaacggtgctgcagggaaattcagacaggaccttggtccacagagccccaacgtttgaaaaaagtaattatccacactgtttccataattcagctaggtgttatcctgcatttgcagctgtcaaatcatttgttttaaatgtttttttaaatatcttatgaatacttgaaagttttgagttttgcagattatctctcagcctatttctaagcacaggggccaagcttttttttttttttttttttaatccattacagagtctttcctgacaattt

SEQ ID NO: 90288 - DNA, 1051 bp, Homo sapiens
tcatcttctgggattattgttcaagaccagcctctaatgggaggtgaaacggtacgatggtctcaacacctttcttctgaactgtaatacatatcacaaaaagtacatccataattcagggcaattgtcagtctttttagagaaggggccagggtggaacaatcccagtgagtaaattatttctcagcgtggacttctctgcatgtcgggcttaaggtcaccagccgggcagggtggaaggagcttgcctctttgagaaaccaaggagtcccagtgatctgttaccatttggttatgacttctaaagagccaaatgctattccttcaagcctgttttgcaggcagaaaataccagcagtgtcatttaggggttcctttgatgatgactactgctgttaactgacctcagcattaaaaaaaaaaaaattcagggaatagtttgcaaagaaatgaaggaagttttgcatgatatattctataacttgtcattatatgatttcatctggatgaagttcctcaggagtaggatagagcctctgtaaatggtcattagtattacattctgtgtttatctaatgaaagtgcagtgacaagtagctgcttcttattaaaatgaaaatcctgcattatgtacttgaggaacattccagctaatgaggatgtaatgtcctcagtacaacgcagaccttctttttgtgttcaccaccacaagatgctggaagcttgacaaatgatatcatttaagacacatgcctgccttagggacctggtttttggcttcctgtttctggcttttatttgggtaacgtttataatggccacccgacttgtacctgggtaatgttttaaccccttccccagagttctcaattagcatgaatttactacagtcagagtttcctttaaattggggtgggggtgctaagcactgaaaatatctttcttgattactttaccatgtggacatatgggataaatactgtatttcagatttacataaaagtagattagtaatgcacagctttcagaataaaaactgataaaaaagacc

SEQ ID NO: 90289 - DNA, 1049 bp, Homo sapiens
tgagtgaggcctggcggtaggtgagcatggcgtggagctcgcgggagagttggagatgtgatcgcttctgtccgtgtgtcagcgtgatggcctgtccacgccgctttcttctgactgtgagctggcccatctctgtacgcttgccccacaacctcagcatgccctttggaacatcagaagtcccccacagcctcagcaggtcttctgagaactaggaattagagccccactgtcgtggaaatcaactcgtcatcaagtagggccgacaatgagacagctgaccatcctccacattccgagcctgaaggggaaaggttttcccaaggagaggtgctggtgggctcgcacgccatcctgagcacagcagacagcagttaatgcaagactatatctcggtggcgggttttacttaatgttctttattatgaagaatagcgatacctcaaagccatacattttttgagagtagcttctccatgttgatttttctttggatgggttgcttagaacggagccaaaagagagccacttggtggagaggcaggtttgcactttgccctgtttttgtgtatgtggatgtcaaatgtcaatttgtttggtaaaatgtgaagctgaatttataaatctgtgctaagcaattagtttggaaattagtgctatctctaggaaaatccccttagcaggcatcagattcaaacgatgcaactcagtaggtgtgggggcaaaactgcaacatattttcaaggcaaaatcttacaaatataaacattatatcaaatataaacatatgtttgcagtgtacaaatgtcttgcatattcaaagcaaataagtcctgatgggggaggaaaaagtatttggatgtagccgttatgtttaattttcctcacacagtcagtagatagtctgtgtctgcaaaggattggtcctttcttgctccccactcacccaactctgtggttctagaaccttctattaattcccattggtgagcccatgaaatctttgattccttcttgattgctctctgaagacgcctatcaggcactgt

SEQ ID NO: 90290 - DNA, 1040 bp, Homo sapiens
tgtgagaatgtgagaaaagttattgtttctctcatccccacccctttgtacttcgtacagtccctaccacactgaagttatttacagcatcagataccatttaaagagatagtgaaggagactgttgccttcgccaggaactttccagaaagaagtcctataaattagccattgctcaggagtggctgtttcctaggcggagctagccctttcatttttctgcataaggctaatttatttttgcagccagatgtgggctgacagccatcactcagggcttccttcccccgccgttaggaggtctggaagacagtcacgttccccattttgcagaatccccatcaacattattgaagatggatgtatctttaaagcaaagattgattgtggatatcggagttatggtgtcatttatcatggtgaatattatttagacttgggttgtacaaggctgtaacttgagacacagccaggggagggacaacctgaaaacgcggatccatgaattttaatggatggatgcttttttcaaagctcaactcactatagcgtgatttacttttcttactgcaaggaaacaagcatttcagtcttaaagagacagcatgccagtggtcctgttctgtgggttccacccgggaaggcattaccaagggcagtcagagcccaggcaaaaatgctgagaaggcgtgaatggtgcaacagactctggccatagacatgtacattaaagatggctttccagatggatctcctcctcgccatccttataggaccctgatagggttagaaatggagatgtaccccagagctcaccattatcagggcagcagttaagatgctatttatttgaagccagctaacctctcctaagtgctacagatagcggccatttatatttaggaagacaaatgaagcccaggctctcccgtgtcaggagcatgatgctgtggggagaacgcacagttatccttgtgtgcctaaaggtagtagcatatgcaatacaagcagtcttgttgacctaattaatatcagtcttt

SEQ ID NO: 90291 - DNA, 1021 bp, Homo sapiens
tggtagtatttattggcttgctttttcactcactaaatggtgaacagctttttacacaattctttatacattttcattattctttctttagggtttttttttttttttgacattgcttggtcaagctttggcacctactgcaaacctgttttcaaaatatatccatctatctttccatttctagtgcatgaaaacgatcatattcctgggccgttgccagcatgggtattttttaatttgacaatctttgccagtttagtaactgtgaagtagtgttgtttcagcttgcatttcttggattacacgtgaggggggagcaatttttccatatgttttatgagacaaaggtattttttcctttttgaattattttcggtcatgttatttgctaatttttctgttgctttgttccatcatcttactcatttggaaaagctggaataaaggtgttaactcatcgctttagcatctctatacttgcagtccccaccttctgttgtcttttaagattatgcaagtgatacaggcttattttagaaaaacttgaacaaagaaaaaaatttaaaaattaatgaaacttatttgaaatcccatcatccagaaattaccaaaattgatatttgggtatatattcttctggatcacttcctatgcagatctattaatgtctgtctgtctatctatatttatctctgtctctgtatctatttatctatctttgtcattttcagtgcatgtatagtatcccattttgttgttatgcacaaattactggagaaatcaaccattgttggaagtgtggttttctcccactttcatattataaacagctgtgtaattaatatctttgtatgtatatcttggccatagtctcatcatttccttgataaattcccacaagtaaaattaccaggtcaaaggttttggatgttttaaattattttgttgcgtgtactgccaactggccttctgggaaggtcgtgcacattttcagtcccaccagtgacatgcatttctctgg

SEQ ID NO: 90292 - DNA, 1021 bp, Homo sapiens
aagtccaggatcagcagggtgaggcagtaggctggagacccaggacagccaatggttttgttccagacttgagacccgggagaacggatggtttagttcaagtacagaaccaggaaaatacaaatgtcctagttagaaaacagtcaggcgggataaacttcctcttacttaaggggaggctggcctttgtgttctatttaggcctccaactgattggatcaggcccacccacactggggagaggggtctgctatgtagagtctacctattcaaatgcggattcttcctgtaacactcaacagagtggtacttgaccaaatatctggacagtgtgggccagtcaagttgacatgaaaaattcaccatcatatctgtctattggtagatgaagtcttcattcctaaatattctactttctcattactctgtggattaggactcatatttagaagaattaacttgcctccctaaattttaaaggaaggtgtccactctgtaaccagctgtgttatttctaatgttatagtgtgcccctgagagtagtaactatttctttttcttggtatttaagtatgatgttggtctgctagaccatttgtccctaaggcttgtagatcatttgacttgttcagatttaaattttatttaaattttgactcaagccattatttctccaccaatgtaagggttatagtctctgcagttgaccttaacactgcaacctgtgaaccagtctccttagcgtgaaattacatcatggaggggaatccccttttgtccattatcctgggcgtttcagagacaggcctcttgaagagccaggatgctatagatcaggaggggttgggaggctcaaggggggagaataatagtacgaaggccaccgtggcaatttcttctattcttaatgccatagaaagagcactgtgaagtatgggcatgaggtgtttcttcctggcaccttgtcaaaggaaaattattttatgcaaatggaaatattctgttccgagaaataatagat

SEQ ID NO: 90293 - DNA, 1049 bp, Homo sapiens
gatctcgaactcctgggctcaagatgtcttcccatctcagcctcccaaagtgttaggattatagtcatgagctactgcacccactcggacttatgtgtgtattttaatgttaatataattcagaaaaatgagaaaggccattctttttatagcttttcccaaatcaacatacatatgaaaataaaaactggtctgctcaatgaacttagaggtattttaaaagcaaacgtacacttgggcttgctatgatcgtatcattgttaattcctgttgatccgattttatagtgatttatttagattttctgcaagagactcaaatatcaaatgtccagcaaattgcacttagatggaactagaaaattctaatgtattttaaacagttgttaaattacctgcattggcttatctcatctttgaaatttgctgatcctgcttctgaatactgatcatggttctagctttttatttatactgtttaatcttagatctgcacattaattatagttatgcagagcaacataacttcttgtaagcttaattgtgttttgaaccaatgggaaaaggtactgacttcctacgtagctgatacacagcctatagcctccaagcactgagaaaatgtatttggcagaactgcagatacagcagatacttatcaaattgtgtaagaagtgctctttctaaatggaagacagctgtattcaaaatgcataaatgtgagtaaaaatgtacacttgctatcaacacacgtacttattgagcaagcaagataaaatactacatattaagtgtgaaatccctacctcacatccttctaacttgaacatacagaatctacaggcatatttattacctattataataaagagcttatttagatagagttaagagaagtaatgaataaaagtgaacatattctgcagaataaaatatcaacttgattgtccagagtttgttaagagaagacttccatagcttaatatagttgctagggtattttgtcttttctgaacaatcttgtaggtgtctgaaagaaggtgcttttcc

SEQ ID NO: 90294 - DNA, 1012 bp, Homo sapiens
aaaatatttagataaaacatattcattctattggaatttgaaataaataaaaacatcttggagttctgagatttgtaagacatttttccccaatttcagagggtggcgtaaatcgtttgacagcccgctttggtctgtggttatttatttttgttggctgaacataaaccaaagtgttaatgctctttatttatggaagagttttagggtaattcacaagatcgttcatctgaacagatgcccagatggcccgagtggtttttttccaactcttttgtggactcgaggacatacagttttttaatggagacgctgtgtttttctcattttctttcacagcacacatgttatttccccactgaatacacccactgttcttacccttgcactgtcacccatacaggacgcacagggatggacgcggacggaattctgactcagccacacctggaggaaattattgtgtcaaaaatgtggggacacaagggctggcactgtggtttgcaatggtttactgatgagacagcaaaaatgagacaggaccatcagatgcaataaagattctaatttaaaaagataaaatgtgttttaaaattaaaagatagaactgtgtctctactggctgaggaaagaacagactagataagttcccgaatgtggctttccagatgtgctgggcaggaaatggaactctgaacagcactgggcgtccttcccccaaccggagcgtctagccttgggtacgccactctgcgctgggtacgccactctccgctgggtacaccactctccgctgggtacgccactctccgctgggtacgccactctccgctgggtacgccactctccgctgggtacgccactctgcgctgggtgcgccactctgcgctggggacgccactctgcgctggggacgccactctgcgctgggtgcgccactctgcggtgaaaatgctgttgtggaagcccgaaggcctttgatactctgaaaggcccttagatgaagtgcaga

SEQ ID NO: 90295 - DNA, 1055 bp, Homo sapiens
gtttctctgtgttttagttattaaaaagaaattctgtacccaaagtgacacgaaagtgtagtctacatttttactgtttcagaagcggcatggaaaagtgcagttggcctttggagctggaagtgtcttgctggtgaggctccatcctggaggctctggtggggagtgggctggcgctggggccctgccggccgcgtgctggatccttcctggcttgcaggagagcaggcgtggaggacagtcagcttgcggggccgcgcagggtgcacagagtgcaggaggaaggttttcacccagttaaacagactggggagcccccccaagaacgccatcccttgaggccagctgtgggcaggcctggatgtgtggtcccttccttccacccatcgtcagtattgtgttggtttgttaatttgttgatttggtcatagtatttaatatgatttgtgtttccttatttatttagccaccgttttgattgcctttttttttccgaatggtaatttctgcatgatacacttctgtacgttgtcttctgactgttacagactttctactacctctcccgatctgctgtttccttgtttcttaacaggattttttacagtgttgcgtctaatgtaacttagacaataaagggtttggttgtctacactgcagcttctcggtgtctctcccctgctttccgctcgctgcttcccgctctgcccctgctggggcctggctgcaccctggcctgccttcctatactctcctgtttcctgctcatatctcttcctcatttttgcgttcaaataacacacagctaatgagcttctaaaaatcttttcaggttgttcacttgtattccttaatttgaagaatgaatatttaaattctctcaaaagtcagatattgaggatcttctctgggaaattggccactgtacctgcccacctttctgcctggttccctggaaggtcttattgtcatcttagacggacagatttcattctcagcaccatacagatttggcttcaaagccaggtgaattttgcctttgaggctctgaaaag

SEQ ID NO: 90296 - DNA, 4238 bp, Homo sapiens
agtcccagtagtcaatatccatccctagaacactgaaataccttcaagaaagatagtatgtctttcagcattactgaaaagcccacagttcacagctgcagaaaagaaaagcgaaatcttccgaaagcttctcatgttttgactactctttcccttccaggaagacaaggcgatggtgggcgtgctcaaaagattatagtgtgtccacttaatttgaatatttctctgcctcctttcttccctgttttattcatttcttaaaaatgctctagggctgctttattgaataataacatggtggcctccggtgaatcaataacttaaagcaactatcttaaaaaaatgaggtattggaacacatcccttcagttatgaagagaaaatgggcgtctctgcatctggatttgtgaacacaatttaaccacctagttgtttggcttatcccgactttgcagtgcttccaaaataaatatttttaaagccttctgagccctgtaatataaaacgttagcccttcatggacggagggccgtcttcctgttgcctctggaacagtccattgatgcctaacccaatgcaagtctgtgacttctggtccaaaagaagagctacccaggtggatgtgccctgggggtgctgtccatgtgcaatctaggcacacacagcacctgtgttcacaggcatcccctgcccgcctcttacggtccctgacgtctatgtttgctatgcagagacggtcaaggccaaacacccaatagctaactataactcccagttttctttggtaaacacgaagaccattttccttccagaatgtatttggaattggttcttagtgagccctgttgatgatgaatatttcccatcagaacctcagagatgtcttcacggcctgacgtcactgtacaaaaatgtaaaacagtctttgtccgtttactgcaggaaattcaccatctacttagggaagttttatcacatctctcattccattactgtttcctacatttcaaataaactgctgtctccaccactttgcccaccccctaacccctcgtaaaattttgtccagtatctttctgacttccactacatgccaactggtagatgtcacaaacacagagccagctgtaagtaggagttttctggaactattaactaaagaaaagcccttaattcattatgtcaaccagaccttcccccactccgccattatttctggggttcctataggcatagctggaaacagaattttacacgagtcccttagtttatgtatgcatgttaatttccactggtcagtttcacttcatcaagattttagctgaaggttaatgcagttaagtaagattaatctggccatactgtttctgtcctcagattgtaaatgctattgttcaaacagggatgcttcaaatgtcattggagagcattctctgaaagctgtggacccccatttatgcttggttttctctcgcagttcactttagaatactccttccctttttccaacttggtaattgtttatggaaatgggtgaacacgctctgaagttctgacagacctacgtgagagccgtgctcttctttttgtttgtatgacccccaaattcagccttgttttggaactaccgttcacttgtaaatctgctttgtactatacagttttacaatctggccgcctcctcatcttgccaacttgtaaccttctctccagagctggttcagacactatcatctgccattcttacatgtgaaaccattagagaagcctaatgatcctttctaaatcacactggaaatgattcgttttcaagctgcctctctttaaggcaggaaggcacatttgaaatacttgctgctcattttatgaaatgagttacagctcaggtcagggggtcttcgcctacttggttggcttgctttgtgaaggtcattgtttgtgttcttggatgttgattagaaaattaataggaaaaatgcatttagaaaccaaaaggcagaaatgagcttttctcctgttctttcctttttctcacccaggggagagaccattctaacacaggtaccgtccagacagtgcctctgagaaagggaacctaaaggcgtgtttccgacgcaccccaggtccccgtaacggccattagcagtaccctcacgatgtcccagcagcctcccacctgtgacctggccgctccatggaagaacagccggggaactcctgagcagacacctcacatcccgagccgctgcgctggagtggaaactgaaggcagatgcctctccttgttaaacgttcagaaataaatgaagatgctatattctagaaatacatgtagatactatatacgcatttacgtgctcatcgtccatagtcccatattttcttataataaacagtagtactggcaggcacagtaggggcacaaggcatctgtcttattcaagacaagtttgagacactggaaaaaaagatacttgttgtgtgtgttggacagagtggcgaggctgagcactgtcacaggggcctcccatgttaagagggactgtggggatgatgtcagaacaagacgtggtggatttgaggttgatcgagtattaatactactgcctctccttgtcttagtgggtatttaaaatagtaaataagagagaggaaggaggtgacgttcaggtgctgtgggaagcaggcttggcggaggggtatgatgatgagaccctcattgttcactggctccatcgcactcctccctggggccgtgtgcctgttccattcttcccaccattcgaactgagcgaatctggcaaaggagacacgtctgtgggaatgcgtagattccgcctcggaagagagctagcgcaacactaagaaaagcaggcttcttgtttattctcaggacctttttgtaacagggctacattctgcaaactgcttacaaaggaagactatacgtcttaacaaattatttagccactgagtcctcccgattcggacctgttttagtaatggcagaagaatccctgagcaggttcaggtgccctagatgactagggtgctgagctctggcgccttctgtccccactctttgcctccccgccccttccctgagccaccccagcaagtgggtgtcttttctccctgggcctggtgacctccacaggatgagtgactttgttcataaagggtggggatcaccagccccttgggtgggggacggcttcatatacctcttcctcagtaatgcaaatgcgagtttttgtggtgggggttaaggcccataacaaaggatcttaaaccatgcagtgtacgcaattgaaatggtattccacagatataaatattttcttttcccattgccgtgacactatgtgtgatggtaatatttctgagagtttcagatttttgcacatatgattttatgcattatcaaaagttactgctgccttgaatgaaaatgttctgtgaaattttttgcaaaagctttactaggtttttttttaattgtgaaattttgtaaaggcaggaaatggattaaaacgagcatgctaaatatatttttcaaaaaagcaataattttacatgtacagaaattatcctaacctttaatactggcgagagcaacagtttacttaatacggtaatggactagtgcagtttttgtagacagtgggcttctgatacaaagtcttgtttaaacacagacacacacacacacaaacacacacacacaccctaaagtgtgggtttcctgttctaatgatttgttgaatattattatattattattattattattattattattgttattgttattagtaatgtttggttctggattctacttgttactgagtttaaattacttgacggttcaggttactttgcaacactttcaaacgatgcaatgtaactggctagcttatatatatatatatatatatatatatatatatttttttttttttttacttatttttttctgatattcttacaccagatatgtacgaaaatgatctgtcctgttggtgtaattaggaatgtccatgcagatacagttaaacaactgtaattgactgttctgtaaagttattttgggcaaagttgcggagacacattcctctgtccacctaagaaatcagaagactcttctgttgatttatgtttaatcatttcagtagtttccccacagtgatcatttctgcattttctggcttttgttttcttggctgaaagtgaatggt

SEQ ID NO: 90297 - DNA, 1080 bp, Homo sapiens
ccaagtgtatgacctccactgcagttaggaagcattgtcctttttaacagaaataaaaccctcttgccacaaacagtcaccgtgatgtgtttgtgggatgtagtaagagcaaggtcatgccgtaattgagaattacaagttgatgttacaactggagtgagtgccaagtgttcctgcttacacaggtgacccgttcaacccaccaaagacctggcttttgggtaggaatgtttgacaggggcgggaagccaggccaggtggatctaggaacaagttggtgagattcttcaggaatgcatgtcagtttatttgctgcctattaattctacctaagcctctttgaaaaactcttgtcccagggagaaataggagatcaaaaagcaaatcatttagactattttaaataatgtctgtgttacttattggttatgccccagcataaccagttgtttataataattttattatatgagtaacaatataataattgttactcattcttgattctgatatagaaaagatgtacttatattgttctctttgtctctctagactaaaatattgttattttatacttcataccaactatcctcttagtttcaagtttacagtaactcaatattgtggtctgagtgaatgtggctttcagacttagcctgtgtattaactgttggtgtgaagatctcggtgggtgagctttcctttcattcataggacagtggcagttcaggcctggcattaaaactgagctagatttgtatgcgtctcctgctgtggcagttggtttgttaaattccatatctgagctcatggcctctgatggtactttttgtctttcattacatttaaagtagcttttggtgatttatcactgaatgctctgcagagttctctaaggaaattccattttccttaacgtactttggaactataagcattcctatagagatttgttgggtaggataattgcaaaacacatcagtaataggtagaggtttaaatcctagggttccttgttcttatcctataattctcattgtttacagaaaccacaatagctgtgttaaatttaagatacct

SEQ ID NO: 90298 - DNA, 1013 bp, Homo sapiens
aaaaagggcagtggccccaggcagccattatcacagtctcttactgtaagtgttacggtaaattggtattttccagccacaggctaggcgctggtgtctttttttgtggaagtacttaatctgtaatggactcatttaatgtgcacgtccggaagctcacacgctgatctgttaacaaaccccttgttcccacagtggtgtttgagtccgatgggcctcggggttctgaagttcataccacctccgcagacgcccccaaacaagtaggtctcatgatgaattggatgtctgggtttcgatgcggtagctgggaaaggtgcaccatgatgctcatcactgaagcatgaccttctttttgtttttttcactagatgtgtaaataatcctatatgctttgacttggaacctgacccttcggggccgtctgtgggcagtacccgcacagaggtcctcccagccgggtggtgcagggtctaggtgcacacagctggttgttggttgtattggggaggaggaagtcgggatagactggcggtgactgcaaacactagaaactcagtttttccaagatggttttggatgtgagtttgcttgagaacaaattgtggttaacctccttgaagaacattatttttgtgttattccgtaagaaaagtttcgtgtccagcgtggtgtcttgcggctttgtgccttgtttctctgcattacgaacacgactggcaaggccagagtgcctgaaagtagctgtgtgcctgtgtctgtgatgcaccttaccatccaggcgtgacctgtgtacatgcatgactcagtacacactgagtgtgtgggaccctggcactagcacacggttctgagtcctgctctaaagtagagaggcacccacagcccgcagcgggtctcttgcattctctcaggctgagagtatgtattttcattgctctcccattttgccctcctggaggacgtcacacctgtgttgcacaagcattctctaagtaacattctggctttct

SEQ ID NO: 90299 - DNA, 1022 bp, Homo sapiens
tcttctcttctcaccgcatgtgtttgttacgtgtctgctaggtgggtgtcgtctgcagctgtaaagatcacaacttccctgtgagtggtcattgattacccctattgctgtagcatcattttgtagtttggggaggtagaaatatgcagaggagaatggtctcagagaataggaagtcatctcacgtgtacatgcaatagttgtgggtgctagaagtgtgattctgtgattttgcagtggacatgttccatttatacagagaatgttgctattggaggatgcttctaagacaggttttattcagaagttaggaaacggaagtctcaaagacttccccgcccccacatgtgttcgggtgatgtttctgtagatatgaagagtctaaaaactctacccaaacaggaaggaaagaactattgctacctcctttagggactccctgaccatttaagaagaaaaacccactgcattttctgtaatcattgtacagtgtgactaccaagtctataaacatacaggaatagaacataaatgacttattgctacaacagtaataaaataatacatgatctgtgttttcagaccttacggccagtctagatgatctgatagtatgaatcttagaataaaatttgaagctaataaaataattccagatagaatagatggtatttcttattgggacctaaaaaagtcatttataccaaggaggccttcatattgtggtgatgaaagctttgtgctttcttgcagtttgatctctctttgtagaatctttttcatctcctctttctctatggatagcacagcaccacataatgacacgcaacgtagcagggctgggtgtccctctctgaagttggccaggcctttttctttgaccgttaagtccactttccaaacacaacttgaatttctaggtgagaacatttgagctgcgtgcttaccaggtggtcttcagttcaaatgaagtttataacctttgtgattgactcggaatgttgtagcttgggcataatatt

SEQ ID NO: 90300 - DNA, 1030 bp, Homo sapiens
tttttcccaagttttaatataccagtcaccctctgttaactagggacagcgtcgttacatgtaactagatacaccactgctattgtattttttccctgtgatctttcaggtcatttaaattgagaaaagaagtcctgcctgactcacccccttttgttcttgtctgggtggctcctcaggggttttctaagagccacccagactcaagggtggcttctcccgctgaagacagatggcttggaacatgctgtagctgtacgcaccgtgtgtcttgctgtgttctgatgagaaatggtaacttcccgtttcatattttgcctcctctagggggacagccgcgccgctgctgcttttccgaagaggtgacttcgaccgagctctccagtggagaccagagtcacaagatgggagataacgcctcggaaagagacaccggcgagtccaaggcagggatcgcagcttctgtgtccatacttgaaaacagtagcagagagacttctagaaggcaagagcagcacagattttctatggacttaaagatgccagcatttcaccccaagcaggaggtgcccgtccctggtgatggtgtggagttcccttccagtacgggagcggagggccagacgggtcaccctgcagaaaagctgtccgatttgcacaacaaggaacactctgggggagggaagcgggcgctggccccagacctcatgccgctagatttaagtgcgaggtcgacgcgggatgaccccagcaataaggagacggcctcctccctgcaggcggctttagtcgttcacccgtgtccttactgcagccacaagacctactaccccgaggtcctgtggatgcacaaacgcatctggcaccgcgtcagctgcaactccgtggctcccccgtggattcagcccaatggttacaaaagcatcagaagcaatttggttttcctttcccggagcggacgcacgggccccccgcctgccctcggtggcaaagaatgccagcctttgctccttgctcggttcacccgcac

SEQ ID NO: 90301 - DNA, 1063 bp, Homo sapiens
gtgtatgttatagtttgttatagtgttacagtgtgtgttagtgttacagtgtgttacagcatatgtcacagcgtgttatagtgtgttagtgtgttacagcatgttacagcgtgtgtgttatagtgcgttacagtgtatgttagtgtgttacggtgtatgttagtgtgttatagtgtgatagcgtgtgttacagtgtgttatagcgtgtgttacagtgtgttatagcatgtgttgcagcgtgtgttacagtgtgttactgtgtatgttactgtgtatgttgtagcatgtgttacagtatgttacagtctgttacagtgtgtgttgacagtgaatggatgtggtggggaaacacagttgtggggctgccacaggcagtgagaaggagaaacgtagaatcctcatattcaactgacgtttatttttaccgaaaaagctacttataattcaattttaaaacgtcactgctatacttgaccctctggccgagaatcctttgtaagataactagcaaaattgtggaatctcacatttaataagtgacactcttttgcattttgtatatttaaatatcatttttcagaggtttagatgatttaaatatttcttaacttagggctttctgaaacttatgcagaaactcaatggtagtcgtaattccataaaggaaatgatacatatatttgtaggaatagtaagaaaatgttgagtgtggtattttctctaattgaaagctaccaagttaatatagttaattacatcaaaaagggagaaaaatcctttgaagttttattacttcttggctttcagtaacaaagcagtatcagatgtaaattctgaaataggtttttatggaagattacttaatatgatacattaaggtaaaaatccgtgcttggattatatacctatttaaatatgtttacaaagcatgtgctagaaaaattggtaaattacttgtaaatatctttggttaaaaaccaaaagtcattgatgtttccccgttattgaaggcagaagacttttgagattttaaaagtttctcaagattcctggcggtgttctt

SEQ ID NO: 90302 - DNA, 1062 bp, Homo sapiens
tctgaggctagtttttcatgagggatttgtcggctattgataggatccagtatttgcatatataatttgcataagcctttgcatattaaaatggattgccattttaggtctgtattttactagaattttaaaaagctagggatatttgtctctggattaaaggttagaaagtaagactccagttactgagattttacctgattctgtatgcatggttcacatagcgatatccatttacaggaggccttgtctcctgctttctttacaaaggaagccattgatttgaaagaagtattttcacagattagtaagacatttgggcgaactgttagctgccaaatatgttcctgtatagatgtgccaaatctgagtgttactcatgttctttctcttaactccagaatagttacgttcagcactatgaataaattctcttccaaatttaatacaattactgttttatttaataacctacttggttactgaaatgtatcacttaaaatgataattccacggtgccatttgttgagctggccatcctatagaaaacttacatacatgcttgaatctcatatctgaaacctgatggagaatggcagctgccttcaaagtcatgaaattaggttgttggtacctatgataatccagtgattgattccaatatagacattattgggatagtttgttcattggactggacaattagagaacatttttgatattgaaatgatggccaggtttccagtctgactagttaaattgtgtttcctttgatttaaaattaatctgtgatgtcactggtttttaaaaattgattactacgtgactcatgagaatgtgatttttatagattatttcggtattagactaggacatgataggagtggaatggattgaaattttttcatttttaagaaatattactgggttctactttttcaaaaatgatggaagatggtaggtccagggccatgagactgaaatcaaggcctaaaccttcggaagcatcatggacagatagggatgtgttggtaagaaccttgaaatgcagttaaaggtgcc

SEQ ID NO: 90303 - DNA, 1050 bp, Homo sapiens
tctaaaaacaccaacttttcactcacaacagctgcctttaatggtctagtgtagcaacaaattactaattcatggatattctttaaggagagagagaccgtgttccattgatttaactactctcaaaacactgtgatttgtgggatttggcccaggtctttcacagggctagcttggaaaagaaactgggtattttgaatctcatatttaaatctgcagcattcctttctttttctgaaaaaatacacgcaactttgggaaatgcttgcctttcctgttactaaaaagattacttagttctttaagtgttaggttattttaaattctcatggaactctgatgggatgattggttaacactgttagagtgtctgtgtgggaattgaggaacgaaagatcacagtggttcttacaagcagcagccagcctgcctgtgggagcacagttgaaattagaattcagatctatgcgaccattccagtaatacccagttgtgccataattttgcccgaacattttctttgacatctgggaattgatttgaatgctgtttctggatctggaaataatttgcattattagattaagtgaaagaaactcctctcctttttttttatggaacatgtttcgtcagttgaatgttgccatctattcctctggaaagtgttctgatattcatgttacttttatccccacataagacttggtcacagcagctctcgttattgacttaaaatagtagaagtgcaaaattatggaaaaaaagtcagtcattgggaatatgttactagatttaaatcctccactgagaaagagacgtggcatggacagaaagtctacttttggacttcataaaaagttaatatttttagtaagaaagaggggtgaaagggcatctaattggagtttgtaaaaatcaacatttccaacattcccaaacacaagtaggctcagggagcttagaaaccatcactaaggaaaaacgaatattgctttgcaaggagacatacaaaccttcagtgtatgggccaaaatagaattctgctcagaa

SEQ ID NO: 90304 - DNA, 2061 bp, Homo sapiens
acggacagttccttacatttggggactagcatgctggcacttgctttgatttatttggggggtgctaagtaatgtaaagacaacctttgttttagaaaatggggctttgtcattctccttcactctacctcgttttctgaacaaagccggctggagacttacctctagaataaatgttttgagcagaaagacctaagcacattgttctctggctgcccccacatcaggtctgttgtggtcagggggccgcgttgctgctggcggctgctccctgggatagtggcgttttgtgtcctttttcccctagtgggggaggtgggtggagtttcttgtgaatgctgccgattctggtcgccttttattcatttcttcttcttagagtggaaatgtagctggttcataatggattattgattggtctgagaacagcagccgcctccaggcctgtcatcggccgtacttactctcccaatagtgaatgcatcactttatggggctcttcgggaccccagtctggggactataagcctgtaattgttactggtgtacagaatggtttgtagggagaggaactcttcattgttgtgatggaattttcccccatttgttgagagaataggctttttgtctcagtagtaagataagcttgtccaggatgttaatgatgtattttaattcatggttcataatactacagtgtaactagtgaagcccgtctcattgtttcccggagaacaaacacacacagtatactcaaacaccaactgggccttgcacccactcagcacacgcacgggcttctgcgccgaccccgtagtagctgtggccgggaccaaccgtgtctgagagtcgtccttcagaaacgcaccagcgtagttgctcttttagattttatgatttgccttttggagccatcatacgcctttgcagacagccctgtaaatatcggaagcattctgtctgctttgagctttttggcgttttccctccctccccaattcctcccgttcactccagcccctcctgaggaatgccctgtcagcggagatgtgcgcaggaccgggctgtcacccccctgcacccgcggacatccatcccgggctgacatcggtgccccccccgcccccggaaggtggtcagagaggacgcagacggggataagtaaagccacatggcgtcgggggagccagggctgtttcgggaccgcgataaggttaattcatgaaccagaactgaaaaaaatgccaagctagataggcatttggaaagcagcacccacttcagctttgcttccctcccctgacacatgctgcttgtggggacttggtgcaggaaacgggactttcagttttcctctcgctcctttgttcctccctggtgtctcccagtcagctttgcttggtttccgcaactttaagcgttcgattgttgaggaaatgactctaaatacgagagcatatttggttagccttccggtgcctttttcgggataaggttttaataaggtcaacttcggtagttgtagggaaatcagtacacaaccattcagcttttgttttgtactggtttaattcacaggcagaaaatggcaagatttcctgtcgattcagagacatagttattattttaaaatgtaagatgttttacagtttttccctgataacgccatatttaactggtcagaacattattgttgaaaataaggaagaggaaacctgcaccgcgttgctgattttttacttcgtcaagtgctgggaaggatagttaggaatgccagaatacactcagaatgccagaatacactgaattttggctgatgttcgggagagttcgtgttggccacagaaggctttgcaactggagcccgtgggtgggtttctttaatggctttgggcaagcctctaaaacatcagaaagcgatcttttaaaataaaacactgcttttcaattgaaccaggttcctattattcagacgatttttctttgactttctttggaaaacttgagttaactaaaggtagtttcccaacctgcatttattacagccctggagcttctgtg

SEQ ID NO: 90305 - DNA, 1591 bp, Homo sapiens
acagagtaagaccctgtctcaaaaagaaagccccccccccccccacacaaaaacaaccaacaacccagtgttaggacaattacatcttctttgtgagttctactttaccctttatgattataagatagctacttttttttttttttggagatggagtctcaccctgttgctcaggctggagtgcagtggtgcaatctcagctcactgcaagctccgcctcctgggttcacgccgtcctcttgcctcagcttcccaagtagctgggactacaggcgcccaccaccaagcctggataattttttgtatttttagtagagacagggtttcaccgtgttagctaggatggtctccatctcctgacctcgtgatccgcccaccttggcctcccaaagtgctgtgattacaggcgtgagccaccgcacccagccaactacttttgtttaattgccttttttgaccacacattaaacttttaatggtatattttttccatgttgcttttgtttgtacttttctgatatatttttctctacgtgtccagcttttccgagttcctcagtcataggtgttttttttttttttttttttttttgcagagagcaaatagtcaatttaatttttaaccctatcatggagtctttttttaaataagtgagtttattccattaatatttatttctgaaactgacttacttggtcttctttcctaattaaagaaaaaaaaaacttttgtgcttcctcgctttttcttcttttctctttattggaatatgaattatatttcttgtcctttaattattaaaatcagaaagcatatagaaagcatataatgcttttgcttccactagtggcggtatttataatgttttcttaaagctgtattaatgtatcaacatcagtagtaatacaatttgacttcccctttgggaaagaagttagaacacttctattaccttcctcttctttccccatctcctccctctccccacattgctattgtcattccttttttggctgttgttttttagtctattagtgttaatttttaatttttacatgacatagtttttatttcaagacaggtaaggatcgcatgtttattttatgtgtagatcacagttatttggatgtaattctatttatatttatttccttgcttactggatttagtgatcattgccggattttattattgctttttctgcctgtgaggccttcatttggagccatcctgtttgaccggatgacctttccaggttgctcttaaaggactctggtgaggacactcgtccttatggaggagctagcctgagctaggtgagaatccaagcagcagaaaagtgggtcagagcccaggagagctaaggaaatttcatattgctgaagccagaggtgcatacacctgtgtgttcatgcgtgtgagcgcacgtgtcgcaagtgcatatgtgtgtaagtgtgcctgagtgtacgtgtatatacacacatacatgcatatgtgaatatacacacgtgtaagtgcgcctgtgtataggtgcacgtttgcaagtgtgcccgtgtagtgagcctatgcaaatgcacacacacatgtgca

SEQ ID NO: 90306 - DNA, 1013 bp, Homo sapiens
ttctcagaaggaagagtgaagtaactcaaagcaaaccaaactcctttaagaagatgcttcttaaagcatcttcttaaaggagatgagaattaaatgcagtgtaatgagtttgcattccttcgtttcagcaggtttttttgtgttgtttgtgtcttattcccatgctattgggaattacagtgagataaaaaggaaccctttacagtgggtcattttgtgagtgcttgagaatgtgtggggtggtttggaagccaagtggaagggaaaatgtaggggatttaaagtataaaattgcaagagaatcacattttgttggtgtatttaaaagtgccacaaagaaagcacaaaaacctgaccttgtttttccccggacagaacgaatctcgccttttgtcccatgtgtctcaagactgctgtccaactcagttttgtcacattttcaaggctaaggcagagttaaattgcttcctcattgtggggctgggtcccgttcttggaggtgacacttcaggttacctgttactcctgcttatggatctgatgttcagagcagcaagtttattactttcacggagggtcagttttcgtgcttgctatattagtcactgaaatgcttcttttgataggtcagatgatattgaaacaaactagaattctgtttcctgtctgacttgtggaattgcagtatcagtgttcagaaaacttaccagacttttgaacgtaagatcgactagcattcaagtagaattacaaagtccaaacgatatgactcagctgggataaaaagtgctgttttatcttttttctgttccagtgactcagcaaaaacagtgctttggacatacggaaatgtaggcaaacgaatatttctgcataaagggaaaatgtagacctttacttttaggacgactgtttgttagtggaccagcccaaaattcttttcagagttttgcaaatccacctgagtctccacaagtgcaatttcatctgtgggttcttctcttgaaagtgat

SEQ ID NO: 90307 - DNA, 1135 bp, Homo sapiens
agattaatcatttcaaagcttttcatgtctttagcatgaccattagcataatgatgataatttgtccctttgagtaacaccaagcataatttaaattaacgttattgtgttgagtgcagtgcaaccccaggtgctcaagtagcttccttttttcaaaaatggctttttactttttaaaatgagaggcaagcaagacgatctcattcctaaaaccaacttaaaaaataaaagtgttaataaataagtgaattcctaatgtaaaagtgcttgccgtagcaacgtaaacttggggacaattctgtagagtcatgcgattagtggtttagtggtaggattaaaattagcctcggtaaattaccctggtgacagaaaagcagaatctgttaatggtttcacaggaagattggcttatcagttattttctaggttgatgaaagattatgggctgctaagaatttgaactttagaaagtaaggttgattttcctaatatttacatattttaaagtataggtattgattaaaaagaaagttattacagttagaatttgggattttatatgtgtgtgggagatgatttacaaaccaggttttttgcttagctgtgaacattaagggggccgtcgagagtgtgtgttttaggcaatccttaaatcccgtccaggggaatagtagaccattttggaaagcattttacatgttttggacccacgaaaactccatttagattcctacaaggtggtaggtgatgaaactgcaccttcttggcccgagcggggttagggcggccgccattttagagcacggtgttatatcgttaggagtgttacattgacttggtgtaatgaccgtgaaggaaagcatttgctttcgtgattgtttatgtttctttgtaaacttacattatttgtatttgggcttgttttagaaggttaatatagacaatcatatatgtgttataactgcaggaaacttggaggtgatttttgagtgaatcctgacattttacaggtactgaaatgcagaaagatttaataactgagccaaggccacaggaatggtgcagagctcaaatccaggcgtcctgattcccagcttagcctttttctccatacgctgtgctgaatgcacagaat

SEQ ID NO: 90308 - DNA, 2750 bp, Homo sapiens
ccctccccctcaaaagttctagaagctgtgggaaaagttcagttgtctatctactgaacgtagtccaaggaatacccgtgggtttgttcactgctcggggagctggacgtgtgccgctctgacttcctttgcacatccttgcttccctgaatttgcatttattgcctaactagcatcccgcaaaaaggcctttcctggctgcctgcgaattggcaccttggagcttcacttccagcattgttaatggctaaacgtgaagaactaattttattactgtatttagctcacagggccttggaagcggcccctactctgttgttgggagctgcatctcatttagagttgcatttttcaagtgaattgtagtgtcaggctgtgcatccgttgtggggtctgagtgggtgatggttggaatacatctccccgtgtatgagaggcaccgagggatgtggaggttctcggaggcagatggaggtgggggctgtggacaagcctctgtttgtgcagcagtgattatttggttgttcgactgtttggttaggttccccttgggctggtcgctaactggtggcatgagctgacagtgtagctgttcccttcttctccctcccctcctgggggctctcatcctcagtccttccacctgactggccgaaagtgtagtggcagcagcctattacgggaatgtatctaggggccatagaggagacagcatttttcaaattcaagctctggcctcagttttctctggtcccaggaaccagtgagtttgggagtggggcaggacattctctttgatagaggaatgacctctgccctcagttaagaccaccctcccacccaccattggatgagaactatcagaatcgttcgattttcaggaattttgaaaaggcacaaacctattgtaagaaaagaatcatgtcaaatgtttacatttatgaataattaataaaattaaccttatgggaggaggaggaagaaagaacaacttttactatgactttagaatgtctcctgttctttaaaaagtatctttattttaaaattaatttttctaactgaagaatattttaggggaatgacttaaatagctataaggaaggatatatttataggggctataaatgcatcatttgtatttgaaatttctagcatccactacagtgtacgaagtgtattttagatggactggtaaaaaccagcagttgcaactgtctgttttgcattccttatgctctgcatctggccacacgtgacttgaacagctgaagcttctctttccaaagctagagccatcatcgtatttatgtctagcctgagatgttttccgatggtatacattcgaattgtaaagcagtgtaatttgtggctctcaacatgccttaaaagtcatttccaaaaaagatctggcatttaatctttaattcaaatggtactgaaaattacaaagcaggagtaattagaaatgcaactatttttagaaagcaaacatgtaaatatatgttaagtgatgactaaaacacaagcaggagagtaggaaaaattatttaaaagacaactatagtaggtttagatacatcttaccatatactgtattttaactctgtgttaattctggtagatttacttcgtattcctgtttctgtaccttccccccgaaccttggtcaggaagtaagtaaagtctatagaatctcagaatttactgggccgagaagagatgtatatcgtatgtaattgtgaaatccagacagttcctcaactgagtggtgaaaatgggatgaaatcttagtgtgttttgttatcttcaaggcagagggaatctggtgtttttttttttttttccttcaaaaccaggtagacaacgtctctcaccgccctggggagttgctggtgctggctcagcctccaggatacagctgtcctgttattttcttgcttttttaggagatggtgtgcgtagaggaagatgtggtgttagttttcaggacacagttaaagacaggcttaaaaaatcaaggttctctattaaaactataatttcttgttaatggctaagaattaaaaatttttcagcgctattaacacttgaagaactctctaatcccccactcttcccatgtgaaagtaaaggacatttgtttaggaatttttttgtttcagaaaagggcaacatgtgtctgtctttgccatatggtactatttaacctatattgcatgagctgacaagacactgtgtttgggcattgatttattttagcattcgagaatgttctttgaaatttagtacagtaaatgatgcattgaaagttgtacagaatggtcgtttgtggctttagcagattctttctcagttgatacttaagggtgtagtgaacaagtttcactttttttccaccgatacaatttttgtgagaaatagtttgccattcaatgctgagtgactgttaattcaggaaaacacagacttgaatataagtagttaagacttctgggggtcacaaataaggctaagagttgggcaggtcagaaagagaagattcactgtttagttcctgattattctggtgattttaacctagagcaaaaaagtatgtttattattattattatttttgtcaaaaagactcagcttttgtccccatcttttttttttttttttaaagaaatgagttaatgaacaaatggacaatcctatttaatagttcccctgagcttctgtggtgcggccctggaattatctacagg

SEQ ID NO: 90309 - DNA, 1051 bp, Homo sapiens
ctgcgcggggctccgggccggggcaggcgggggtccgcgcggcggcgtggaccgggctccgggggccgaggcgcggcggagcccaggtaattggtttctattttaaacttcactttgttctggcggaggtggggcggtgggaaaggcgtggccccgaggacgattacataagtgttcacacctgaaccggtcctgcgcccgcgagcggatttggggtgggagttggcggtgggcacccgggcttggggcgcctcgcgaggggctgctgcgtgggggttttgtgttctgcgtgtgtgacctcacagtgtctccgcggtaaagaggccggggatggctctgtggactgcctggaaaagcccagatgtgcccgtgggcgttgggctggccttccaggggtgtcccctgcgtaacaaaggacggagccctcggaccctccggtccgctcgtcgtgtgacttaaccagcaagtcacaaaaggaactttagtggggatcctacttacacatacagcagaaaggcattgcccccgtcagcctgccatgcagtttcgaatcttgattgaaggtaatttaaaagctgagtgatgtacgttcaccatggggctatggagtaaatactattaaagaaaatgacccgagtagatgcaacggtggctagcctcccaaaaggagcttttccagcttattttaaaaaccaccttattaatatgattgaagtattttggtttagggatgtgttacttaaaagagctaggcatgcatgttatttgataggatactggctactgccgtgtaaaataaaaagagctcattttatcatttgttccagcttcattttcacttgcattctttgattatgtcgtcaggtaactgttatttatatttacacagaccagccagaattaaatatgccacataccactattgtgcatgggtctgagaacccctcgcccccccttagtaaaattggagagtgaagttgcgtaggagcctgccgtggtgtcaggggtttgagagttgggttacttgtaggaggacgtctttaatttcaca

SEQ ID NO: 90310 - DNA, 1076 bp, Homo sapiens
gaagaaactggagggggagtgtgatttttcagggagtgaattgtgacgtcaggtctttttggaaaagatgttatttttaaggtctgaaacccggctaggtaaagtgcttacaggaaaaacagattacaagattaacatctgttaacatgatcgtttatctccagccaaaaataggtcagttctttcttaaggaaacacgattgctggcgcatgcttaaataataaaatcaaaacggcgagttcataaattaggaacgagtgtttgttacaatctgacctgtgaagaaacgtttttgaatttcgagatcaatggaaggtcaaagtcccttttcggtgtagagagcaactctttcccctgcgtcggcccccgcccccccccccgccccccgcggaatgacccctccttctttctcggagctccctttccgcctccactcccttcgtgaatttccctttccatcctttgtggaagtacaaaatatatttaaatggatatcgtctgacgcctccctccttaaagaaggcaaactctgcgcagatggctaactttcagagctctgctgttgttttaccattaaatgaaacggtagggaggagaggaggaaaaaaaaaaaaggaaacagctttgcgaagtctccctgccccctgggcgtgagtgacggctctgctggccaatccgcagcggctttctccatcccggaggtaatttggggtgtgtgtgtgagcgcgcgcgtgcgcgtgcatgagcccatgtgtctgcacactgtgaagtctggccagccccgcgcatccgcaggcttctgcatttacacagatgtgtgatgtagacgtggacacgcttttattcgagtcagttcggctacatgggcacgcagcagcccccacggagcgcctccccctccgaacgttctgtgaagcatggggtttagaagcactttcagattcaggtcggaacctgcagaagggggagaaaagaggagggctgtgattgtttctcagcaactggggactcgaaacgtgcggtttctctggccttggtgcctgggcacgcgcgccctggtgcgtttttggttcag

SEQ ID NO: 90311 - DNA, 1097 bp, Homo sapiens
ttgtggcctaacgcatggcctatttctgccaatgtctcgcatgtgtgttcacaaacacgtgcactctcttaggtctggagttcttcttatctctaatagctccggcatattaatcatattgtttggatctttgacatccatgctgagcttttgtcttcttgctctgtccatttttgaaaaagatgtactaacgtctccaactacaattactgatttaactatttctccctgccgtactgttgcccgtggctcagtgtgtgttgaggctgtcactgatgttcatgaaggacatcacttccagctctcaggctgccttcatcagtctgtaatatcatcctttggcctcatggtattttttagccttatattctcttttgtccgatattaagattactacaccaactttctttaggttcatagttgcttaatataaactttcattctttttctttttaacttttttttttcattttgtcttccatgtgtttctttaatattcttgtttttaactccaggttgacggtatctgtcttttagtcggtggatttaacctatttatgcttatatttactcatatttaaaaaacttacttctggtagcttattatatttttaacttactgaacttctcatttcttcctttttgtttttgttcctgattttaattgtatagatcaagttttcttctgctggtttagaagttgtttttatacttgttatccttatcttaagatatagtctcatgtttacttatccctactgacttcttgaacttattaatatctgcatttttctcctaagaggaaaagtactttatcatattgtcatctgcctttaatattttgatactgcccagaatttaaattctgggtttgcttgaatagtgaatattaccaaaatatttggttttcattaattctctatctcttatagcaattttcagggatctgtttctctctttttttttttttttttttttttttttttttttttttttttttttgagacagggtcttattctactgcagcccaggctggattgcagtggcacaattaaagctcattgtagtctccacctcccaggctcggttgatcctc

SEQ ID NO: 90312 - DNA, 1044 bp, Homo sapiens
tcatttacgtattgggtccctcatccttcgatatatgtagtcagaattcgtggctgttgtccttaattctttcttaaaggcagaaacaataatgtcaattcacttcatgaataatgtaaaagcaatttgccatttatatggcgttacttaatggttcacagactatagtggtggatgcagttgatgttaaagagacttgggtcagaattccatctcagctgcttcctagctctgttaccttgggcatatcccttggcctcttcaccttccatttctgcatccgtaaaatggacatattcataccgatttggcaagattcctgctgggggttggtgatcgagatcatctgtgtgcaacctcctaacaggatctccagggcgtctggtcctgtgcagagctcacatctctgtgggcttcttgtcttgcctctcaaagctagatgttaggtgtcaggaggtgttggcctcctgggagctagaatattgccttccaaattttccaaagctttttaacatattaggaagcctaagatatgttagccagagtgataggtcaattcactaaccttgaaggcttgaaaaaaaaattgctgattcattttgtttgctgagtacagactttcagtatttttgtgctaaagaagatttatttaacattttatcatttaattaaagaaagcatgtttataatcagtttgtgcctgtcccaaattgtccctttgtcttcccagactttgtcagaaattccctttctcggagcaaaaatgcttttgtgcaggcaacatttcttagatgtttttgtacttagagtttgacttgaggatatttgtggatgggactcagatttcagagtgtgggaggagaagaggtctggccaatgaggaggcggctttgctcgggtcatttgcatctggccgcccaggttccagcagctccatcgcgttggtgaaatatatcctttaggggatgtcacggctttggttaagttttcctttttactccttagctgctagcgcagttttaatgatagctgtttcacatgtgc

SEQ ID NO: 90313 - DNA, 1044 bp, Homo sapiens
gatctgccaggaggagccgtgcggctgcccagctcatccccaccctccaagagcccacagacgcgcagcatgggggccctgccaggaggagccgtggggctgcccagctcatccccaccctccaagagcccacgtgcctctgcgcatcagccacagtctgagctgggcacagaatcgactcgtggcctcttcagtttcctcagtggctctttctcgaccccgcttcttagagccagggtggcaactgagagcaatggcgaaacaggtgaaaatggggagaaagggcagccagcgctgagatccacacccactgggagcctcccctgctctccaggtcctgataattcagatgacaaagcactcagccagtcagctctaatcctgtagctgcactgactctctgtttgtgactttaaaatgaaagcgatcctgtgtgtattgataacaccagtgagccactttcagattctgaatcaaaattgtcagctgtttctcatcagactgtcgatggcacctgccggtgatgacactggtcagggggcagccgcaacctgggtgagaacaagctcctgggggatcctcacgtgcagcccgggatggggaccactaccatatgggaaaacaaagctcgattagtgcatattcgactttacttacattttgatttattgtatttataattatagagacagttatctgctccttgggaagtagattgaaggagagagaagtagaaaaatagttacgcacaatctcattacccagatatgcccactgttgatattttgtcatatttcctcctgtgtttttattactggttttttttaaagcataattgaaatcatacagtatatatgatttcggaaacttgaaaaaatttaacaacataaaaatttcctcatgcattaaacaattttgtaaacacaaaatgtaaacaccattttaaatagctgcataaaactgaaatataggcatggaccacactttgaattttttcctcttaaattatgatgttaataatattaatattggctccttcttact

SEQ ID NO: 90314 - DNA, 1035 bp, Homo sapiens
tactgagtgatttaagaaacaatgtggattattgatgaaatcttaaagtgatttggaggtgaaatgcgtcagtggtttgtagtgactttgaaacactatacagtaggttcacatggtttaagaagcatcattatggcttttgtgtgttttggtgtgtgtggctgtgaagcctcaggaatttagtttaagcttctgaaaagcccaccaatatgtatttagaattctgttgtcccatatcttagtcatctcaatgtttctcatttctaactttaaaacatgtcaattaaaaaaattcagtatatcattaatttcgtctaaaatgtcacataaatctctgacataatttggtttttaaacaataaccaataatttggttttatttatgtgatgagaataacaactggtatttattgtctatacttatgcaattttatagatggagttttaacattgaatgcggagaacactaattatgcctatcaagttccaaacttccataaatgtgaaatctgtctactatcttttccaaaagaatcccagtttcaacgccacatgagggatcacgagcgaaatgacaaggtatgtattttcaaaggtgatgtcaggaatgtgagcgttgaaactggaggtattgtaaaaatgaacaagtaaaatcaaaacttttaatttaggttcctaaatagtagaacattttatattctacaaataaatattttggcctttttaaaagttgtagttgtattcctagctattatttgataaggcgagagagtgagagcttgtcctggtgaatttgtatattgaagttacttatttgtggacaaataattgtttaaaaaatatgactttttaaaagtagtttcaatttcctgtatgactgaacacagaagtggtgtgttttgaagtatttttctccagtggggagttttatctttaagtgatcttgcatttaaaaatggtattctagatgttttaggttgtgtttcaggagggagcaaatattacatactatcttaaatagaaatttgcactctt

SEQ ID NO: 90315 - DNA, 1009 bp, Homo sapiens
acacttatactcactgaaagaaaacagcttatatacagcatttcttattagaaatatttcttttgtgtatgtatgtgttttcatccttataatcctttcagtaattctgtcaggtgctttactgtgtttattttggatttattgacttaagagccagaggagacttcagaagtttctgtagattgtctgtacattatggtacttgttaatattttcatttattgaacaagcatctgtgaaaagattgtatttcagtggcttcttcacttttctctccaaatagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagaggtaatcatcatcattttgcatatactttgttaactgattgttaaaatacatctgatcatgagtcaggaggattttagatataaacttgttttgaaagccttttgtgtagatttcaaggagtgaattgtcattagatttgccttgacaccagttgactgataagacattttattttctggccctgtcaatgccttagggtagagacattttaatgtgtagtatatttgaaggatcaaagtatatccacattggctggcagaggctcctcctggcgcctcaccctcctctttgtaaacagaaactaacatttatacgattctgccatggccaaaagtaacttttctgctttgaagatggtagaatctccttgcttgctcctgggtcctctgactgtgagaatctgagggaagagaatcatttcatgatggcccaaagcagcttatacaccaaagtgaccactcctgggagctccacaggcccaatgtctgggacagctttgaggatgacaggccacagtgctgggttgggggctgaatctaaggtgccaatggctattgctta

SEQ ID NO: 90316 - DNA, 1051 bp, Homo sapiens
ttacaatcattcgtacattgattttggagttttctcttccacgtggttcttcacttcatctttgatctttaaccacagcaaccgtggaaacttagcttcacaaagacatgatgttattgaaactgaagtacctcaatctagtttctgggtgttattggtcaagtgtggagcaccgctgtttcccttgaacatgtgacctattcctgggcctcctcataagcttgttatggtgcactgcagtgcctcagttcatgggctggggctgaggccttagagcccacatttctctgggaaatggaaacattactctgtcttcaccaaaaacatggggtggcctgaggcatctagagatctgcatggggtgcctattttgggaaatgagagcagagcctgagtggggcacatctgtgggtagccctgggagctgagagcccatctggttgtggagtctgggctgggcgggggtatggtctgctttccaccgctcagccgctgggaggagtggagatggtggtttgcctggaggtgggggcttctgaagcatgtgctgtggaataacaaaggagtcagggccatgggaatgttggcgggagagctgaaatgttgagccgtgtggtctaggcagagaggtgaaacttgaggggtgtgcgtgaaccctctgttaggatgacacaggtaaaggtggttgaagatgtctgtgcatgccacatgttctgggtggcccaacccgaggacgacatgaagggcaaagattacctctaaggctacacccatctacaggggtcaccagcacagtgagctttaccgttttccattctgaagttccttcagatgtgccttttaatacttcactgtgatttcctccatcactggaaagagaaacaactgttagctgtcattcgcagatgttctaaagtatttataccttattttgaaaaccttcccttcgtcctgttttctcttccacagatgggccaggttctttccagatcacttcccacagtggtgctcacattctttgctgtttgcttcagtccctgcctctgctgtt

SEQ ID NO: 90317 - DNA, 1042 bp, Homo sapiens
gtcttcttaaatatacttaggaactaaattaactttttagtttaaggtgttccgtttttaagttttactttcagaacactgaaatctaatttttagttactgctctattgagatttatagtctaaaattcacactggtcactactctgtccaaataaatctcaaacccagaagagtaaaccagaaaaattactgtagtttttaaatcacttaggaatttttcttaaaagtcacataattattgaaggtcacattattttttgagtaaatcacttcccttaaggggtgttacagaatgtttggagaaacaacacatgcatgcccacacacactcaacacaaacaactttcccacggaagacattgttcacatttattgatcatctcagtggcacgtacaaatgaatagtgatggatcaggttctgtaagtgttgagggaagagcagcgttttgtggggtgggtttggggtttattttgtgtgttgagcagtagccgaggtcagcagaggcacactgcattaggaaaagaagcatggcttctgagaaggccaggacaggagacaggatgatgatgggggggatcctggaggggattcggagaaggggaaaatcccaaacactcggagtctggtgaacacacgctgccatccgagggccggggttggacaggagagcagccttgatgcagtcagtacctagcattgcacgctctggtcttttagagatgatcgtatcttcagcaaggtggagacagatgaaaatgccatgcatttctcttgatgatttcccatggccacttagcatcatgagaattaccccaggacagcctctgcctctaggtgagagatgtgatgttaactctgtatggagggtgcagtaagtggaaggcccgttgtcctagtggcctgtgactatacatggggtgttgttcttcttacagaagaacacttcctcaagtgttgccagggcgcgcagggggagggaggagcatcgtggctctttttggcttgcaggagagaaagcagaaagacagtgatgtagcc

SEQ ID NO: 90318 - DNA, 1199 bp, Homo sapiens
ggacggcgcaacattcaaatgatttattcatctatacattaaaaaaaaaatcacaaacttttattttttttccataagtgaactttacttgaaaagaacaggcttttccgaagttgtatctatttatgttgacagaggtggaaaaagcgttttattctttcttgaggttctggtttatgatttggagacagtcatgggtgttgacaattctgagagcgttcatactgcctggccttctctcgtgggtgtgtgggcagcacctgcacgtgtgggagaggaggggggcaggagcgcagagcccccagctttctagtccaccgtgacttcacactaactcttcactcctcctgtctctctgttacttgtttaaccttcctcctgtaccttcatggggaagagctggccaggggtatgaggaatctcagggtgtcgttctacagccgatacctgaaagttaaacccagtgtaactcaaaagccttaaaatagggattcccaagactatttagagacaaccaaagttgtgtgaggtaagatttctgaaagtcaaataaattttaattccctttaatttagaaatgtaaatgcttatattattttgggtgggagcaagatgtcatatcatcagaaaggacgttacagcctcaaagggttggaagcctcacttataagtgatgacttggaattgtagattcttatttcttggagtggaattagaattctataggtaaagcttttgactgattttggtaggcagagttgggccatcgttaccttctaaccttttagttttgttctgtcttagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggtaattttcctaaactttaaagtttggacatttgggatagcatattgctggtttttaagaaatgtgcccttcttttttcctctgaaggtgataggatatgtttgttgaatgttttgtagctagctgtagttggttggtatttaaaattaaaaagaatgacagccat

SEQ ID NO: 90319 - DNA, 1045 bp, Homo sapiens
ctactgtccatattttacaatgtaagactttgtcctaaaaatactaaatgttctttttttacttaaaatgctcttataacatgccttaatatctataatatgcactgtatacaaacaagggaaaataatttacaatatccattaaattataagcatggcctaataaattgaaggttcaaatcagtattggaaataataacattttatgttagcatttgctgttgagatgtaatttctggaaataattctaaaatgtgatttcatttttattaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatattccagtccctgatattcctttgcaggaaccaatcctcataactgacttaggtaagatggattgtagggcgtctttataatttattgagtactattttctttgacattttgtgaattgtgtacacacattatggtctctgtagttaaatagttttttaggcatagtattaatgaagtctgtgttaagccttgttttgctttatggactagtatgttttacagtcaagattaaaatctaagttgtatccaaactactgctcaaattgttttctcggattagagacaaataatgtgtaagtgaaaacagtagcgtgtaagtcctcattgaagaaacattgctacctcagtggaaccatcaaaagtgagaaggggtttttatgtgaaacacacagtgcacgttgttgttttcatctttaggttctttgtactgtgttacagattatttgggctactttaatctttggattaaaaaggaaaagaaaaatctgcctgcttttctttttaggttcagtgttactataaccaacccaaactatgattttgttgatgatctagaaagaaaacactgcttgttagaatctttagaaaaattatatttgttagtactagaacaaaattt

SEQ ID NO: 90320 - DNA, 1559 bp, Homo sapiens
attatgagactaatttacattcttcattgttggttataagcagaattcaacagacaagaacaaatggactttcacacatttacctgaagccctgtgattcttttctgatgggttaatatttgtaactagataaacagatccctgagcttgtttatatgactgtcctgtgtgcagtttttctgttgtttcattaggctccctgtatttatctcttttgtgtaatgcagtgaactttttgtggatatggagggcccggcatcacttatctttgtgcccccaggcctagggcacggcctctcatgcagcaggtgcccagtgacgtccacgatgacttggtgcacgctgcttcatcatttccttggttttggagttcagcgtaggccacgtggataaggactagaaatggaagtctctggataaataccttttggtgcctctttctccattctgaagtagaggtgtgatttctgaggaacccagggcggcgttgggatagcaggttgcactagtccctcggtggatcctagtgtgcaccatcctgtaaaaattagcatttgttcctggacagtagaggggaaaagccagccaggaagtttttcagctcccagaggctcttggagggtggagcctatgctcatggtgctccgagccttcgtggcctttgatatacccagtaatcatgaaaagagcctaaggaactaggtacatgacactaggcacacagccctttgaccctagcatagaactttcctttgcatattctcccagtgtgatgcctacctgtgctggcattgtggttgcccctgtttggcagaagagaagatagagagatgctgagatgttaaagtaccacttgtaaaattaaagaaaagtgacagtaattcagagccgggctgttaagtcataccacccattagcttctgataaatataaatcaactactccaatcaaggttcagaataatgcagtggtttagaaacactgtaaacctcaaaggcttgtgaaaatgctaaattcaaattgtaaacaatacactgttaaatttacaatactgcagcaattgcctgtgacgtccgtaacatcttataggtgaaagggattctcattaaagtacttccatccactgattcaacatatttacatccatagtgacagctgagtggggtgggggtgagtgtcgcgactgccatcgcctctgttgattcttggctgggcttttcacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtg

SEQ ID NO: 90321 - DNA, 1922 bp, Homo sapiens
atgctgccagcattaataacattacgttgcaggtatgacaccttccatggtctcctgtgctgtaattctcttggcatcacagagaagcatgaagttttcattacaagtacctgtgctgcttttcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtggtaagagccactcacttttgcttattttgacagctggagtttcagtttcttgcttgtgattacatatttgaatttaggatgttatgatgtcattttcttctctttgtagaagagaataaatcaaatgtcctgagaataaaataagcttttcttacaattaatgatatgtatttaatatatgctcttagattattactaccttcatttaattactcttttcatcctggcttcatttcctcacaaggctttcttcttagacgaaggaattagagatgactgatgctttgttttaaatctttgtcttattgaaatatgtaataacagtttaattaaaatatttttaatataaaaacaggggaaattggttattttgaatctcaactttgttttgctttgtaatgacaatcagggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccggttagtaagttataattttaaacatcttttcaccctgcaatttaagtactgtatatcttactatctcttttcctacaatactctgctgtgcataaagcccgtgctcaatatgtatttataatttatgggagaaattgaagtttagtgaaaataatgtattctaattcagatctggcaccagaaatgaaaaattatagtttctcatgtcacttccagtttgagtacagtcagttatttaattatttcattcattgactcatttttagagaataagttatttttgtttagcaaacagcagaaagcgtagctttgtggttctcactcatgctccatgaaactggtataaactgtttacattagggcattttagatccgcatggcactctctttaccgtatgtcttcagaattctattaggattatataggaaaattgaaacataggagaacattgaaaagtagataaacgggtaggaaataccctttggcagtaaagcccacctaaaactggcaatctaattctctctgccagtcaccaggctgactcattccctgtcttagggctatgctgctcgcattctgacttttctccttgtgtgccttccttggtccttacgtatcattaattcccatagtgtgttcggatctcagtgagcattgaacatattttcctggtgtgctttgctcacgtgactcttaactataaactctttgtattactaagagtcatttgttaattcagcaatttttagagcccttactatgtgcttgatattattctagtaacttccacagatattaactcattcaatattagttcatttaagactcgtaacctgatgatgatgttaacaaagacattttgctaggaatcaaaacacgctccgtggagatctgatgtgacagagggaagcagccccacttccctgaaacacacctgtggagaaggacagcattctagatggact

SEQ ID NO: 90322 - DNA, 1076 bp, Homo sapiens
cttcaccagatactttcgtttctcttagtatcggctgcaaggggagatatttcagttttgttgtcttttctgaagaaaattaagatgtcatgcaggataaatgaatatttaaaggatttatgagatgtattttgacctcctgtcttttagaataagaatcagtcagggtgatgaaagtgagaaaatgagcagagatggtcagatttatcccgtaagctcaggagctagttattcctcagtggatcacacttgcttcctttcttcagctggtctcttcagttgtggatgggtaagctccggaagtagctattcctcagtggatcacacttgcttcctttcttcagctggtctctttggttgtggatggggacaatgcactggaaattcttgtctgagttttcattctacagtagtagctgtgactgagactatggggtcacattttcactctttgtttactggtttttctctgtgtgtgttatacttaagaagcacagtatattcatatgtaaagatgtttaaaaactaagaaaagccttatcctaaaattagaattgaagaccctgtgatttctttggtgcagcttggagacctcgggcatgaatgctgcttcctgcaggtgggagcatcgctctccctatgcccttacacctggacttgtctggccttcccattgatctacttactttgcctcttttgtagaacttaacactacaagcggaagccttccttcaacaacaccgatgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcaggcaagtgctcctcagagagggatgcgaaggtcctttcaaaaagtgatctttgaaaacattattcattgactccttcctaaataaatagtctgagcattttttttccccaaaatcgaagcattttttttctgattaaaaaatacggtaaatataaaaggggataaaaattcagataatgtagaagaa

SEQ ID NO: 90323 - DNA, 1174 bp, Homo sapiens
gcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtg

SEQ ID NO: 90324 - DNA, 1004 bp, Homo sapiens
tggatgggtgaacggatggatgagtggatgggggatggatggatgcatggatggatggatgggtaggtgggtgtgtgtatggatggatggatagatggatggatgggtaaatggactgttatgtggatggatggatgaatggatagagagatagatggatgactggtattacaggaatatgtgagtgaatcctgttttctgtagataagtaatagagtttggagaggaaactaactaaatgatatttatttaaacctaacactctaacttgaaagcaaaatggattcattgcccttcgtgacagaaatgtggtattttttggagaaagctatgagatgctggtatacaacatgaaatatctcaatcccacttcagatttctaattgtttctgcttccagaggagaagccaagtcaaaatgtcctgaataagcagttctctattgtgagaggcctcttgtggaatctgggattgaaacaattctaaatgccccacttctttcatgcatgaattgcaaaaagatgtggcaagttttgtttctaccaagaaaactaaaaacaccttttgtcaaataaatgctccttgcatatttaacttatgcaccagtggccttttaaacagtcaatgtcccatcaaggtgcctgcacatctgggctctccgggagcagccatggcagcacccgggaagaaacgctgatgtggctgctctgcatgctcagatgacttcatcgggaagcctgggtgcattttacgctgggtgccaaatctcgagtaactgaggaattcccagagccttctgaaacacagagctgcaataaggctgctccatccaggttagctccatcctaggccaagggctttatgaggactgcacatattctgtgggttttataggagacagctaggtcaagacccctcagagaaagctgctttgtccggtgctcagctttgcacaggcccgtattcatatctcattgttgtttgcaggagaggcagatgcgaacc

SEQ ID NO: 90325 - DNA, 1019 bp, Homo sapiens
ctgaaatatcagcaagcaaataaactgtgtgtgtgctattataatatttattattcttcttcctgcttacctctgaagagatacagatagccaattagcacatgaaaatatgcgcaatctcattacccagtaaggaaatgcaaagtgagagaatttacctttgagagattccataattctccctaaacattgtatgtcctggtgagaaactgacttgttctatttatctccaaacctacatgtttgagctttgccctaagccctgctcccccacagtggccgtggccatgggtggtactgcccagtgcccgccaggtgccactgcctgcctgggcactgccatctgcccatcagggttaagagctcagcgtccctccaaccttagtgtaccaggtggctgctcttgggtgatgtcctcttctcagagaaatagtcctaggcctgctacccctggtccgaaagaccctttaccagccactctgagcacgttggaaccgtctccttctttctgccaactctgcagccttgaggctggggactcaaagggttggtcgtttgtcagggctggggatgatgtgccctcctgtgggacactcctgctttcaagtctcctctcctgctgggctcagtgatggctgagcgcctgactcatccctgggctcatggagccacagtcttgggagggtgctgggcaggagtgcccagggcacagccaggctcctggagtcccagtgctgagcccgcctggggctcccagctccactgggtcacaggcagggaccagagcacaggattggggcatcctcattggtggagtccacccgaccccaggggcagcccctgccagccaagacaggagagaggagcagagccccagcacagggcacgggatggaactcacctgtcaggaatgtgcccccactctgcggatctgctctctccaactctggagttgctcttcagtccacagctcaagtcctcatgtgacaacttccagagaaatgagttctccaggctcc

SEQ ID NO: 90326 - DNA, 1037 bp, Homo sapiens
aaaatacaaaattagccaggtgtagtggtgaacacctgtaatcccagctactccggaggctgaggcaggagaatcacttgaacccaggaggtggaggttgcagtgagccgagattgcaccactgcactccagcctgggcgacagagcgagactccgtgtcaaaaaaaaaaaaagaagaaaaaaagaccctttaaaaacccgtgaatagtcaataacctggttacagtaagaaaaaccccaaatggagccatgtctgacttgagaatgagcgtaaggcatggtactggtgtggttttatgaaactgtgtttgcatttgggagccagcagcctcccctaaggcgtgagcgtgctttcaggctgctgggcggggtgtccagcagttgcagcgcccgcccgtgggaatttcttgtgaatgttgtgtttgacatgcagaatttcttagtgatatcagagaacaatcttacgaggttcacccttgatagcagcctctcaaacgttttgagtcagtaatgttttgcttctggaggagattcacgaaggaagtctctcgtccatgcttggtggaaagcacacctgaaggtcattctggttttggaggcagggaagtgggcatttggcttcatctgataaacggtgacctttgttaaaatccctttgttaagttggaatgcaatgattaaagatataaggcgtaattagcaaacaagggcagcctctccacaacctttattaaaaataatggggtgatcgtgaagtggtgcctcagggcaatgtaaacccacagggcctccacacacctgcactttgtgcacacgccccacctgcggctctctcctcatgccgccttccctctgctgcagctcccagacccagctccggtcaaccccctcgaggtggcccctgggaccgccgtatgagcctctctccaaccggatccctgatgctcccggagagccggcccagcctcgaccccgggtctggctgagggcgacagggctccaggcacacaatccagcttctgctcagacaacccagg

SEQ ID NO: 90327 - DNA, 1034 bp, Homo sapiens
ggagaagggaaggtgggggactggggagaaggtccttgtgacacaagcatgggaaatctctattctgaaaaaaaaaaaaaaattcacatatgtcataggtttttgccccctgatctataagaagaaggttctcgaacacaaatcacctgtagtgcttctgaaagcaaagagttcagggcccaagaatgtgtgtttctaagaagttctcaggtgctgatggccggtccccacaccgcatcacgctgcctcgtatccgcttctgagaccctcaccactgcacacttctcttattgtattgattaataatttaggaatgtagaatgtcttaggcctactgtcatactttccacatgggacattcaaaatgtaaataactctgttcataactaaaatatattcctagaggcattctcatagctagattcagtcttctaaactttctcaactgtaaaatgggaatgaagcttacagggttattcctgtaattatctaacttaggtttatagaaacatgagggataaagcaaatcattgtaaaataaatcctgttatctccatagaaacattactttaggattgctttcttgaacatggactcaaaaaaaaactgtgcaatcaaaagcatgttatgaaaacaacgtccaaagaatcctaagtctaaaagtaacacaagcgtgatctgtgtcctataatatgggtataccctgcagctctacacaatgcaaatgttttgctaataagcctaaacaaaatgaagtgcggagagcatatgatgaattccacgccatcataaacttgaccttgcattatggcacctgacatgcttgtcagcctaaccctcaacaggcacgatgtttgctccctacatttttgcaggtttgggagtgggagtaagatgatttgggtaaccaagtgccaactatctaggaagactggcattgaggtcttctctatctcacgatgcatttatttctacaagggatttcacaataatcccattgcttgtaaaattgcactcacaattatttcaaaaac

SEQ ID NO: 90328 - DNA, 1050 bp, Homo sapiens
ccttttctttttcttttttttttttttgacagagtcttgctctgtcacccaggctggagtgcagtggtgcaatctcggctcactgcaacctccaccttctggatccaaaacagtctcctgcctcagcctccccagtagctgggactataggggcgcaccaccacacctggctgatttttgcgtttttttgtttgtttttgttttttagtaaagatggggcctcaccatgttggccaggctggtctcaaactcctgacctcaagtgatccacccacctcggcctcccaaagtgctgggattacaggcatgagccaccgcgcctggcctctaattactcttgggataattttaaataagtggccattaagtagtaagacacttctgttggcccattggaacccgtgaaggaagctctggagctgtttaagggaagagtgctcatgccacaggccctaatgccagctgagcagaaatgccaggcgagtagctggaatagtctctacaggagattttaaatctctgtcaaaacctgtagtggacaggcttcatccagagaaacagaagcaggtggagatacacattagagactcatggcaaggaatggcttatgcagaggtgggctggccaggtttgtgggacgtctgtaggacaggccagccagaaggcagctgatctccccggccgactgaagctgccttccacagcaacatctcccacatgccagcaacaaccacgagtgcatgttccaaagctattagtaatgtctcacactcaatagccattaaagcgtaaaaatgtcattccgaatgttcttttgttctggactctgtgaatagcactgcgttggtctgagtcaccattgtgaaaaataggtggatatctaaaagatgaggagaaacagacctatgtgaggccaggatctagaatacagaaacagttctaaaatgtggtaatttgaaacaagccactcaagagtaaaatatgagactaatgagaaaacccagatggactgataaaataagaaaaggactttaaccctctgggaatcag

SEQ ID NO: 90329 - DNA, 1009 bp, Homo sapiens
ggtcctactgtatatgggtgggccctaatacaaggactggtatccttataaggagaggggtttatgaagccacacagacaaggggaaggattccatgagaaggaggaggcaaaaactgagtgatgcaggcacaagccaaggaactgaggggccaccagaacccagaaccacaagaacatggaaacaccagagccaggaaccaccaggaccaggaaccaccagtaaatgaaactactagaatcaggaaacaccaaaacaagggaccatcagaacccagaactatcagaacctagaacaccagaaccaggaatcatcagtacctgacaccaccagaacccggaacccccaaacatagaaacaccagaaccaggaaccaccaggaacaggaaccaccagtaaacgaaactaccagaatcaggaaccaccagaacaaggacaacgaatcatcagaacccagaactatcagcacctggaacatcagagcctggaaccatcagtacctgacaccaccagaacctggaaccatcagtacctggaaccacaagaactagaaaccatcagtacctggcagcaccaaaacgtggaactgccagtaccagaaccagaaccaggaaccatcaacacctggcaccaccagaacctggaactatcagcacatggaacccccagtacctagaaccaccagtacctggaaacgccagtacctggaaccatcagaaccagaaaccatcagtacctggcaccaccagaacctggaatagggaaggaaagattcttcctaaagtctgcagagggagcatggccgtaacgacaccctgattttgaacttctggcctccagaactgtgagagaataaactttatttgttataaggcccaattgtggtaatgtgttacaatatccactacacatcgtaacaacccctaatggttctcctgccccaaccatcacagataaagtttcttttttgttttgtttttctttttgagatggagtctcactctgtcgc

SEQ ID NO: 90330 - DNA, 1682 bp, Homo sapiens
gaggtcagaagggagccagggcttgggcaagtgaaggagcaagacccggacccttcgagctccagaacattctctgcgtggccatgtgggttttacaccttaggagaaaattactcgaaagtttgtcaactgaaagaccgcactcattaatttatatttgttggttttgcttattgtattcaataaaacaagatgtttgcatgtagaaatataaagtgcccagaaaagtccacctgtgttttgttgtccgtaagtcgcgcttgggagcggggtggacctctgtctgctgcgctggaagcggagcagctctgcctccgtgtctaggcacttactcgtgggctgtctccgtgtctcgcgcaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactagccagtgactcgctcatctgccctgcccaggcccacgttttgaagttggagcatcaggcctccgacctttcttgcctcggttctcattacactttcacccatagcagaaaacactttgtgcggctgccgagaggtggtcttgtaagcgctgcatggcgctcccttcaacagcaagcctgactgttctcgagaactctgcaatcttttaaataagcttccttcaaaaaaaaaagtgcttggaaaaccgccttaggaacagaaagagctcagaccatgtccacttcctttctcctgaaacctaataatctctccgagggagaaaggggttctctgcggtattccagtgaaactcatttgatggtttcttttgaattagttagacacttgaacggtgttttttagaactcttcatgttaaagacgtggtttagtactcccaatgctgtgtatcatgacactatcttcgtctgtagtatttatgatgttaagataatgcgggtaacagacaatataatagccccgaccttaaacgaagcttttgtactgcagaatacatctggctgtgtgatttttttttttaagcaagatttgttttactataaataagtggattatttcaatgcaggcaaaattgtgaagttctgttgggaaagatagcatgcttttcgtgtgcaagtacctgtcagtaataagccttttttttttttttttttaatttaaatgtttgtagctgctatgtggacagttgttttctagtgtggtctgtagcccaataactggggaacgagttacagacaaacatcaccgtaaatgactcacaacattataaacagttgtgagaaaatatttcacattatcaaagctgtacaataaaaaggtaatgtttgtataa

SEQ ID NO: 90331 - DNA, 1076 bp, Homo sapiens
tcagatacagacagctacatactgtcgaaagtcacttctagaatgttggttgatgacttaaagttgtgtaacatagagtgtttagatgttgcttggagtgaacattctttgctatagtcatgtttcagaagattggttttttctgactggattaagtgcagtgaggagctgttgagcagcattggttgtgctgtcaggctgcccatccgcaccacagatgcctccaggattatgctcacagcacggttaacagagacttcttcagctagcacaggtctcgttgggcagcttttttaccttagctaacttattcctttgcaaaagaaagcagcctctgcagtcttatttataatgctttccctcagctgaagacagcctaatttgaggaaatattgtccctaaatgaaacacactgtaaagaagactgcttggcctatctcagcactccatttttaccctaactaggtaccagctggaggatgagtctgcgcatttggatgaaatgccactaatgatgtctgaagaaggctttgagaatgaggaaagtgattaccacaccttaccacgagccaggataatgcaaaggaaaagaggactggagtggtttgtctgtgatggctggaagttcctctgtaccaggtttgttatccattgctacctaatttccttatatgctaaggttacttataaggttagcttctaatatacttattagctatattaatataaaaactcaaggagatattccttaaatgatatcatggagattatcagtacattaatcaaagccaaacaatgctaatatgaaaggaaaggaaagccaaattattatcttacgagaagttttaatggttaaaagctggaggccgggtgtggtggctcatgcctgtaatcctagcacttcgggaggctaaggcgggcagatcactttgagctcaggagtttgagaccagcctggacaacatggtgaaaccccatttctactaaaaatacaaaaattagctgggcgagattgtgagctcctgtaatcccagctactagggaggctgaggcaggagaatcacttgaacctggga

SEQ ID NO: 90332 - DNA, 1048 bp, Homo sapiens
tgatttgattatagaggcattttgtgaaaagctactaatcctaaaacattttaagaaaaagtataacttgtacactgctggatatagtttcagctggacttgatgatgtaaggcaatttaaatataagggggaaagtgttcctgaataatcaataatttagaaactatttcgcgtacatagaaatgctattgagtaaagctcctagttactgtctcccaaggacttctgtttgcttctccctcgttgtgcaatatttgccagtatgctttcctcacatttttgtcctcaaaaattccccatatttcattttcctttttagctctactactcagtgaggcttaaacatactgttttcgttacagtgtttatgtatccttggggctcatgccttttactgctagcatggaagtcgcctgactcccctgtatagtggtttctggctgcatgatccaggggcagttctggtgcacctgcaggcctttcacacctcatgcctgttgcgagtgtattcattcagttttgtatagtagcacatgatatgatagtggcgtcttaaccactactttattctgtctgtacacaataaaattattagtagcacagtgatacaaataacataatttatatcatcaaagtctaggcatcttagatttactggtacagggttatagaggaaaaaactgagtaaaatgttgaatatttatgtttttagcagtgggcattgaatttagagtttctcgagtgagagtgatgtcagtgaggcattagttcatgtagttgctgacagtgatggtgacgttaaggtttctgttgtgctgctgtttacagtgctcatgttatgcagacagtggtcttgcgtttatagtgtcgtttgtctggaagaacatgttaatatcagataatgctataaagcttatattttctaaattttatatgtatcttttcaaatacttagatcttaatatttgatttttcattttgaatttgtctgacttttgtatactagaacatcagagtagataattatgtgtcttagagcaaaaattc

SEQ ID NO: 90333 - DNA, 1024 bp, Homo sapiens
gatttgttcacaaaattgatgatcttggccatacttgagtgaagtgtgcacacaagcacacacacgtctgtttaccaagacgagaaaacgtttctctgttttttcttttcatatgattgttcatttccagttccagctgcaatttttagtcctttagcttgaattttcatcctctgttattttgaagtactttatcattttttgacatgtattagctttaattatttttagataattacctcaataagcaactacttcaatattcatataaaagatactgttattccactatatttgcgttttaagattttagagaagtgaaaagccactttttccatttgaataatgcttgacgttgccttctgatgcacctagatgagttctcttgtgtcctgagtatcatattgttcgatctgagaattgatttactttttaaatgattttctttcgttccttggtttggcagcagccacaattgatgctacctttcagataacaaatgatgaatagtatgctttctctgtttatatgcatcttaacctttgattgagcaaacctcttaaaaagttgatgtacaccttaggcttaccttcaaatctgagaagcaagcttaggagagcatattgattcttttaaaaagcttttaaaaacgctgaaaatcaagacaatttgaataattagacaaagttaaggaataattaaacatacactaaatctaaagaaatctctttaaaggaaactatttaaaataatgcaaatttgaaaatatgtataggtgtctcttttttaactgaagaaaatgttcttcaacaagaattcctcataagcccttgagttcttgcattttctataccagtttatattaaccccattatatccagtgccagcaacaccatcatctttatacatacattgacttctttttgccatcttttgttctctaaggttctataatgttctcaagaaaaagatatcagttaacatttccagatttcttctagccaaaatcctgcctctgaggcat

SEQ ID NO: 90334 - DNA, 1034 bp, Homo sapiens
ctgtccagtgccttaaatgttctttggcaaagaggacagcaaataagttatttaagaagctaggacttgataacaatatgatcatttcttcaaaatttagatatgtgtactttgagcagatatataaggcaggtggtcatactattttgttactgtactctgtttagctttctaatactttgttcattgtgtaatagcattttgagaactttttatgctgtatttgatcataaacttttttcgttaaacatgtaattgaaggtaatttccatagaaattaatcgtgatcactatataatgcctgagaattaaaggctattaaatatgttaactctcttaccgtgctacagaataataaatctctcagaaatgttagatcttaattacagagtcagaaaggatatgttttctattcaaaatgttttaaagttatttactgtattatgtgttatgactgtagtgtttctttttctctccttttaagatgtgttgattacagagaatgtgaaaaaaatagaaggaaagaagggtgaattggatagctaggagagagggtgaaattagatgatgaagtaggaactttaggtcagtggggcatctctactgccggatgctttgctgtgaaaagcatagcagtgggggaggaggcctgaagctcctaatgctcataggaattaaagtggacattttattacaattaatgattttaaagctcagttaagatttgtttcacacgtaattctaaagaccattgctattttataatataaataaaaatagcttcagcccttattggcttgtataattgaggcatgtagaaaaaactacaacataatgcatataaaagttttgatatatccaaatctttaggaacagtgtgatactactgaaatacagctgctttaagaggtatttgggaaatacgatcttttaataagttggatatgggtctaaaagtcagtgtaacgagtgtgatgttagtttttgatagctgtcaacataaactgaatgtaaaaggaaggaacattttccct

SEQ ID NO: 90335 - DNA, 1024 bp, Homo sapiens
ttaaaacacaatgaaatatcagtatgcatctatcagaacagctaaaatgaaaaaatggtgacaataccaaatattggaaacaatgtgaagaagcggatcacttgtatattgcttgtggaaatacaaataatacagttatcctggaaaatcgctggatagtttcttaaaaaaaaaaactgtaactatcatactacccaacagttgcactcctggacgtttatcacagagaaatgttaaattatgttgattcaaaaaaacctgtgcaggaatgtctgtatctacattattcacagtagctcaattccagaaagtccatatatcccaggtgggtgactggtcagagaagtagctgtgcgttcacaccgtggcatgtggtgttaggagaacacagggctccttgctcttgtggtgcccctagttttgaggggaagcaaaaagaaacaaaaagtgtccataattatttgaaattatctagtttgtttatgagtactccatagaaaataagacagaataaggacataaagagtctgaatatgacatttttaaaaatacttttaaaggccgggcatgatgattcatacctgtaatcccagcactttgggaggccaaggcgagaggatcacataaaactaggaatttgagacgagcctggacaacatagaccaaaatttaaagaattagccaggcacagtggcatacatctgctgtcctagctacttgggaggcttagggaggaggattgcttgggcccgggaattcaaggctgcagtgagccatgatcattgttgaaacgtattaaagagaccaaagtaaatgtaagacagttcatgcccatggttagaagtatgttattcaaaaggcagtgttccctaaattgatctgtagattcagtgttacccctctcaaaatcccagttgatgtctttgcagaaattgacaggctgattctgaaattcatagggacattgaagtgacccagaatggccaaaacaattttgaaaaagatggacaaactttgaatactc

SEQ ID NO: 90336 - DNA, 1219 bp, Homo sapiens
catgtattgacttatagttttggttttgctttttcttgtgttatttttgttttggtgtcagggtaatactggccttagtggaatgagttaagaagtgttctttcttctatgttttggaagagtttgtgaagaattattattaattctttgttaagcgtttgatagaattcgcccatgaaaccctgtgggactggactttactctgatttttaaaaaattactaattcagtttctttacttgttacaggattattcagattatctatttctttccaagtcagttttggtagtttgtgtctttttcataatttgtccactttatctaggttatctaatccactttatctaggttatctaatctgcggccgtgcagttgtttttaggatttccttacagtcctttttatttctgtcaggttggtagtaatgtaacctcctttgttcctgattttagtaattgaactcttctctctttttttcttggtcagtctagcttaaaggtttgtcaatcttgttgatcttttaaaataaccagcttttggttttaatgatttttctcacttgtttttctgttctttatttcatttattggtttctgtttttattgttttcttccttccacttattttctgttcagtttagtcttctttttgtagtttaaggtggaaagttagattatttacttgagggtcttttttagtacaggtgttcataactacaaatttccatctaagtactgcttttgctgtatttcatgaggtttggccatacatctcaaaattattttctaatttcccttgtgatatcttctttgattcattgcttatttatttttagtttttatttttatttttattttatttttgtagagacagggtcttgctttgttacccaggctggagtgcagtgacatgattatagttcactatgatgatcactgtaactttgaacccctgggctcaagcagttctcttgcctcagcctcccaggtagctagcaatacaggcatacaccaccacacctgggtaatttttaaattttgttgtagagacaggctgtgtctgttgctgtgttgcccaggctggtcttgaccacctggcctcacgtgatcctcccaccttagcctcccaaagcactgggattacaggtgtgagccaccttatctggcctgattcattgtttattaatgaatatgaatttcctcatatttatacattttc

SEQ ID NO: 90337 - DNA, 1337 bp, Homo sapiens
gtatgtgctctgttttattcagctcgtcctctgtttgttcccctttgtttcacaacagtcttctgttattataaataatgctgcaaggagcagccttgtgtgtatgtcattttgtgcttttgctattccatcattagaatagattctgagaagtgggatgatagcacggccaaagagtagtggattttcataatagaatatcttagcatgtttgaaactggataggcctgagagcatatggtaacatttacctgggtcttagcattgtagctgtgcttttatgattgaacattttttatgacggtaaatctggtattttattagcaaaataatactatacactgttggatatttttgtgtatttgttattttgttattatcaaaacatacattgaaagtagaaatgatcaatgcagtttttctaaaatagaaggctgattaatgttaaaccttaataggcaagaacagcaaataggaaataagtgatttaaaaaaatataatggcctacatcttttcatgaaacctgttttgtgaatcaaggaacattgtgtaaaataaaagtttttaaggagttttgttcctgggaatatctagattgttatttctttgtcctactgtgccctggaattattctttgatggcacctgtagctcaggaaaaaccttctgtaacaattcaagagtggtaaatttttattctctacttccaaggttcgtgttttattcgaactgatcaactagatggtgaaactgactggaagctgaaggtggcagtgagctgcacgcaacagctgccggctctgggggtgagcagcaccaagactactccatccttttatcttcaatggtagtttctaggcttcacgtatatttctgtttataccagctaatttatttaatgcattgagaatttgttttataatttctttattcctcatgaaggttcattgaagaattgtgccaaaataatttctgtgatgtcttagcacataatcagttttaggtaattgtgaattttctttgacacttaggttttctttctccttctgctcaccttcctgcccttcctccctgtccttgcccccttccccctcttccgcctcctcctcctcttaatgtccttttcctttttcaatttattttattttttaagtgataggttgtcactctgttgcccagactgaaatacagtaacatgatcatagctcactgcagcctcaaacgcctgggctcaagtgatgctctctccacagtctcctgagtagatgggagtacaggtgcacaccaccacgcccagccagttcttaatttttttttttttgtagagatgggggtct

SEQ ID NO: 90338 - DNA, 1050 bp, Homo sapiens
aatttgtctgaaaaaaaaaaacccaaaaaatccagccaagcaaggatgtcggtacatgtttccattaacatacaattctgtacaagcgatcagcaggtgacagaggttagcagtgcagggataggcgggttgcatgggggcacggggatacttttgtgagtaatgaaaatgttcagtatcttgaggtggtggtggtcacaggcatacacatatatcaaaacaaaatggtacactttaaacgtgcagttattgcatggaaatcacaccttatgaagtagttacagattttcatactgttatctataactttgagtaatgctctttgccatgattataggaagtgacattttattatcttcaatattataaggatactttctttatttttattagtgacagatatatacacatataaattcaaaaatatgtacagaattaaaataaataattcgtacaatgcaactttaacattttcgtggccagtacactttgatacagagtctgattaaggattttagtgacataactatatggtaaatgaaaacattttaatttttgctgttaccacaccaccaaaaagcagtatatcctaggaaaaaaggaagttcaactgaatatctgattcattaatcaattttatattttagcttcacataacttggcatattaggtatagatcttttttctatagagaagaaagctctgatttcattatggatatgggcaaggcaattgagtttttcatgtaatagcttatgcccgtaatcatccctcattctgacattcgtgtctctcgtggtgtagatctgagggtcttctgtgttgtgagctgtttgttgtatcacagttgtgtcacatcagactgtgtccatggtgacagccaggctgagtaaacttagagacctaagaactcatctggaagagctgaggacacagccaagaataacctttgtccattctgttatattctcagagaattaaaatttcagagtcatgtaataataactgtgctgcagagcctgtaatggcaggtgcagtttcttgtggctt

SEQ ID NO: 90339 - DNA, 1069 bp, Homo sapiens
ggtcaaaggacaagtttgattagttaaggatatagcctcttaattgaccttcagtgatagaaccaccattttagtagacagtagtgaaaggccattgtcattatctctattgtcagtgaaaagaatattagtacgtttcctaatgttatatgtgggtacatttgtattgcttaacaaatcatttgactttttcaaagtccatttttaaagttgagattagattttcttgaattagccaaattaaatacactgttggataaatttatataaaatcaaatagtgtgataatactttccatcaaaacaattaattagaaagtgttatcttttactcatctttaaagtatttctacaaggaccactttcatgtttttgcaggtactgtaataggtgttgtcatttataccggaaaagagactcgaagtgtaatgaacacatccaatccaaaaaataaggtaggctagattgaggagcaactgctttaatgaacttatttttcctttcagtaagaaagtctgcatagttctgaatagctcattcttttggcttaacatatatcttaaagtagactttcaaaaatgttggtgacttacaatatgaattctccgtatttatataacaacattctcatactggcgaatttccaaaagtatcattgcttggctaatcagttttatatgtgtcttaaattttcattgtcagatatataatttgcccgtaatttgacagttaattgtggctaatttcttatcttcagtctacttattttacaatttgcactcttttatgttgatggttcattttaaaataaagcaatctgtattaatgtttttatactatttaatttgatgttacagtattaagccagttttatttatttccatgtcagaagaagcatattgaagccaaagattagttttaaagaccgcttgattatatcctgaattgattatatttctaaaattgttatttatgcatccaacatgtgtgtaaaatcataacaaaaagtctgaatcctcagtagttgctatcatcatgataccatatgtgagatgaattcacagtatgtg

SEQ ID NO: 90340 - DNA, 1019 bp, Homo sapiens
cccaggctggagtgcggtggcgcaatctcggctcactgcaaactccgcctcccgagttcacgccattctcctgcctcagcctcccaagtagctgggactacaggcgtccaccgccacgcctggctaattttttgtatttttattagagacagggtttcaccttgttagccaggattgtctcattctcctgacctcgtgatccgcccgcctctgcctcccaaagtgctgggattacaggcgtgagccactgcgccccgccagatttggtatttaaacatccaattaagacataacataacagggaaatgaaatatatacttaaatatttctgagtgttaaatgctagttttacaagaataaaattcaggagaaggttttgagcaagctacactgggcgaaaggtaacatgtaatttatccaggggaagcctcggtattgatacatgttgaatggaagagaattgtgacattggtctctgaacagagacggaaaggtggaaattattgtttattgctggtaagactgttttctgacggtgacatcacagtgttcttctgttgcttagtaaaccaacaaacttttgggcttcaaagaaggctggtgcaaacaaaacggtaaacatgtacaggggaaatctcatctcatcctttacctgagctttgttggatttcttcaggtagcaaaaatgtttctaacactcaattctgacagctctctgagtagaagccatattgggacattgatacattggagttcgtcgtcagcagagaaattgagctgcaaatacatatttttgaatgagtagtggttatcggtcaggataggctgagtcatgctctgataataaagtgcctcatactccgcagtggcttccccagcgttgtgtttctcatgttccaggtccggccaggctggcagctcctgctggtcatgttttcctcatgttctgtatctggcacaggctggcagctcctgcttcttgtcatgttttcctcgtgttccatgtccggcacaggctg

SEQ ID NO: 90341 - DNA, 1361 bp, Homo sapiens
aaaagttatattgatttatattaaaatattacaataaaataacttatttttatcttttcttgtagttgcatacaatcatagaatgccttaatttttctaacagttgctttcttgtaataaaataccgtagagtttaaatacttattttaaaatgtgcccatgtgcttcaccaaagagctacatattgtagaacatattagtagtattgcagtaaatcaacagagatagaaagactcttgggatgctttttttgggataactgttgttaatattcacaaatcatagtgtttcagttcctcatcaggaaaagattaactagaaaacaaacccaccatgacataattctgtagcttctagactagacccagggtggctctttggggtacattagcacagccttcacttgcatacccggcacactttgatatgacagctgctcacaattagaagttgtagttcttcatctgcagtgtgaacataaataaacttataatttcaggaaagtagtaaagaaacaaaatgctaagtgttgaaaaaacaatcctactgatagcatctggggcataatgctctatcagagtgtatagcaaatatctaaactagaaaacttagattttgtccctaaattccttttaaatatgaatttaattagaaaacaggtgctccaaataaaaaatgcaagcatttttattattgtaattgatttctatcacagaaaagacttagttagctttacataaagttctgaataagaagggcttactaattatttgttgcatattaaataagaactatatttgacagtatctcatcatttctaagcggtatagctaaattctctgtaatcaaaattcctaacagagaagtgtaatttattcaagaagcaagtattttcataattgtctttattttttgaactccttgattccttacccctgtgccataaaagctgttagaaatgtatggaccttgtgataatgattgacttatgacatttcctgcaaaactaagcatgtctccctaccagatcatgccccgtgatttctgacgaggcgatctggaatgtctcgtgagactgagaatgggaaagtgctggaacctctgtggggtggaaagcaagtgggcatgtggatggtggttatgtagttgctgaagatggagaagggagagtcggtatcaccttccccaggaggatttctgtgggctgccagactagggagggtctggggttcatggacatgccctgtctcatgcaaatggattccctttgtggctaccatacatcaaaaacaggtcacgtgtgtgctgtgtgttcagaagccaacttcaccagggacaccttcaagccagcagccagctag

SEQ ID NO: 90342 - DNA, 1046 bp, Homo sapiens
ttcagacattggtcagcattttatatatcctcatgtttttaatataattataaataggtgaatatgcatttaattgcaaggggaatgaaatagaatactgattgtagttctgatcagcaaatattttagtcatacgtcttgtcaagacagctaatggctcttgatttaaaaatagtgttgagtagttttacatagtggtaggtgccagatatctggagaatgggatggagatcttccagtggcttataaatccccacatatttacacaataagccaagaaacacagaaggagagtgtgacatgttacttgacagtgacagccttgtgtccttgactaggtcctgtaacatctcttctgtgctgattctgatacacctgtatgtaggttatcaaggtggtggaaacatgctgaagtcagctggaccacagttgagcacttaagcattaaggaattttcctgatcattgtcattttgtggtggtttctaagatactgttagaagaacaattagcaacttcaaatgctatgtttagtgtttcaagtagccttaatgaaaccagactttctggaatctcacataaaaatgtttttcactgatactgtttagtaaattcccttgcacaaaccattaaatatgttatacttgttggcatgccaaagcaagaattcggatgccaacattttgaaattaattactgaagaaatttctcactttactgtagaaactaatctgtatcattacctcttaataaagataatctaagttggaaattaaagttttaattataaaattagtgatcttgtttactaataatcatttaaccattctcttttctaaaattttataagagaaataagcaggtggaaagtagtctccccactaccccccctccgccccctctattctccgcagtttctttaaaaacacagttttcatggccatgttccaggcaggctccatggaaggagggctaggctggtgcctgtctgctgggccacccccctgccctcctgtgcacctacatttgcaaggactcactttgctt

SEQ ID NO: 90343 - DNA, 1082 bp, Homo sapiens
aaacagactgagaaaatgaaaggagatgcgtgctctgtattttaaatcattttaaagaaagccatggtcttccctttcttaccatgtctcttaaagttttatgactcctagtaagagactttcttttacaatatcagtaccacttagagttattattagaatagaatctattttttatatgctttggggcaagaagtatttgagtgtgtgccttgtaaagaagcatgaagcagtcagaactcctgggctcctagggaccctgaggtccagtgacctcccaccccccactgtcaggatctgctcttcttggagttcctgcagagcttgctggcttgtttgtaaaatacaatgagagctttataacccccctaaagtcctgggtattgtgtgtttagatagtaagggttagagaataggttcatgctctttgtaaaatacttgttaaaataaatataaaattacccaaataaactgtgtattagactgaaaaccaaatgccacttctatgaatgatgttgcatgttgaggtttctggtgttagtgggtagcttacgttattgaaggaattattttaaattggtggctggtcttggcaaaaccatttaaaattgatgccttcctacattaagacaaaaaaaacagtaaatctgttcaggatcttgaaatcattaaggaagctgttgttacaatgttatcaacttagtttttagctctgaaacttcgaaaagccttaggagggcaccaccctactgactgaggagggcaccgccctactgactgtgcggagggcaccgccctaatgactgtgcggagggtaccaccctactgactggggagggtaccgccctactgactgaggagggtaccgccctagtgactgtgcggagggcaccgccctactgactgtgcggagggtaccgccctactgactgtgtggaggacaccgccctgctgactgaggagggcaccgccctactgactgaggagggcaccaccctactgactgaggagggtaccaccctactgactgaggagggcaccaccctactgactgcggagggcaccgccctactgtctgtgcg

SEQ ID NO: 90344 - DNA, 1051 bp, Homo sapiens
gagaagagaaagccccatgctggagctccgagatgctgctgtggacgttttacttggctagaaggggatctgctgctgtgaattagagggcagtgtgctttcttgggagaatatagagctgggaatgtgcagtctttgaagagtttctgttgaaaatgagctgctgtctgtgttgctgtattgcaacatggagaagagtttttgtggcaggccaagtgtctcattaattgttacattagaatcaagtcactatttcatataaaactgacactttgtgtttgaagtgtcctcaggagtcttacacagtgaagtggccaagtgagccctgtggcagtgtgcgcaggacagatcacaggaggggccgccccaccccgctgaatgcggcatcccgtctgtgttggtcatggaacccacactcggcacaccagtcccatggctttagggtccttgtcatcgctactgttgtgaaaggccatgaagtatttattaaccgatggtagtgctgactgtcggccacaggaagtgatttaaaacaagcctggttagaaaagaaaacttactattttatgattctgttttataacatagatcactggtgttcatcttatttctcctactagattagcttgtaggtaaaatcttatagttagcttattttcataaccttagagtttagcacaaaatgtagtagacatttcaatttatttgtttaattagttgacttttcttcgcagctgcacttaatggactttctgacaaagttttatttttgcttgataactgcaggttctgatgatctcatgagagtttgtggaaaatattaatcaaaaccagatataaactaaatatatgagttgtgggaaaaggctagctttctattgggcaaagttgcagatttttcaaaaggcactacaaaataaaccaagttatttattagctcagtaattctcaaactttattttttttaatcaggttttttgcagtcatgttttctttgtgtactccttttcaaaagttgttccagattcaggagaaattgagatggcagata

SEQ ID NO: 90345 - DNA, 1007 bp, Homo sapiens
tttagttgctctttccattgttatggtaaccttacaaggatttgtgggtccatggtaccgcaatctttttcggttccttctcctcttttcttacatcattcccataaggtaagtttaaaaatgaaaataaaacaaatgtctggtttcattgagtatgattttattgaatttatctttctcagtatgaaagaaattacccaaacaaagctagagaagtaggagccagaagttctgaggaatcttgaggaattcttctgtggaaatgttgttgggggagacgtcatcagtgccggtagaatgatctagaggtgccatactttcctgatagtgaatgtgttgatggtgtcttcttcaacaatcagaagatatttcctgatgaaacataaaccagaatttcacaaaattagttttgttttttgctgatagacttttaaatgtccagtgccctttgatctgtgtggaatcactggcattttaaagttctgtttaatatatctaatatctgtcaagttagataaaatattaaggctgtgttttagtagggactatcatttcagaatgttaacctatattataactacagattggaatataaatagttcatattagatgcctatttaatgtaaagactaatattttaccatataaacataaatccattttaaactattttctaaaatattttaagaaagatattcttaatatatatgatttaaaattttcataggaatgagcaactgaaacctaatgatggataaagtatgaatctagaatatctaccttttgtaacagagaatggactaaaacggtatagaatgcttaggctcaaggatgtagccactttgaagagaaagatatctctatttctaaaccagctttctccaaaatttgctctaaaaggtgatgtctcttccatttacttacgtcataaagtcagagctataatctgttcttgggatgtgtacacactgcactgccctcacaggcagtcaccaggaatgaatcca

SEQ ID NO: 90346 - DNA, 1049 bp, Homo sapiens
tgcccgtcacagtacagattcctgtggatgctgccttccatggtgttgctggttcacgggtggccaggcctgtgcagagagcacgcagcaaatagcaacttctcattgcggctgtgtaacttgctgctgacatagattttctgcactccataaagctgactgcagagatggctgttccagcctggcttgtggattaaacctaataaggcccagcttccccgctctcctctcccaccacactgcagctatccccatgtgccagctgcttcccaccctagctgtgtcctctgcttcagtgctcctctacctcatcattccatggctgggcttgtcttgtcactcggctcttaccctaaatacctttcctcagagaggctgcgtttgtctgctcagtacagaccaagaaacagccagccacttgctatcatagcagcctattgaattctgtgtagatctctatgacattcatcttgtttgttgcctgtttctctcttctcactaagccctgtgagaatagaggccttgtatgtcccgtttgttgttgtgtcctagttaggacctagaacggagcacgcttgggatgtggtagggcctctgtaagtatttgttgaatggacccattacaaaggccccatcctgctcagaggacccgagcgcagattgtcacagttcttgtgccggcatgtattgagtgccacaggtggactctggagacacaatctttgtcctcaaaataccccccgcccactggctaagtggcaataaacaaactataaccagaaagtaacctgccttttttatctgactgtcatgccagaatttacttcttcagatgtgatggtccttcaggtagttctcatttgttgttcagcctaagcactcactttgatcccaggcccttcacacattgcatcttctctccaccagcttcctccatttgatgccacccactccccaagagtctcctttgtctccatacacatgaatgagccctaatctccattgttgtattgtccagtgtcgtgtgagaagataggttagccatcaag

SEQ ID NO: 90347 - DNA, 1165 bp, Homo sapiens
ttgggattcttctcctgcaagttgcttccagagcctcatagcatgttgttttcgttaccacttgctttgtggattggtacatggtcattttataaatattccatgtgtgctttaaaaatatatatttttttacatgaagttattctataaatatccattagattgatctttaatttttaatatcatgtatgtgctttactgtcttttttttaaaaaactccttaactttttagttactgagagtgtgcaaatctgtcaccataataatgaatttgtctattttcccatgccattttgtgaattctagctagctatatatatatatatatatatatatatatacatacatagtgaggctatgttattagttgcctataggtttagaatagctcttattattctggtgaatgaaaatctcttataaacagcattagctaggtggtagtggtgttttcttaaatcccatgctaccatctttacacttactgtgattaatactttatttgcattaatttatgtcaccttgtttttgctgtttgttttacttctatatttatttttctttcttgcaatctttggagttttttaaattccattttttcttttaacttgaagtgataccctatatttctattattgtggtttccttagaaattttacatatttaatatataatatttagtaaagtttaaagttaagctttatctttactctcctctcaatcaatgctaagaccttaaaatattttaagtcagctcatcttccctctcccatccacttacatgctttatttagtcgacatttgctttcattttgctgtcctgtttggtttatactcagtgtttgcactagacctccgggccgcagccttcttggcattactgcagtagtcaaagggtgcttctagcgaatcatcctacatattcttgatcagtcttttttcaaaaaggataagggcttttagcagggtaaatttcatttacagaagaataaccttaatgattatgtttgaagtaagacttggaaaatacagtgcgtattattcacattcaatcctattgctttttatcttggccgggcgcaggggctcacgcctgtaatcctagtactttcggaggctgaggcaggtggatcacctgaggtcaggagtttgggactagcctgg

SEQ ID NO: 90348 - DNA, 1374 bp, Homo sapiens
acagggtgcacgcagggatgagaaccgttgatgtcaaaagcacaggacactgatttgggaaattaaagttcacattttattaaagccaagtttgttttccttttgcaaattttccgtaaaatatgaataatgatacattctagtatttgctaaatatgcttttggattgaataaagggtaagacttctaaaatatgttttggttttgcacagtatacaaatctgttgtcctaacactcttaaaaggcttttcaaatttaagaaagttaagctgttttataaaaattcctctgtatgaagtaaaatattttgagctacttgatacaatttaccttgtaaatttcagaggaaaatattatagtatttaacgttgacttttgtaattctaaaattcatatatgttccctaaatcctgtgcatctctcataagaaaaggaaaactgatgatcagaattctgtattcatttaaagttctctgaggtcagggacttgcagttacttccctctttattaactctttcgtccgtatgctttgaaatgctatataccattgtagttgataatgcaaaaactgtcttatcagtgctgggtcagagtgtttttactcccacatgaggcatatgtgggtgctagaggcagaatgttgtttgacaaagtgataaaggtgttccttctgagaacactgaagaacctcttgtaaatacagtggctttgttgaaagcactgaaggtgaagggtgtttgtgtggcttagggacagggtttcctctcatttaccaagggtctagcctccaacccagtgagcgtggggatgcttgcctgtgcgcttccagagcagacggaccagggaccccaagtgctctgtgcagtcagcacacccccagatggaagaccaaaagtgtcaggcagcacaggcacagcagtcattgctcctggatttaggagagaacttttctgaaggaaaacttttaagagctttatcaggttacttttcggttaggtaccctttctgtgacattttacaggtttttgctaatttaccaaacatctttagtaagacctcattttccaggtagaatgcttggtgaaaagagtgttttcaacttctttagacctagatttgatattcaggtattgatgatttggaaaatttggagcctatccagatcacataaaatgctaatattgggagattcactgtttggaaagcattcaccaagggtgtgtccaggtggcgttttgctctttgaagagatagattaggggcaggtgttagtccgttctcaccctgctgtgaagatactatactagactgggtaattgatgaacaaaggaggttgaattgactcacagttctgcatggctaaggaggcccc

SEQ ID NO: 90349 - DNA, 1180 bp, Homo sapiens
ggcccataaggggaggaagtaggaatgttaacacccattgtgtgtctgttcatttcagggtgtttgtgatgaatctaagatatctcataggaaatagaacacgtgtgcatctgaagcccggagagaggtctaaactaggcctcgacattttgggtcttgtctccaccatggatcacactggtgggactcacccagggagagtgtttgggcgccggccctgcctccctaatatcccatgaaaaatggaaagatttcacagagtgacaaatgctgggaaaaattcagatcacatggcctctgtgtcctttcagctttacgatctgtaggaaaagatgttaatttcttcggtaaaacttctgattaaatgacttctgtttcgttttgctcagattagaatccaaaaaataagtctgacagaggaacgcatgtgaattatttcaggtagtttcattccctgaggagaatctcgcgcgattctcagacaagttgtgggactgggttcacctggtagtgataaatgctgcaggtttaattataacaaattagagcttaaatgtagcaagcatcgtggtgcctaaataagattgcatggtatattttaggaaaacgcacttcaaatttttcagagtccaagttacctcctcagacacttttgtagctgtggagcagaaggaactttttggacaatagggaggtataattaagagatctgacattccgagatttacgaatgctttcttcctgtagcataaaacaggttcatgtatcttcctactcctaacattgctgaacacagtatttgtttaagataatttatttcatttttcatattgcataaaagtcatgactgccttttgtttcaggtaactgtctgaaatgacaggtacctttttccacttatctggaacaggtctcttggtaacaatttcacagttgctaaattagcaataaaatgagcttaaaatatagctggtattgattactttataatctatttctataattctcaaaatactaggtttaatatatattgagggggggtgacatattatgttacagtatagtactttacagctgagtagagatccaggttttaaaattctataaaattagaacattactaaaaattacacataatgcagcagtgatagctatactctgccaacttagtgtttgaaat

SEQ ID NO: 90350 - DNA, 1038 bp, Homo sapiens
catcctgcagtggctctacttatttttttcatcctgaagatgatctctcaccttttcatgagtagctactgctttatacaatcttccgagagcacttgtattcaacttaccatatttcagtggtaattattatattccatgaaataacttaatattccatgatacaacagctccgcgtaagtctaaccacggaaacggtttcatgagccataggcccctcgtgattgaggagcagcgcccagaagagccatcctggtcctttggcttccaccaccctgagcccagtggccaactgcaagctcttcagaaattcccagctaacagcagaaacccatttgcattatagtagctgaggcaggctgacactcttcaaaacagtatgacacaaatctgaaagaacacagcacatagatagaaagccatgttttccaaagtgcagatatccgagccaaagaatcagagccatgaatagcgtaataggaagtcaaatccccctttcaagcccttttcccctcttctgtacaggaaggcagtcatttcttggccaccttgccccttgcctgcctccttctttcttgagtattgctaacattttagctaagtggtccatgacttccactttctctttctgattcacagagaatctttctccaaagcccaaatcaaagaagagttaatgtaaatgtgttttcttttccttcttcaaacctcccactcaccctaaactcatgtggaacagccctgctatttagtaaccatttgcaggaatgtccttagcttttcctgagcctttcctgcctgtcaaacactcctctgaacatttggcaggcagcagttcacatagtcttcagcacagctgataaaggtttcgtctctagcccatttgttaggaggcactggaggcatacaggtgggtaacttgtaggcgtcagcatggccagccagcactcctcgccagggagctgcagccgtcctgcaccaagaggccaagtggctgctgtgtccggccttgagtgtcatcttgcaggggagctttga

SEQ ID NO: 90351 - DNA, 1039 bp, Homo sapiens
atacgggcacactcacaacagtctgtttttctgtcccatctggtgttacagactgtcttgaaggacagaataggagttacctatttttctgtcacctacaaatattatcttgggtgtaaacatgtttgttgacttaaatgtcagtaaatacatttattttaaagtctaaaatccaatattatgtattttcatataaaatgaaagataatgcatattaaaaaatacgtgtatatggaaccatgagcctgaatgtgtggcctgggtctggatcacattaaccactgcagtgggttttatctggcagtttgggtatgaacttggacatgggtctggatcacactaaccactgcagtgggttttatctggcagtttgggtgtgaacttggacatggctctggatcacactaaccactgcaatgggttttatttggcagtttgcgtgtgaacttggacatgggcaaagcggtgtatggatggatgatgatgaaagatgagaacatccctggcacggtcgttcggaccagcactatcccagaggaacttgggcgcctggtgtatttattgacagacaaaacaggtactgttcgtggtctgtgttcacctttgaatggacaaaatgacatttaataaaaaatagcatagcgtatagatatatgtttatgtgtatgtatatatgtgtatgtattggaacagatcattgaatccatatttagaatttttcagcctctactcttgaaactgtcacacagcttaatcatcttctagtatacacagtatcataagaattatcaaaatgttaagttcttagagctttaagtaacatatttctgtgtttttaattttctacagtcttacagttttttttttaaactacctttgtaacacctccctagtggcttattaagagcaagaattccatgtttgtttattatagaatgatacttgtgagctattagaagaaaataacagatatgttaatttggtatttaatactcaaattctcctaaaaagctttactacagactatttatcccactct

SEQ ID NO: 90352 - DNA, 1034 bp, Homo sapiens
ttttagctttgtacaacattatttaaagaaagctgaaagcagttgtgagtataccatttcattttgttctttaattgactctgcttttagaagtcatgaataaataggagttaaggacatagcaaattagtgccattgttgaagtgaatacagtaaaaataaattgtcagatttttaagtagtatagtgaatattttggtgtatttgacaacctggatatatcgaagtgcttcatagtactaggcttaaaaaaataactcattaatcagtgctttataggagataatcagaatcaaatcaggctacttatttctagctactttgcttgtaaaaatcatatatgttaataattccatgttaactagatagttctctttgctctatctttaattatgtgacgtttcatattctaaagatgcagtctcaagctggtggaaacaatactggttcaactccactaagaaaagcccaatcttcagctcccaaagttaggaaaagtgtcagtagtcgaatccatgaagccgtgaaagccatcgtgctgtgtcacaacgtgacccccgtgtatgagtctcgggccggcgttactgaggagactgagttcgcagaggctgaccaagacttcagtgatgagaatcgcacctaccaggcttccagcccggatgaggtcagtcaaagcacaaaaccgtgggagcttgtccgttccatttggactccagagtcatgaggattcattctttctgggatggggaatatagaggagcagtttatcgtagctttaatgtatgttttagctgtatgtggaaaactgcccaacctattccagcatgtagcctctgacgtagcctgggccttgcacatgcaaatgtgcggccgccacatctcggcacatcccagaacacccagggctggtcacagggaacagcatgagaaataccagcgaggtttactgattccgtaaagtaatttgtgtcaaagctgcattttataaaactgttgaagtttgggactgtccttatggctatggattccgtgtc

SEQ ID NO: 90353 - DNA, 1036 bp, Homo sapiens
aggtcatgagcaaccgctctgtaagaggaagcaagcccccatattcctatcaagaaggggtcgaacacattgttttttctgttatggcattctggaaattctcaaaaatgtcatgtgattatgtattgaaaaagaaggattttcctgccataaatatgagaaacctagactagagatttttcccaaagaaaactgtatttgaagttttaaaaatactgtattacatatttaccatattaccttattccacattttttattcaaagtatctgggattttttatttttaagttttaatataagtcataacactttttgaatcttaaattgggaattcacaatagagatttcattgactccaagattattaaaaatttagagaaactatagacattgctaaccttacagttaaatttttttacttgtctaaaatgtctttctacttgggaaattggacaatgataaaaaatagcagaacattaaataaccttttaaaaatccctaaaacgtattttaaatctgaaaatgaaaacaatagacttcatcataatttttaaagagctctattgatgcaatgtttgcaagtccctaaagcctcaggaaaatcatctaaatggttcattatttagcttattgaactttgctgcagttaggttgacggatgatagtagtgtttcccgatcaccaaagtaccgttttaaaagcattttttatcgaataaagtgcttagaatattgcaccctggagctttatttagggaaatggttcaattgatgttttctatttaacctcagctctgacctatcacaacatctatggttaataagcaacattatcatttgagagacttaactagtttcatccactgtgcacccataccatcctcttaaaaccctgtttgtggcgctgtgtcatctcggtctttaggaaggatgcagtttagtaagtagagtgccctagttttagtcgctgatacacagttgctgttcttcaggaaataagcagtctttgattttcatttttcctgaaggagaaaca

SEQ ID NO: 90354 - DNA, 1034 bp, Homo sapiens
atgggtctctaacaaatgtatttgtcactgagctagctgccgtcagtctccataactgtgtctgttgttggaagataaaccccagtcttgcttggacagcttgattctgaagttgggagttgaaatgacaggttgtctttactggatctgcatatggaccatctggttggctggccatgcagaactcccacccccctccagccctcgttgcttgtagaaccctatcccacttcctcgggatgctgtgggttttacactgggagggagcttacatactaggaaactccgggatgctgtgggttttacgttgggagggagcttacatactaggaaaccttgggatgctgtgggttttatactgggagggagcttacacactaggaaacctccggatgctgtgggttttatgcggggagggagcttacatactttaggaaagtgtgtatattttaatctctcaaacatctttaggaagataatagactcaaacttatcaatcctttacaattttcttttaatttctacatctactgtccctagatgtaagttatttctaagagccttctaaaaagaacaccatgactatatttcagatataccaagagaattcgctaggctgctttcacctagtcaaatccccacacttacgtgctgcagagctgcagagcatgaattaagatatgaaagctcaaaaccaaaaccggagaatctgccgtgtccgtgggaaccagccgttcctttgatgtatcttcaataaggaggaccaggtctgcgtgaagtattgagtacttaggtatgaattcaggagcaaagatgctaaaagtactgcatgtcctcactgaaattatttttcttgtagttatttcatctagcaattttttttttttttttgaggcagagtctcgctctattgcccaggctggagtgcggtggcacgatctcagctcactgcaacctctgcctcccgggttcaagcgattctcctgcctcagccccccaaatagctgggattacaggcatgtgcccaccactcc

SEQ ID NO: 90355 - DNA, 1032 bp, Homo sapiens
cacaccatttagttgtggttggatgtgtgtagcgtgacctgttgaagcctgcgttgccaacacaccatttagttgtggttggatgtgtgtagcgtgaccttgttgaagcctgcgttgccgacacaccatttagttgtggttggatgtgtgtagcgtgacctgttgaagcctgcgttgccgacacaccatttagttgtggttggatgtgtgtagcgtgaccttgttgaagtttgcgttgccgattcttgtgcagccatcaccaccaccccttccagaactgttccatcctcctaaacggaaactgtccatctccccattccccttcccctaaaccctggcacccaccatctagttctttctctgtggattggatggctctagggacctcatggaaatgggatcatacagtatttgtccttttgtgactggcttctttcactcagcgtaatgtcctcaaggttgaaccacaatgcagcctgtatcagaatttccatcctttttaaggctgaataatactccattgtatgtatggaacacattttgctcattcatttatctattgacgggcacctgggttgcttccaccttttggctgttgtgaattatgtgagacatcagaaatgaacgtgtccttgtcttgttgaaattcaccagtttaaattgttccctagatatggatgctaacaggcgataaactcgagacagctacctgcattgccaaaagttcacatctcgtgtctagaacacaagatattcatattttcagacaggtaagtatgtatcttaatcactttgaatttttaaacatttgtctcacacaaacgaagcctattgtttttgtcagaatatatatttattaatcactaaatatctttttaaaaagaactactgtaatttttttaatttataacagcacaccagcatggcacatgtatacgtatgtaactaacctgcacaatgtgcacatgtaccctaaaactttaagtataataataaaaaataaataaataattaattaattaaaaagcatgt

SEQ ID NO: 90356 - DNA, 1032 bp, Homo sapiens
gggacactgttgtcgaccataaggcaaaataacacaggctttgttttccaggtttgtctaaagtactacgagcatgaatttgtggagctggcctgccagtgccctgccgtggtttgctgccgctgctcacccacccagaaggcccgcattgtgacactgctgcagcagcacacagggagacgcacctgcgccatcggtgagagccgcccaccctgctcacagggaggtctccagagaaacccgtaggctgacattgatgggcaaagtttgttccatctctaaaactagattgatttcatctccattcatggaagtttctgaaatagcttctgatggtaaaaatgaaaaacgtgatgatggataaggttttatttcatctcacttttcttgcttcgcaggtgatggaggaaatgatgtcagcatgattcaggcagcagactgtgggattgggattgagggaaaggtaggttcgcccttttatcaacacattagcacacagtcagcacacatcaacacgactcagcacatgctgggccactgtacactcagcacctacttggtcagtgcacgtcagcatgtgcttagcgtacgctcggtcagcaaacactcagcacatgcttggtcaacacacatcagcacgtgctcagcgcacagtcagcacacactcggtacacgctcggtcggcgcacgtcagcacatgctcagcgcacagcacacactcggcacacggtcatcacacgtcagcttgtgcccagcgcacagtcagcacacactcagcacacggtcagcgcacatcagcacgtgctcagcgcacagtcagcacacagcacacactcggtcagcgcacgtcagcatgtgctcagcgcacagtcagcacacacggcacatacgtgcttagtgcacatcagcacatgctcagcacacacttggcacactcgtttagcacactacacatgctcagcacacggtcagtgcacgtcagcacatgctcagcacacttggtacacttgtttagcactactatgcttggca

SEQ ID NO: 90357 - DNA, 1003 bp, Homo sapiens
ttttgttgtcttttttgtagagatgaggttttcctatgttggccaggatggtctcgaactcctgacttcaagtgatccgtctgccttggcctcccaaaagtgctgggattataggcatgagccactgcgcccggcctgcaatctataatgctttggttttgttttttccattaaaagaagaatgaattatgcccggtatgcaggtcaaacaattctgcagtcaagaaaacctgagatttggagctgggcccctgtaaatgcacagtgatgtttccgtggcaagcttagaccgtctggtggcctggccaggtctgtggctgtggccatgagggcccaggacttcttggtcagctcttacctttttctctgtttcctgccaacagatgttgcctttatcaccaccgtgaccttcctgtggaaagtgtcggcgatcaccgtggtcagctgcctcccgctgtatgtcctcaagtacctgaggcgcaagctctctcctcccagctactgcaagctggcctcctaaggggctgtgcacccccagcgggctggccccagcaccttctgcccttcccagcaccttgtgcccttgccagtgaacgcagggtttgccattgctaccaagcaagcaccacaagaaagggagggtacgccaggcgagcccagggcacagatgctgagacagcctctccttctcagtgcagggacgtcacccctgccaggcaagcccagggcacagatgccaggatggcttctccctctcagtgcgaggcttcacccctgccaggcaagcccagggcatagatgctgagacagcctctccctctcagtgcagggacgtcacccctgccaggcaagcccagggcacagaggccgggacggcctctccctctcagtgtgaggcttcacccatgctaggcaagcccagggcacagatgccgggatggcccctccctctcagtgcgggaacgtcacccctgccaggcaagcccagggcacagatgctgcg

SEQ ID NO: 90358 - DNA, 1098 bp, Homo sapiens
ggaactacagcgtcgccgcctgggttgtgtcgccgcggtaggcgctgcgctctgagcgcagcgcaggccccgtaccgaccgcccgcccgccctctgtccgcgatggaggtgccggccgcgggtcgcgttcctgccgagggcgccccgacggcggctgtggccgaggtgcgctgcccggggcccgcgccgctgcgcctgctggagtggagggtggcggcgggcgcggccgtgcgcatcggctcggtgctggccgtgttcgaggccgccgcctccgcgcagtcctccggggcctctcagtcccgtgtagcctccgggggctgcgtgcgccccgcgcggccggaacgcaggctgaggtcggagcgcgcgggcgtggtgcgggagctgtgcgcgcagccgggccaggtggtcgccccagggtgagtgtgctgagccgggcggggccgagggcgggcggctccggggagggatcctggaggacccccgggctgctgcgtccgcggtgggcaggggcgcccctggtgagggagcgataaagcgggacgcaggcactgcgcttctcccctaaaactggatagtcaccacctgtggttttaccaacggggagcattttgagataaaaggaaagggtcctgcgtagcgacacgaagttactgtttggaaaagctatgtttgtttctttctttctgcagtgatagtccccgccccttcctttagctccacctttgtgacttaggaaaactcatgggtggctgtgagcacaagagtcatcaggcaggctccagacctgttattgaaatataaactgttgggtgtgtgcacatctttaaatttttgtaaactttgtgaaacgcagttgtaaaacctggtgcagttctgtttcgtggctaaggaacgggcggaacccaggcctgcagcgaaggcagtagccccgtggttgaccacagtgggcattgtcgcaggctgcttcagggtgacgtgggcgttgtgacagactccacagctctcagtagctgtgctctgaccccagaaggggatatgtttccgtagcaccgaagtgtccagccatgtttgaatctacccttgtgttctgggatgggc

SEQ ID NO: 90359 - DNA, 1017 bp, Homo sapiens
cctgttttctcctgactgaagacgcagatcgctgagtgcctggagcagcccctccctctgggccgctgagcgccccatgctgggggctgctttacctctaatgccaagtgggaggtgcggcagctactttttctgcgttttcatggttgagggcctgtttctgcttctgtgtgactttgcagtttgttttcatgaaggactatggctctgtgtgttcatgagtgtggccacgagctcagtgtttccaccagttttcctgtctgtggagaatgtttccacgtttgccgacagaatcaagtctgtgctaagatagcagcgtgtgtccgttaaaacatcagctagaatcctgtcacttagagcccagtgtgcatctgtgcgcagagactcagctgaaagccctgaacctgtccttgcacttgcaggttgcagagtaagaacgggaagcagcaggtgccgctgtccacggcgaccgtgtccatggtgcacagcgtgccggagttgatggtgagctccgaggtgagccgggcatcagtggcggcgtgttggggaagcgtggtgctctgaggagggcggctgcaggaggagggtggctgcagaagcacggacgtgtggttgtcatcgtcgttactgaaacaacccctcatcacacggatgacttatgggactgcggccttcctgaagcagggacggttgcccttggttctccacagacaagtctgcctgcaaaagcgactcagggccccgaggctgtgtgacctgcgtgtcgggaacaccaggtgctgccgccgcagctgtgaacagccaggctcagcctgggttcccttgagccaagtcctaactggggagggatgtgacagctgctcatggagctcaggaggtggccgcgctgccgaggcatgtgctggatgacccgggagggcaaagcgcatattggggcagataatggcgaggagtcggtggccgggggtaggggcggggggacgtggttggtagcaccttgttggctacaggagcggc

SEQ ID NO: 90360 - DNA, 1131 bp, Homo sapiens
gccccgcgtggagggacaccccgatgcgctgttgccaggcccccgggtctcttcgaggcacaagaataggctgagcgtggaaggttctgagcgcgggagattctgagcgcattgcccttaccagtctctgctgcccagcttgggccacccagcgtctcccagccggccgacttggtttcttcattaattttgcagttcacttttattgagcactccatactgttgaatccagcttttatagaaacaaccagtttcccttccccctccgttttcattggctcatgtatttaactgaattataaaattgtggtcacaagcgaggttgccgtgaccaggttggtgacccagccctgcctctcggcctgtacggcgcagtccatggagcgtggggggctggaggggaacacattgatatagttttgtgtttctcgatgaaatggagttttaccttggatgcaaacatactgactttgtcatttcttgtttctttttaattgtagcaagctgaacagctgggaagagaagaccagcagcgactgcaccgaaaccggaagctggtgctcatggtggacttggaccagacgttgattcacacaaccgagcagcactgtcagcagatgtcgaataaagtgagtgcagtcagcatctacggacagtttcccaggaaccgcgggtcctagaattttgattcagaagtgtgttctcttgttttttagatgatttcccgtaggtcagcctgggtttggaaagcagacttgctagttctgggcgtgggccgtgtgtctgctgggctgttggggagcatccgcggctcccgggcagacatcccgacgcccactgtgtctcacgcttccttccgtgtgtgtgggaaccctttgtgtgcctgcccggcacgatgtcggagaaggcagaaacgtcccgagcctgtgaggatggtgtggtggatggtgcgaggcgtgtcctgagaggggcagtcttggtggggaggacgttggtgttggatgcctttatgttgctaggatgtcaagggcaggtggacgcctgggtttgtgcttgggagaactgggctggaggaaaagcctgggtgggaggtgaccagcgtacattctccaggggaaacacggggaaatg

SEQ ID NO: 90361 - DNA, 1061 bp, Homo sapiens
tgaacggcagcgaggccgccaccccgcgggactcaccccgccccgggaagccagacgagagggacatctggccccctgcccaggcccccaccagcagccaagagctggcaggcgctcctgagccccagggatcctgtgcgcagggtggccgggtggcaccgggacagcggcctgcccagggtgccacgggcactgacctggactttgacttatccagcgacagcgagagcagcagtgagtccgagggcacgaagtcctcctcctccgcctctgatggcgaaagcgaggggaaaagaggccggcagaagccgaaggctgccccagagggagccggggcgctggcacagggcagttccctggagccggggcggcctgcagcaccgagtctccccggagaggccgagcctggcgcgcatgccccggacaaggagcctgagctgggtgggcaggaggagggcgagcgggatggcctctgcggcctgggcaacggctgtgccgacaggaaggaggcggagaccgagtcacagaacagcgagctgtcgggggtcactgcgggtgagtccctggaccagagcatggaggaggaggaggaggaggacacggatgaggatgaccacctcatctacctggaggagatcctggtccgtgtacacactgactactatgccaagtatgaccgctacctcaacaaggagatcgaggaggcgccggacatccgcaagatcgtgccggagctcaagagcaaggtgctggcagacgtggccataattttcagtgggctacacccgacaaacttcccgatagagaagacgcgggagcattaccacgccacggcgctgggagcgaagatcctcactcggctggtgctgagccccgacgcccctgacagggccacgcacctgatcgccgcgcgagctggtgagtgctgcctccctgtgccctgggcatggtcaggcccgcgggctccttgcaggcactccttagagttggcattgctgtttatctcactttcaattttcagaaacatttcccagaatcaccatcttttaagaatagatcat

SEQ ID NO: 90362 - DNA, 1033 bp, Homo sapiens
cctgagccctggtgggctgcagccgagtgagggccctgagccctggtggggtacagctgggtgaaggccctgagtcctggtgggtactgccaggtgagggccctgggccctggtggggtgtagccgggtgggggccctggtggggtgcagccgagtgagggccctgagccctggtggggtacagctgggtgaaggccctgagtcctggagaggtgcagccgagtgagggccttggtggggtgcagccgggtgagggccctggtggggtacagctgggtgagggccctgagccctgcaggggtgcagtcaggtgaaggccctggtgggatgcagccgagtgagggccctgagccctggtggggtacagccaggtgagggccctggtgggtgcagccggatgtgggccctgagcctccagtgctggccggaacagcctgacgcagccgggtctcctgcaggcacagagaaggtgctgcaggcacaggagtgcggacacctgcacgtggtcaaccctgactggctgtggagctgcctggagcgctgggacaaggtggaggagcagctcttcccgctcagggacgatcacaccaaggcacagaggtgggtcctcgctgcacccagcaggtccgtgccaggcgttcccttgctggacagctgttggttcatgcacctgggcagtgcccctcatcacccggacgccccgctcatggccctcgttctcttcctccgacagggagaacagccctgcggcctttcccgaccgggagggtgtgccccccaccgccttgttccacccgatgccggttcttcccaaggcccagcctggccccgaggttcggatctacgactccaacacggggaagctcatcaggacgggcgcccgggggcccccagcaccctccagctccctacccatccgccaggagccctcttccttcaggtacgtggcggcccagccactgtccccagctaatgagggctcttcaagcttgctgctccagtctgttggggggatggcgtcagttgcccgaag

SEQ ID NO: 90363 - DNA, 1023 bp, Homo sapiens
acatcttagcgagcgtccctgtggcacggccacgtctccacccccaggtggctgctctcccagattccaggatgggaaggactgggacgcctccctgaaagccctgccactcaggagtcttgctgtgaatctcattgatcttgaaaatttcaagcaaatattctgattattcaccataaaatccaacagtgcaccaggaataaagtccctgttcacataagggacagaaggaatttaaacccaatctttgcctgcgaaccgactgggtttgctctgtggatttccaagcgtcttttgcccggggctttgttaaggattggttgagtttcaagccccagggctcaggtagaaagcagagtgctacctccagcccccaccctgctgcactcagagccctggactctgccgggagaagcctgttgcggaggaacggggcccgggaaggaggtctgtcgctgactcttggctgtttgtcaggtggacgacatccttggagaaggcagcgacgacagcgacagcgagaagaggaggcctgaggagcaggaggaggagccccagccccggaagccagggacccgcagggagcggacgctcggggcacctgcgtccagcgagaggagcgcggcagggggccgggggcccaggtgagtgcggggtctgaggtgggaggggcctgacacgggctcccggaggtgactctgcagttggtgggccgcctacctgcatctcattcttcacgccctccaccattctgtgtgtgacaccagcagcttccaaactcagcagcccctggtgatggccacttggttgtctccatgctgatccatgtcatcttacatgtgtgcaggcgtgtgaggtgtgtgcaggtgtggggggggatctgtacatctgcgcaggcgtgtgtggggtgtctacacgtgcacaggcgtgtggtgggggtatgcacgtgtgcgcaggcatgtgtgaggtgtctacaggcgtgtgtgaggtatctacacgtgcgcacaggcgtgtgtgggttct

SEQ ID NO: 90364 - DNA, 1050 bp, Homo sapiens
aaaactggaagtccctggtctttaaggaagaagtgaggtccccaaagtccaagagtcacaaaaacccagctggacaggaagctgaaaagaccccaccgccccacccttttgaggggcacacacggcccccagcagtcaggctgctatcgcggccacacgtccacagcgatccgcaaacggcaggcgtggtgcaggcagggagcaagcgccgagtcccacccgtcccggccgtgggtatgagagtcccacccgtcccggccgtgggtatgagagtcccacccgtcccggccgtgggtatgagagtcccacccgtcccggccgtgggtatgagagtcccacccgtcccggccgtgggtatgagagtcccacccgtcccggccgtgggtatgagagtcccacccgtcccggccgtgggtatgagagtcccacccgtcccggccgtgggtatgagagtcccacccgtcccggccgtgggtatgagagtcccacccgtcccggccgtgggtatgagagtcccacccgtcccggccgtgggtatgagagtcccacccgtcccggccgtgggtatgagagtcccacccgtcccggccgtgggtatgagagtcccacccgtcccggccgtgggtatgagagtcccacccgtcctggcggcgggtatgaaggctgcgcagcagaacctgaacagactcccaggacactttattctcctgatctcaaattctgaaatcacccaagcccaccgagtctgtaagacatagagtgaaacggcaattacagtactgatctggtccttgcccgaggagccagaatggagaggcagaaccccaaccacctcctgcagctgggagggcagcatggaagccgcgccagagccgaggggttttctaatcatgctcgtgtggtttcaccagggagggtcagttccgtgcttgcgtggttctctaatcgtgcttgcgtggtttcacccgtgagggtcagttctgccgtgcgcaggtcatttagcaaaaaaaaaaaaaccacaaaaacccaggggtgctaactccagtcctg

SEQ ID NO: 90365 - DNA, 1059 bp, Homo sapiens
aggcggagctcaacgacctcatgtgagcgcgggcagcgggcagggactgaagcctgaccgacctccagcagcactcggacgtccccggaccagccctcagtctcggtccacgctgctttcttcccaaaggacatgtatatttgcagagctccacatacagaaacacattattttgcagaaataggtgtttttaagaagttttactacaggaatgtctacttttgtaagtgacaggtgttaaaggcccaggtgtgctgtgccaaagagctcagcagaggctcacgtggcccaggctggtgcgcccgctgtctcggtaaggggcgggttggtgtgttttccccttgtgtaccagagcacattccttaggggacggctttgggggtcccacgagacatggactaggagtttaagcaggacagtgtgcgtgcacgagctccgagcccagcacagacatgcctggaacccccgccgcctgctgctccctcctagggaacccatttccggggaacgccgtgactgtcgggcagcctggagcttcctgcagcctcctacgcagggtccacgccacgtggcctgggctgccatcctgccgtcctcccactggcatcctggcaagggggcgttgcttttcctgggcggccttttatgtcttggagacacctgatgtaaagtttctgtaaatctatttcatatctgacccaccaaacagatttctctttaataaaaatcctttttgtaagttctcttctcgtgggtgtgtggcagcggtgagcacccgcctcctccctcgctgggatccagctccttagctgtgaaacagaaacgaaaaaattcccacggacaggaccgtgtggaacggcagaaatggaaaccgcagaactgcgagcgtgatgatctcagggtttcgcctctgagcataagaaccaggcttgtagctggtattttaaaacggttaagtgtgaagaattactctcttgcattattttcatccttcccttttgtttgtttgggatgcgggggcccgagagctacaggtaggtgctgggctatggccgccgc

SEQ ID NO: 90366 - DNA, 1049 bp, Homo sapiens
ttaggttaaggcagttcccttttattcgagtttgttgggtgtttttataataaaagagtttgccaaatgcttttcgtgtctgttgagatgatcatgtgggttttattttttattctactatgatgatgtactacattgattgatttttgtgtgttgaaccaaccttgcattcttgggataaatccatgtggtcatggtgtctaacactttttatctgttgctggattttatttgctagtattgtattggggattttttgtatctgtattcgtaagacatgatggtctgtagttttcttgtgatgactttgtctagatttagtattaggataatactggccttatagaataagttgggaaatgttcccctccttttctatctttttagagtttgcaaagggttgacactaatttctctttaaatatttttagagttatccagtgaagccatctgggcttgggcttttctttgtgggaagttttaaaattacgaattcaatctcttgttataagtctattcagattttttgtttctttgtaagtcagttttggtagtttgtattggaatttttccatttcacccaagttatctaatttgttgacatataatttttcttagtattcccttataatcctttgtatttctggaaagtcattagtaatggttcctcttttattcctgactttagtaatttgatcccctcctttcctttctttttttggtcagtctagctaaaaatttgtcaattttttgttctggtcaaataaccaactttttaaaaggtgtttctttttcttttctttctttctttctttctttttttaacacaacacatccacattgcctatcagagaaccaatttttggttttgttcattttctttattgtttttctattctgtgttttatttcactccaatattctttcattccttatgcttgctttggttttaatttactctttttcttaaggtggaggttagaacattgattttttttctttcttcctttttaatgtagttattgacagccataatttctctctaagca

SEQ ID NO: 90367 - DNA, 1048 bp, Homo sapiens
tctcggactccgggcctcaagtgatcctcctgcctcagcctcccatagagttgggattacaggcatgagccactgcgcctgccctcctttgaccttttaatttccccttagaataactgtcctaaataaatacagaaaaatgcaggaaagagcatggtggacaatgcattgcatctttaaaaacacatttagctgcttcctgtattctcctgcatcatggcatacactctcgattttatgcgttcttcagtgatgttaacaagagcttgtcacagtgggaaaaatacggcattgttttcaaggaattcttttttaaagagacttctatgagaatggatgcccttgtttctcgttgcaggaacaagcacatcatgattgacttggggactggcaacaacaacaagattaactgggccatggaggacaagcaggagatggtggacatcatcgagacggtgtaccgcggggcccgcaaaggccgcggcctggtggtgtcccccaaggactactccaccaagtaccgctactgaggcgccctcagtctgcgcggataaatgtcgtggagccctttttgtatggaaacgttttaagctatttaaagcctttggaaaatacaggaagctccagggctggagcacctctgagatggaattgataacatggtcttaactcaccgaaataaacaagcacgtggtgagaggagcaggcctacttgtttgttctcaggaaacttaatgaatagattactgattttcctagtcaaagttaattcttacccttggagtaaaacgaaggtgtttatcctgtgagcctgtgcgttttgcatactgggttggtttgctggggctgcggtgacagcatatgccgcgagctgggctttaacagagatgtgtgctctcacagctttgcaggcgggggtctgagatcagggtgtcgcgggtggggggtcactgctgaggccgtgaggggaatctgctcaggcctgtccctggcttctgggggctgctggtggtattttcagttccttggtgtgtggatacttcgcccc

SEQ ID NO: 90368 - DNA, 1157 bp, Homo sapiens
tgtctctacaaaaaatacaaaaattagccaggtgtgatggtacgtgcctgtagtcccggctgcttgggaggcggagatgggaggatcgcttgagcccaggaggcagaggttgcagtgagccaagatcttgccactgcactccagcctgggcagcagaaccagatcctgtctctggaaaaaagatagcagcagtcacccctaggtgttgggattggaggtgatcttattttctttttatttttctgacttttctaaatctctgataaacttgcaattaaagaaaaaataacagaaaatgtgttatatgcagtattattggaggtactattaatatttgcaagtgttcagacctaattgcggggaaatgatggcaggattctacaggtatattttagagcagttgtgagatgcatgtaactatttgtaaaggttcatacagatgattactagatcagcataaataatatgtctgtggacgttttctgcaggactttgataacttgttacctgagtgaaatttaattcctgggcgattctgggagatggtaaagtgaggcggaaggagccagcggccaattcctgaactattctgggaaacggtggcgtgaggcggaaggagccggtggccaaggtcccagtagtgtcacatgatcttcccgcgtgtttgctgcactgggaaaaaatgttgaagaattagtttgaaaattgccccgttggccaggagtgatggctcactcctataatcccagcactttgggaggctgaggtgggaggatagcttgagcctgggaggtcgaggctgcagtgagctgattgcaccattgcactctaggatgacagagtgagaccctgtctcaaaaaaacaaaacaaaaattgccctgatccacacaaattcttggttttgtttttataaatgtgcttctataaaatgaaagccaaagtgttctgttatttcagtttttttttttaatctccttttaggttaaaaattttgcagttatttatcttgtggatattacagaagtgcctgacttcaacaaaatgtatgagttatacgatccatgtactgtcatgtttttcttcaggtacgttatcttaaagttgttactgaaattgaatattgtcagtttggaagcttaatgtaatcaagatctct

SEQ ID NO: 90369 - DNA, 1032 bp, Homo sapiens
cgtctgttcctattgttccacttcaacaattgctggtattttgctggtcttgtgttacctaacccctcatttttttaggctgtgtgtttcatggaaatcccagatataattatttcacctgtaagttacagtcaggttgtaaagatttagttttatatgaagaaatgttgtgcatatcccattgatttcccgtgactgctgtgagaggatgctgcaagctgaggggcttaaaacaacagaaacttctctcacaattctggataccagaagtccagaatcgaggtgttttccaggctgggctctctctgaaacctgccaaggagagtcctcatgcttctcccagcttctggtgctgccagcagcctcttggagctcctaggcttgtagacgcctctgcagtcctcgatgcccccagagcctcctgtccctgtgtctttatgtggccattttcctctaaggacaccagtcacaccagattaggggcccacctactccagtatgacctcatcttaccttaactgattacgcctgcagtaccgtttccaaataagctgcgctgtcactttgggggtttaggacttcaactgttttggggacacagtttaactcataacacatgtaagtggctacaagcttctaaagggcattgagttagtatttataaagagcctttaaaatgtcatatcctttgttccagaattttaggaatttgtctttaggaaataatgaagtatgtatacaaatttaagggggaaaatgttcacagatgaataatattaatgaacaatcagagagtaacagaagaatggtgtaggaggctcttctcgcattgctataaagaaatacatgagaccgggtaacttatgagaaaagaagtttaattggctcacagttctgcaggctgtacaggaagtgtggtactggcatttgcttctggggaggcctcaggaccttccaatcatggcagaaggcaaaggggaacaggcacgtcgcacggtgaaagctggggcggagtgtcacacacttggaaca

SEQ ID NO: 90370 - DNA, 1076 bp, Homo sapiens
ggacacacacttaaggacagttgaaatgggctcactttggggtattttttttggtcttttaaaatagtctgatttttgtttttgtccaaaaatttggatagctttattaataaacttttaatgcgaatattataatatagttattaaaagggcaaacctaggccaggcgcggtagttcatgtctgtaatcccagcactttgggaggccagcgtaggcgatcacttgagcccagggattcgagaccagcctggacaatatggtgaaaccccttctctactaaaagtacaaatgccgggcgtggtggcacgtgcctgtagtcccagctacttgggaggctgaggtgggagaatcacctgagcccgggaagtcaagactgcagtgagccatgattacaccactgaactccagcctgggcaacaggagtgagactctgtctccaaaaaaaaaaaaagtgcacacctgaaatgcattaaaagaatattcatgttttattttcttcttagtctatgggcaaatatgacttcctaattctggaagcccttttttggagaagctcaacagaaatttttgaaatataaggttttagtataaagaacaatataactatttaaaaatttccctgtgcagaaatggcagataatggggactcttccttaccttgttccgagttctgtctggatattccagctgttttaaagtgagtaacagttgcaaatgttcaggctggacttgatatgatttttcctagatgtgttgtattgatttgctgcttccacagggcccacttgacttcatgctggattagagttgagctgtaaacttcaggaataaagtcagtttggaaacagagctatgcttaaaagatttcacagatgcctagagtttgctaataaatgtggggcaattcatttgataaagtgataataataaataaagttttcatctgggcactgtgtctcacgcctgtggtcccagcattttgggaggccgaggtgggtggttcccttgagcccaggagttcgagaacagcccgggcaacatggtgaaaccttgtctgtacaaaaaatgcaaacat

SEQ ID NO: 90371 - DNA, 1921 bp, Homo sapiens
aaacaagcaccagaaaggaagaaaacgagccgcagtgccgggcattccgggcctttctggacgtccccatccgtggctggaggacagcccgggcggcggcgggcggcctcggggcgggagcgtgggggcagggcacggcgagcccggggcttctcaggaccaccaggccgcctggacgctggggaggaacccccactccgacagctgctatgacggaaccaacggcgctccacggtgcccaggtcgccgccgctccacccggccaactacacgttcgcgcggcgcctatacgcacatgccgtcagcacgcacggcgctagcgcgcgcgcatgccgtcagcacgcacggcgtcggtgcgtgcgcgcccagacgttctgccgggtggcagtcccagcggagtttgcgtgtgcgggcgggaccggatttcgtccgtgggcccgggggcggcgggggccggggagtgaggggccggctgagcccacctcgctgggccctccctggcgccccgccttgggcggcggcgagcgcgcgggccgccatgtcgtacatgctcccgcacctgcacaacggctggcaggtggaccaggccatcctctcggaggaggaccgcgtggtcgtcatccgcttcggccacgactgggatcctacgtgcatgaagatggacgaggtcctgtacagcatcgccgagaaggtagcgcgccggactctcccgctctgcgggctgtgcttccgcatctgccccgcgcctctgccctgccggcgtcgcctgggggcgcgagctgttccccgaggaggggccgcggctccgtcgttcaggcgattcctcccctcgctgcggtcgagcgctctcggggactgtgccggcgtttcacgcctttttctgcggggagctcttgtagtttttcatattttaaagggtttatgatccccctcctctcaaatgaattaattatttctgttgataaggcgtttttcccaaacttatagttcagtgaacaaaatgcacttgcaggttttattgagagcgcggatccttaatttaaaaggacgtctttttttggtacctgagttattcgttgtatgcataaagcaggactttcatgttcatagcatgagaaatcctgcttttctgtgggtgtgtttttttatcccaccacgctttttgtgagtcatgtggtttacagcttacagtgattgaggtgcagtaaacatcaggagaaaatagaaatatgctttgttagaattagttctctgaatttctaatattagtacactgagtggtcttggcatttacttgctgacaataaaagttgtaggacactattttataaccagatttcattctttttctgtggttcctcatagcaattttaggatgacttttattgaggttttgcagctgtagcaatagggcaaagggcacaaatactagggtgttaataaaatatttgccatattaattttccataagtaatttgagaggttattccttttaatgaagagtaaaagtaacattgaagctatcttttctttcacagatgctaaaaagtaggcctgggttaaaataactcctttgagtaaagagtaacagatgtaaggacatattttatattcaggaaaggaaagactatctggcctgccatttattaatttttgctatttcttatttagtaggagaggcatgaagttaggaactgttgttatattttagttattacaagactcccttggagtgcttactagaatgcatctgtgattctgattctatgggtatggggtgaagtccagcaatggctttttaaagaagcccctcagggaattctgatgcgacttgaccttgaaccaccttccatgggggtcagggatggaggtggagtagctttagtaccagccatctcgcagcctcttcctcctggacact

SEQ ID NO: 90372 - DNA, 1204 bp, Homo sapiens
gtcccatcttggggtgatgggagacagtgacagatcatcaggcattagattctcataaggagtgtgcaacctagatcctcgcaggcacagttcacgatagggttcgtgctcctctgagaacctactgcaccacagatatgacaggaggcagagctcaggcagtatcaccagcgaaggggagtggctgtaaatacagaggaagcttcgctcactctcccactgctcaccttctgctgtgcagcccagttcctaacaggccatggacgggtagcagtcctcggttaggaacccctgctctagagcattccatcagaaaaggagggaggcagccgctgctcgacaaagcagaggaggagtgcagtgctctgggaccctgtgctctgggaccctgtgctctgggaccctgtgctctgggattctgtgctctgggaccctgtgctctgggaccctgtgctctgggattctgtgctctgggaccctgtgctctgggaccctgtgctctgggaccctgtgctctgggattctgtgctctgggaccctgtgctctgggattctgtgctctgggaccctgtgctctgggattctgtgctctgggaccctgtgctctgggattctgtgctctgggaccctgtgctctgggaccctgtgctctgggattctgtgctctgggaccctgtgctctgggaccctgtgctctgggactctgtgctctgggaccctgtgctctgggactctatgctctgggactctgtgctctgggaccctgtgctctgggactcactgctctgggactctgtgctctgggaccctgtgctctgggaccctgtgctctgggactcactgctctgggactctgtgctctgggaccctgtgctctgggactctggaatcacacacagcagagtggacccagaactgaggacacagcacagcacacaggcccgactcacaatggcctgactcacaacgggtcaactgtactagagtgtgaaagccatctgcattcagtaatgcccctctcacaagggggtcctgtcagcgtagaggccattgccatcgtaagtggagcagcatctgtgtagttcaaagacgtttccactcaggaatgctaaccaaaagccatggtaggctgcagtgtgttactgggagatactcatgacaatgtccttgtttacacagagtctacatcacaaaacgcctaatt

SEQ ID NO: 90373 - DNA, 1096 bp, Homo sapiens
ccgcgtctccgctgctgcctctcgcagggctgccgcgtcttccgccgagcgcagccgcgtcccgtggggccgcctgcgcccgcccgcgcctccgccccgcgcggcgggacccccgcctcagcgcgcgcccacccccagcgcgactggtcccctcctcccgcgcagccagaaagagaaaatggcgctcgattggcctcaggaagtgacgttggccctcatttgcatgtaggcgcagccagccaatgagagcagagtgtgcttgggggcccctggcacttcccacaggccccccggggcccctgcctaaagctggactggaggctctggggtggcagtggggggcccctgttggaccccctgactcccttctgtcccagggaactgccctgccagctcctttccacatctgtgcaaactctcgtgagagtttgagtgggcaatgacgtcactaaaggggtggggagagtgtgtcatcaaccatgtgactaatcacgtggactcaccacagctttgacttcatttgcatggaatggggtggagctagtggcagctccaggagtggtgaccccgcccacatctcagagccaatgggagcccaactgtgataatgctgccttgccattggaagacaaaactttggctcccagaactgggacaagtgtgccatgattggcatatcctggtgaaccgactagctggggtctcctgacttcatcattcctgtgggaaagtgatcacaccttctcttgagaattctgatttttagatctactacaagttgtgtggggagagggttaattgcatacatttgtataaactcttaacctaaaagttcatttttgcacaggtgtttatcaattgtgtagcaataataatttattccacaaaattagtggaaacatggcgtagggctttcaaaatggctctaggtcttcgttccgtggagtccccaggcctctggcggacgccctcgtgccccagagcacgtgggagtaaccacgagggcagcgcaggcgcctcccccagtgcccctaaccttaaccctaattctgaccctgcacctgaacctcacctagcactaaccctgactctgacc

SEQ ID NO: 90374 - DNA, 1032 bp, Homo sapiens
ataaatggtggagctgatgtaaacccgggcacacaactccagaatcctttttggtgaccatcgttttgtgcgatttcacaggaactaaaaaaaagttctgtggcttaaaaagtattgtttattactgtattacctgaatgacatttttttttttttttttgagacggagttttgccctgtcgcccaggctggagtgcagtggtgtgatctcggctcactgcaacctctgtctcccgggttcaagcgattctcctgcctcagcgtcccgagtaggacccagccaattttttggtaatttttagtagagacagggtttcaccatattggtcaggctggtctccaactcctgacctcaggtgatctgcccgccttagccttccaaagtgctgggattacaggtgtgagccgttgcacccggccaacattttcttttagaatgtatttttttttctataatagaatatccttacgagatcattatactaaaaaatccccagagaagtcctttatgtacccttttgggaaataatattttcttgtgcatatcagtggaattttatggtagttccatgcctaccctaaacattaggaattgagatttattttgaattgaaattgataggttggtgcatgatgtggaaatagttggccgccccagttagcctgctcttttctaatggtgaaaatacagattttactgagctctaagattctatggagaacagtatctatagaggatctataaatatgaaaacattgaactatttcatagttaattcatccactgggcattttacatggaatattttatcttaggattgataaattatgctataagaatggatctaagaatgaataaattgtggtagcttagaatggataaattatgggtaaaagtcagcttcccatccccaaagtggttggcaacagttatgaaacctgtaatttacttgcattttattttttatcctttgttggtttccctaaagcagttaggaaactgctaaacaaaaaaaaaaaggaggggggaac

SEQ ID NO: 90375 - DNA, 1739 bp, Homo sapiens
ctgtaaaagcataaaaattaaaatttttctacttttactaccaccagatgttagtaatcttaatagttactgttttgataataaaaatttgacattttaaatggcatttctttattattaaagttgaataaccaaatatttgccacttgagtttgactgatatatattttagcttttatagcctacacatttaaattttggaatagttggcagatttttaggaaagttacaagtatagtacaaataacttttttccctgaatcacttgagaataagttgccaaaaaagttgccacattaccctaaatactacaaacaagaacattctcctacatatccataacaaaaccatcaaaatcaggaaatcactacattcgagcgggttatagtctatataactatatagattatcactgtataccaaaccaccccaaacttactggagtaagacattttatttaagaagcgcatcagttctctgggtcagttctattcagacagggaagggagatggtttgtttctggtccacagtgtctgggcctcatctgggaagactcaaaggcagggggtgacttgacagctagggctggaatcctcaagaggcatcttcactcccatgctggtagttgatgtggaacacctctacctggtgtctctgtgggctagttggcactttctacacatgtggtatctagattctgggcatgatcatcctgagagaggtatgtggcatttttatgatctagtcttggaattctcatggcattatttcctccatacttgattggtcaaggcagccacaaagttctgcccaaaggtcaggagggggcattagatgctgccacttttgggaggagtgttagggccgtattgtaagagcatgtgggttggaaggtattgtgtgtttggaaaattcactttgccacaggttgtatctgttacttgatatatgcccacattgtctcgtatctggcctatgggagccctttcaagctggttacttctgtgttctgttgacatgcctcattgagcaactgctttatattccggcacaggatgttctaggctcatcttgtctttaccatgctccagccatttttcctagggttctttttaaaggaaagcggtatttaggaattcaggtttgagccctagttgtgcccactgctactggggtgtataactgcatccaggcactctcagtgggcagagctatggaatgtatgtgtgtatgtggacacacactctcaaactatctctattcttctatctgtgtgttgaaaacaatgagttcacttcagtaacccctagtctggtcaagtactacagggtttattttaattttgtgcctttttagatattgttttaaacagcttgagatataatttatgtaccatacaattcaccagtttgaagtgtacagtgaatggctgtgggctcattcacattgcgtatacatcaccacagttgagttcagaacgaagaagccctgcttccatcacttcccagttctcccagccctggcacccactgttgtgctttttttttctggggacggagttttgctcttactggtcagggtggagtgcagtggcgcgacctcggctcactgcaacctctgtctcccagggtcaagcaattctcttgcctcagcctcccgagtagccgagattacaggtgcccagctaattttttgtatttttagtagagatggggcttcaccatgttggccaggctgg

SEQ ID NO: 90376 - DNA, 1050 bp, Homo sapiens
tgtggttttagtggatgacttagaacaggggtcagcaaactatgagttgtgagccaaatcctatatttgtatgaattagcccgtgagccatgagctaggagtggttgttaggcttttaaatgtttaagaaaaaaatgacaatactattttgtgacatgtggaaagtatatgaaattcaaattggtgtttgtaaataaagttttattggaacataaattacaaattattttggggacttttgtacaacaatggcagtgctgagtagttgccacagagactgtactgtatggcccacagtcctaacataatcactctctggcccttcacagaaaaagtttgccaacccctgggttagaaaacattaagtcaggttaaatgcctagcacattagaagaaaagggatcaagtcctcagggactgtggaaggttagcatctgacagtttattcaattatgcttaaggctttcttttcttttaacagagatatcgaacaaagccatactgttgtggcctctgtaaatactctacaaaggtgcttacttcattcaagaatcatttacatcgttaccatgaagatgaaattgaccaagagctggtgatcccttgcccaaactgtgtatttgcatctcagcccaaagttgtgggaaggcacttcagaatgttccatgcacctgtccggaaagtccagaactacacagtgaatattttaggtgaaactaaatcatctaggagcgatgtgataagtttcacatgtctaaaatgtaacttttcaaacactttgtactacagcatgaagaagcatgtgctggtagcccattttcactacttaattaactcctactttggcctaagaactgaggaaatgggtgagcaaccgaaaactaacgatactgtttctatagagaagatcccaccacctgacaaatattactgtaaaaagtgcaacgccaatgccagcagccaggatgcgttaatgtatcacattttgacatcagacatacacagagatttggagaataagcttagatctgtgatttcagaacatattaa

SEQ ID NO: 90377 - DNA, 1053 bp, Homo sapiens
aaagggaaggtctatgatactcaggaataagattattgcccctgagtgtgaaaactaacttaaatttcagcatagggtttcaggggacatggcgaagtttacagactgagatctcagtctccatggttggtacagtaagtctttcaccacattttctgaaggtcatgtttagtggagaaacgggcttttctctagctggtttaggctggaagctgtgtccgggtcgatgggatggcatattgttaaagaatctccattgtcgtcactgtcctgtggatgttaaacctcgtttttttccccacacgatattaaaacttaaagcaccagaaccagtcatggagaccagccagtttagatggtaagtcatatttctggtggtacacagcagaggaaccccttcactctatctttaggtagaaatatttggaggatgtgacagcctctgagaaacataatgttactatgtggattttaaaaaatataatacttgcatgtaattgctataatgttcatatttgaggcagttgtgaaactggtttatgattgttggtgtactctgttgtaaattcaaagagagcttgttgaacattttttttttttacctattgttttcagagtgtctattttgaattaaaatttgttacaccgctgcaaatagaactgtttaattcttttaaaagttaaaacattattgtgaatcatagggataacctctatatgggaatagataccacatttattttctaaaaaaaccttacctgtcatttgtgtgaaaataagaacataacccaaaaggtctaattactggggtcacaaaataggtgtaactacagattcctgatgattctatactggtagcccccaaagtgccaaagaaggtatgtaactggggtgtcagtgctgtgaagtttccttcactgtggctgtgttcagggtgagtgtggaggaggtgctgatgaggaggcagctgccgtctggcgtggttgaatcctcaccttccttttgttgtgtacgttagggtttcccagcctcagcactgctgacattttgggt

SEQ ID NO: 90378 - DNA, 1099 bp, Homo sapiens
gaagtccccagtccagcctgctgcctcccagaaggctgaggcactcgccagccctccaagccctaaaccctccactgccattgattctctctgctgcagctgcctgctagcaccttttaatctctgagttctttggtttggtgcctgtggagctgtaaggagagtgctagagagttaattttaggggctgcacttgagcttgcctgatttcagctcagcctgcaggtctggaatgctcctgtgcaccctgggtgcttcggcgtcacgcagatggaacagcagtgccaggtgtatgacggccgagggctcaggcggggctcggttgtgtgtcccctctaactgtcccctctcccgcagaggaggccgagcgtggcagcctcggcgcgggctcgctgtgcaggcggaggcgggcgctgggcgcgctgcgtgatgaaggaccccggcggcgtgcacacctggacatcggcctcccgcgcgacttccgccccgtatcatccatcatcgatgtggacctggtccccgagacgcaccggcgagtgcggctgcaccggcacggctgcgagaagccgctgggcttctacatccgcgatggcgccagcgtgcgcgtgaccccgcacgggctggagaaggtgcccggcatcttcatctcgcgcatggtacccgggggcctggcggagagcaccgggctgctggctgtgaatgacgaggtcctggaggtgaacggcattgaggtggccgggaagacgctggaccaggtcacggacatgatgatcgccaacagccacaacctcatcgtcaccgtcaagcccgccaaccagcgcaacaacgtggtgcgcggcggccgcgcgttgggcagctcgggaccgccctcggacggcaccgcgggcttcgtgggtccccccgccccgcgcgtcctgcagaacttccaccccgacgaggcggagagcgatgaggacaacgacgtcgtcatcgagggcacactggagcctgcacgtcccccccagaccccgggcgcgcccgcaggcagcctctcccgggtcaatggcgcgggcctggcgcagcggctgcagcgggacctggccctggacggcggcctcca

SEQ ID NO: 90379 - DNA, 1056 bp, Homo sapiens
gtcgggtctcatctgggagatgaaagaacagcctcaacgacggacgggggactcccaggggacgtgcttgaagctgtttttgtccagagggtctgtgcgccaggcagggaggactgtggggccagggtgacctgcctggcctggtgggctcctgacgtggtgtcagttagcgggtaagagaagacatctggagttagctgtcctcgtggtagactcagaagaaaaaggtgttttgcccattggtatttcatgctggccccttgaggagccccaggagcaactgcctagcatcctctgctagaaaggcttactgttgtgtttgtgttggactcagcttatcatccagagatacggtcccacagctgcggtggcgcagtggcccttggttgagttaggaaggaaccattggccagtccgatgaggaccacgttgacgtgccccaggcctctttgttggccttctgtgatctcctttaaaaagaaagaagaaaacggttggtttgatgtgttggcaaaatttggccttgaatgctggccatgggaattgctgaaggaggtctgctctaaatatgggcttttctgccaacggttatttctggttgtttcaattacagttgtgctctctggtaactgctgtagtgttgtataaatacagggtgaatcacaaccaggccatgaagccagatctggggtggaagtgacacgtgggcagcccctagaactgggttctctgccccagagagtgtcaggcaaccccgggctgggcaacgcctaccttgctgcctctgctgggatgagcactactcttcccatgtctgcattcaccccccaggtcactcttgtgttcagatgccccagcaagtccacacctccctcacgaacgtggggaaacggtagggattgcacccgcctgacttccccgcaagcccatctcgtgggcttgtctctcccacatgcctgtcacttgctgtaccccggccatcccaggccagggtgactggccgagagctgcccatcttctgagatgcaggcccctgagaagccgtgtgaactctgc

SEQ ID NO: 90380 - DNA, 1057 bp, Homo sapiens
tagaactaggaacatccagcaaaagactgttttcaaaatatacaattaagtgaaaaaagcatgaagtagaccggtgttggtagtgtgctaccattgtttagaaaagagggaagatagagacaattcacatttgtttgctttcgtatgcataagatatctctagaagggcacattaaaagctaagtctcaagcctgtaatcccagccctttgggaggccaaggcaggcggatcacctgaggtcgggagttcgagaccagcctgaccaacatggaggaacccccgtctctactaaaaatgcaaaattagctgggcgtggtggtacatgcctgtaatcccagctactcaggaggctgaggcaggagaatcgcctgaacccaggaggcggaggttgcggtgagccaagatcacactattgcactccagcctgcgcaacaaagagagaaactccgtctaaaaaaaaaaaaaaaaaaaaaaaaaaaaaaaaaaaactgaagtcattggttacctgtggggagggggctgggtagctggagatttcactaaataccttttgaatattgagctatgtggttatatagccctattcaaaccataaagaaaaatataacagtgtatgatcctaatttttaaaaaccatacatgttaaagaagcctggaagaatgtcttcctacacattacagtggttttctttgtggtggggtgatgtgcagagttagacatccgtgtgtggggccctcgtgagccggcccagagatgactaggtgtgctctgatctccttgtcctctggcagcaccttgggtgtcacactagacctggactttcctctttgtatgtgttgtacatgtgggagggggcatctacattgaaacttgctggtttccccaggatggctactttcccacgcttctccaactacttcaggcaacactgtcttgatttgggtgcaaaagagaaaaagaatgcttttaaaaaacagcaagagtattttgaggaaatgacaaaggacaatagaaatgcagtgtcagaaacatttgcccttcaagtttaattttgc

SEQ ID NO: 90381 - DNA, 1051 bp, Homo sapiens
agaatggcaggccctctgcagggactgtctgtgctcagaggggccacagggtacagtgggtttagccgtcaccctgcacagtctggcatgatgctcgtctgggcagttctgcgagtgccaacggctgcaccatcatcactctggatcttgggtggacagcacctaggcaggcgccaggctccacctcatctgactcataggtgtgtggcccgattttaaaccgtcccaacgtgtcagcccaagaagtcattctatagcaaactactgccgagtcccacgctccaacaggttcctcattaggatgaccgcctgtatttctttaagacctgttgcactctcttttcctacatggagttctttctgtgtttcttagtttcctacagggcacagatgtgcacaggtgctccccggcttgaaggtctgaggcagctcatgtttgccatgcacacgcgtgagatcctttacagctggaatgcgtctgggcttggatggtaggccagcatcgccatcccctcccaacagaccctgctgtaggccaggggctctgacagtctaaggcgagtctcagcccctgccagtgaatggtttagagctgggcatgtgaccccaccctgacagtgagacttgagggtcttcttcctctgaaatggtgacactgtgaccctatgacccacctggatgcgtgggggaatgtgggagacacctgaaggcccccagcacgtcctggagccaactccctgtgtcaacacgtccctggagcatctcagacacacacagtcctgtttgcctggccgcccacactgccctcctcattcctggggctgtccaggctcctttggttgtgccatgggatgaaatgctctctgtcctcacgcttcacccagttatttccactccttattccctgagtttaaattagggcctgtgttttacagtcttcatttgcatctctcagagtttgcaattacatatttgcatgtgtggattactgtctaacttctggctcgagcaaaccatcagctacacgaagacaggtcagttgtgcaacctt

SEQ ID NO: 90382 - DNA, 1123 bp, Homo sapiens
atctgccctggccaggccctgagcaggctccagggactctgccctgaatacggtaggcccctcctggtgccggtgggtggatggggggaaatcaattccagtgtcccacacgtgactgccaaattccacatgaggtttgcataaggaagagggaaaaagagcagacctttccttctgtgagagggatgctggcatggacagtcagcaggggagatgagagtggaggttactcagagctactttggggccccgcacataaattagagatactttggggcctggcacgttggctcacacctgtaatctcagcactttgggaggctgatgctggaggatcgctccagcccaggagtttgtgaccagcctggtcaacatgagacccctgtctctacttttaaaaatttaaaaaaaaaagatattttgggcagagagaagtggctgtgcaaaggtgggtgtttgctgagttagttcaaggagcagaaaggaggctgccaggatgtgaggggcagagcgcctgaggagtttgtgtttgtctgaggggatgcgaaagggagtgttatttgggctgtgaaaaaagctcttccttgctgtctggtgagagtagaggtgggaggcctccaggccaaggcaggtgtgtggggccccaaggcccagctggtgagagaacctcacagctcccaggcttttcttccccaccagcctccctgcccttcgctatcctgacgctggtgaacgccccgtacaagcgaggattttactgcggggatgactccatccggtacccctaccgtccagataccatcacccacgggctcatggctggggtcaccatcacggccaccgtcatccttgtaaggcaggaggggctcagagggactgggtagggggatggggtggggccagctttaccctgggggcctgatgggggggtggcacagccctgccctggaggtctgtgtggggccgggggacacagccttgccctgagtggtacctgtgggtaatagggcccccttcagagtccccagctctccagcagccttggggaggcccgtgcggaggagtgagggcccctgggccgaccgagacccccactggttcctgcggctgctcttgcaggtct

SEQ ID NO: 90383 - DNA, 1020 bp, Homo sapiens
actcggagcccctgtcacagtgagtgccaccccatgcccggagcctccgcaacactccaaccaggtccccccagccctcaggctgagcagaggagggtgggaggcatttgccccaaggacccgaggacagtgtggctccacgagcaggctctcagtgtgtctttaggtttattctttacttgtatgtattttttgactggagaatacattcatgtggtccacattctccacaaatgggagcaggtgccaggctgtcccacccctgctccagccaccagctcccctcagggcaccccgggcccggctgccataggctgtgggggaggcaaggctgggagtctcgagtccagcgctcagcactgggctgtgcaggcacgtggggccgcactgacactctctgcgtctctcttggtctctcccctgcagctgtaacgtgatgacctgctgactcctggccgcgggcggcgtatgcggcccagactggacttagcgctgccgctgggcccgcctctgtcagtcttcctgaccccttccccaccccccgggccttggggtagcacctccttctgcttcagaacacgtcaggactggggtgaggtggctgggccgtgagcccttgcccctgtccacacagaatggacccacggccccacccagcgccgtcagcgcccggcactgccacccgggtccgggccgctgcctgcacgtgggatccgtcgggcagccggggacagaagagaccccgccgttgggacgcagggcagagccggccacctagtcccttccagccagcagaggcgagggaaggcgtcactgccccggcggggagacgggcaggacgccctgccccgcaccagcagcctccgccggggcgccctcagctccctgcttggctctgtctctccacacccggcagggccgcgggctgccccagccctgggggtcgtgggcagctgctactcagtgccaaccccgtggggcacagagccatatacctcgctgtccggcccccaccccagc

SEQ ID NO: 90384 - DNA, 1050 bp, Homo sapiens
gaggtgtaggtggccctgacatcgcccaggagggtggtgtggacggcccctgatgtcactccctggatagaggtgtaggtggccctgacatcgcccaggagggtggtgtggacggcccctgatgccagtccctggatagaggtgtaggtggctctgacatcgcccaggagggtggtgtggacggcccctgatgtcactccctggatagaggtgtaggtggccctgacatcgcccaggagggtggtgtggacggcccctgatgtcactccctggatagaggtgtaggtggccctgacatcgcccaggagggtggtgtggacggcccctgatgtcactccctggatagaggtgtaggtggctctgacatcgcccaggagggtggtgtggacggcccctgatgccactcgctggatggtatagacagttcttgctgtcggctcctgcgctgagcccatggaagagccaacatgtcctctccccaggcgctgtacgagttggtgaaatgcaacttcaatgtggaggaggccctgcgaaggctgcggttcaacgtgaaggtgatccgaggtgagcagcggtctgggccttccttccgctgcggccccgccctgggcactgctgaccgttctccccggcctgggccttccttccgctgcggccccgccctgggcgccgctgaccgttctccccggcctgggccttccttccgctgcggccccgccctgggcgccgctgactgttctccccggcctgggccttccttccgctgcggccccgccctgggcaccactgaccgttctccccggccgtgtttgcagatgggctctgtgcttggagtgaagaggagtgcaggaactttgagcacggcttccgtgtgcatggaaagaactttcacctgatccaggccaacaaggtgcggactccactgccaggctccaccgggggcttctcgatctggggaggggctcagggtccgcaggcacacagcacacggccgactggaggcctggagccccgtgtcctgtgtccgcctcctcaccgtgtgcccattgc

SEQ ID NO: 90385 - DNA, 1046 bp, Homo sapiens
cttggatgaaggactgggcctgaggtctggctggggagtgctgccatgtggggagttgctatgggtgtgacagagtggccctggttgtggccagtgaggctcaggcaagaggacagggacaggaacccccagagccgtccctcctgatggggccttgttcccttccccaactcagagcaacgacatgccctttgatgagctgcttgcgctctatggctacgaggcgtcagaccccatttcagaccgggagagtgagggtggtgacgtggccccgaacctcccagacatgaccctggacaaagtaagtgagggcccttcctggaactggctcacagctgaaggtgggggggcctggcgctgcctctctgcagaggggagtgttcagtgagaggaggcacaaaggcccccagaataagtagaatgtacctgtgaccactaccctggggttggaatggccatgggcatggggctggaccctagccttaaccccaggccacatgtcattctggctttggtgggtggaggggcacatcggggcctccccaggactggtctctctgccattccgtacccagaggtcacaggtcaaggcttgggtgttgggagcaggggcgggctgcattgtagaaggttaaaaccaaatgcacagtcagagaaagagccatgcactccgggcgtgtgcccagtggcagctctaactgtctccagctctggtggctgggtgtgggctcccacgtgtctccttcccatccccgctccccccacgctgtgcaccctttgcagaatgggaatagcagccccatgtgagcctcagggcactcccagtgtctttactgttgttatcattagtggtattgcgagattgttaaactgtaaaatgttctttacttttttttttttttttaaaggaacaaatagcgaaggatttgctttcaggggaagaagaggaagagacgcaatcatctgctgacgacctcaccccgtccgtgacctcccacgaggcctccgacctcttccctaaccggagtggatgtaggtgactctgt

SEQ ID NO: 90386 - DNA, 1033 bp, Homo sapiens
ccgcctccccaagacccgcttccgcctccccggaacccgcttccccctcccccggaacccacttccgcctccccaagaccggcttccgcctccccggaacccgcgtccgcctccctggaacccacttccccgtcccccggaacccgcttccgcctccccaggacccgcttccacctccccggaacccgaatccgcctccccaggacccgcttccgcctccccggaacctgcttccccgtcccccggaacatgcgtctgcctccccggaacccacttccgcctccccaagacccgcttctgcctccccaggacccgcttccgcctccccggaacccgattccgcctccccgggacccgcttccgcctccccggaacccgcttctgtctccccggaacccgcttccgcctccccaagacccgcttccgcctccccgggacccacttccgcctccccaagacccgcttccgcctccccggaacccacttccccctccgccggaacccgcgtctgcctccccggaacccacttccccgtcccccggaacatgcgtctgcctccccggaacccgcttccgtctccccggaacccacttccgcctccccaagacccgcttctgcctccccgggacccacttccgcctccccaagacccgcttccgcctccccaagacccgcttccgcctccccggaacctacttccgcctccccaagaccctcttctgcctccccgggaccggcttccgcctccccaggacccgcttccgcctccccgggacccacttccgcctcccccgggtctgtgcggatgccaggcctggttgggtctgttttccctggtggcatcgggccgccctcgccgtctcccggcggtttgtcctacaagtttaacgccgacggccggcgtgttccacggaggacgcgtgcgcttccttcacaccacatccattgggaccagtcaggtgtggccattggccgtggatgtgggatttagaatgttcagaattcagacgccagggttgttggggctccggat

SEQ ID NO: 90387 - DNA, 1799 bp, Homo sapiens
ctgcccctgcaggcgcgcctcaagttccccatcgactacccatactctccaccagcctttcggttcctgaccaagatgtggcaccctaacatctacgaggtgagcgcggcccccacgggcctcaagtcctcatcctccgggacccagggtgctgggagcctcacgtcctcatccttccgggacccggggcgctgggagcctcacgtcctcgtcctccgggacccggggcgctgggagcctcacgtcctcgtccttccgggacccgaggcgctgggagcctcatgtcctcgtccttccgggacccggggcgctgggagcctcacgtcctcgtcctccacgtcctcatcctccgggacctggggcactgggagcccgtgctgacctctgacctgttctgacctgtcttcttcttgtgcagacgggggacgtgtgtatctccatcctccacccgccggtggacgacccccagagcggggagctgccctcagagaggtggaaccccacgcagaacgtcaggtaagccggcccaaccccctgtgtccacccagaacatcaggtaggccgggctccgtcccgtatccacccagaccatcaggtaggccgggctcccccacaggctgtggcgccaaggcctgattcgggacctgccagctggcggtcctgggcctcgctgtacctgcacggtaggtgctttcacggggcctgcggcaccgtgtgtcggtgcagactcccaccaggaccccaggccggccccaccgtctggaaccacctagaggtgtcccgccatcctcagtcctggggccttctccttacccagccgtctctgggttggtcacctcgtgccacgtgtgccgcctgggcctcgtccccaggtacaagcactgggccgtgttgcccgtgtgtcctggagtgtagtctaggcaggacgtgcgggtgtgagggcagccccgggtctgacggaggggtctgcaccttgctgccctccctggtcttggcgtgggagggaggagactgatgcaggtccagcccctgctgttctgggggcctgagacagaagcagaggccatgaggccaggtgaaggtcacctgctgggtgggtccaggcgtccccgtgaccctcagggccagagaagagccggaaggctggggtgccccgggccgccccactccgacccactctccccacaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggtgagggcgggcgggggcgtcacgggaggagagactcagatccggcctgcaccccggcccctggtcccacggccgcccagccccaccttcctggtgagggtggcggagcttcctggtgcccatttacagggtgccagtcacagatggaggccgggccgagtggcggagggtccagccaggttcaagcccagcttcttgccccttttcctctttttttttgtttgagacagagtctctctctgtcacccaggctggagtgcagtggcgcgatctcggctcactgcaagctccgcctcccgggttcacgccattctcctgcctcagcctcccaagtagctgggactacaggcgcccgtcaccacgcccggctaattttttgtatttttagtagagacggggtttcagcgtgttagccaggatggtctcgatctcctgacctcgtgatccatctgcctcggcctcccaaagtgcaggga

SEQ ID NO: 90388 - DNA, 1031 bp, Homo sapiens
gaggtcgggagtttgagaccagcctggtcaacatggtgaaacctcgtctctactaagaatacgaaaattagccgggcgtggtggtgggcacctgtagtcccactactcgggaggctgaggccggagtatggcgtgaacccgggaggcggagcttgcagtgagccgagatcgcaccaccgcactccagcctgggcgacagagcgagactccatctctgaaaaaaaaaaaaaaaaaaaagtgttactttgtcaggtgtgatgatggtagtgtggcttcatctcgagtcctctttgagaaacactttctaaaatgctcaaggatggagggtggagggtgtgcagcggtgggcggggctgtgaccgtcacctcacctcccccacaggaagcgcgtgtggggaggctcggggccggggccagcacccacactgggtctccacagcggcatggaggcctgcgtgtcttcactgctggtgctggccctgggggccctgtcagtaggtgagtgggagccgggatgcaggggggacactgaggcccagcgctctcggtgggtccctggatgggaggggtgggcgcgggcgccgacatcctgggtgtaagagcggagattcatccttgtttggagggggactgaggcctggggcatcccgagctcctcacgcttcaccccgagtggacatcccgggaccgtgggagagtgtggtgtccaccggctcacctcgcccatcctcccggcagcagccagaaggcaggggtcacgctcacacccgaggtgcagagtaggagactgagacttggcgaaggagatgctgacctaggactgcccagctgggagggcagagctgggactcgatccccgctggctgcctgccaccaccaagggcttggctgggactaggtgcccagcagtgagggagaagggaggtgggtggcggctcccctgcattccagctggactgagtgacaggggctcttgatgagttggggacccaagaagatggacagaggtaggaatccagccgtcagtcatc

SEQ ID NO: 90389 - DNA, 1105 bp, Homo sapiens
atatatatgtacatttttaaaggcagagatgtgcgtctcgccatgttgccgcgtctggtctcgagctcccgggctcaagcgatcttcccgcctcgacctcccaaggctctgggagtacagacgtgagccacagcggccggcccgtgtttaactcagataaaatctgggtaacacactttcaacgcttcaaccccctcgggcgcaccgctctgcgctcattgcaactttgaaagcaggaaggaagaaatgcgcaggctccagccgcgtccccgcaggccccactcccgtttcctagcaacgccgggtcacgtgcgccgccgcccggattccgtagcgtgagcctgccggagccggcgcgtacatgcgagcgtgtgcgcgcgtgcgcaggcggggcgaccggcgtccccggcgctcgccccgcccccgagatgacgccgtgcgtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctggtgaggagcgggtagggggcgggggtgcggtcctgcaggggccgggaatggaggccgcggtgccgacccgaagccgacgggagcctggggcctcggcgcggggcggcctggggtgcgaaaggccggccccgggggcttcccgcgccagcatggagcttgggggtgaagtcccagggtttgaggggggactagaggttcctcccggcgcggcctgccgggctcccccgggcgctccggcctcgagcccggcctctgtgtgtgggcgtgaagctccctgcttggaggcgggagccagggggtcctggccaggccggtcttggtcaggggaggtgggcgtcttgcttttcggtcacctggggttgggggtgacctgcttcctgggtgagggcgtctgcgaaggcggttggaggtggcccgcccgccggtcccatcggccaggagaagggagacccaaagcctgggtgagcgtcccctttggcctggagccaggggtcaggggc

SEQ ID NO: 90390 - DNA, 4080 bp, Homo sapiens
gattacaggcgtgagcctccgcgcccggccaccaccgcgcccagctggctacgtttttagaaaagaatttccagtttgtgctggggctgctacaagagctcgatgccctggtccctgctcagggacgtgggtgggtgccttgtctgtccccacaccctggtcccagcctcgtgtgtctctgggcaggaacatcgccaggcggggcctctgggttcccagcgccttagcccagggcccgccagctgccagcgaagggtgccttcccgaagggggtgccttcccgaaggggcctcctcagcaggcgctgggctcttcccttcccggaggcgtggccagaagttccccttgggcctccggtcctcggggcgtaagggccacggtgtatttttgggatgaaaaccagtccttcccggggaggagccgcaggttcctgggggtcaggcaggcagcgcgggccgtgctcctccactctgctgaccgcgtctcgccgggccttgcagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaagtgagtgcctgaccacgccatgccgccacctgccccttctcacggctctcttgccgccagcggcctgtggtccgtgagaacaaaagaccggtcggcaggcttgatccaggcggaagttagggaccagctccgcgcagacccccagagggaaaccccagggaggggtctgaggggcgtccttgtgaggcagggggctccagcagccctggcaggagtccccattgcttgctcctcactaggtcccgggcacgaaagggcgccacactgccaggtcccgggcacgtgtgcgggcctcccaggctctgtgctcctggcacaagagggcaccacactgaggcatgccctgctcggaccccagacgctgtcatggccggagctttgtcataactggggctgggacggccctgggagcacagagccttttgttttcaggctgactgggaagacggtcacagggtgtggggtgcagagcagggaccagaggtgtggggttcatcagtcggggagaagggggtctgttggttctctcacctgtggggtcttgccagcctggctctgtccttggggccgcacggggaccccaggagttcttttgaggttcagacttgactgggacagttttgctttttcactgtgccgtggttgggcccctggagaaccctgggtccttggaggcgtcctgcagagctggtacgcggctcacctgcctgctgtggttgcagggtggactccgacgaccagtggggagagtactcctgcgtcttcctccccgagcccatgggcacggccaacatccagctccacggtgagtcctgcagccaggggtaccgggcaccaccgactgtcgggagaagttgttggcctgaggcacccggcacatcccagagccctggccccctgctccctggaggggaacagccctcctgcgggaggccggggatgggggcgggcctgcggttccaggctcctctctctcaccctcctgtcagggcctcccagagtgaaggctgtgaagtcgtcagaacacatcaacgagggggagacggccatgctggtctgcaagtcagagtccgtgccacctgtcactgactgggcctggtacaagatcactgactctgaggacaaggtgagaagccaaggaggctgggggtcctggacccagccctcaggactgggtgagaggcctagactgggggtcccggacccagccctcaggactgggtgaggggcctagactgggggtcccggacccagccctcaggactgggtgaggggcctagactgggggtcccggacccagccctccggactgggtgaggggcctagactgggggtcccggacccagccctccggactgggtgaggggcctagactgggggtcccggacccagccctctggactgcagccctccagactgggtgaggggcctagactgggggtcccggacccagccctcaggactgggtgaggggcctagactgggggtcccggacccagccctccggactgggtgaggggcctagactgggggtcccggactcagccctccggactgggtgaggggcctagactgggggtcccggactcagccctcaggactgggtgaggggcctagactgggggtcctggactcagcccttgcctttggtcccctaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatggtgagccgtctgccctcctgcccacatgccctgctctcggggtggcccagggccactcctggtccgtccctgccagccccaccgctgacccagagcttggaactgaggagccccaggcagggagttgatgggaccccgaaagaaagtgtgggatggagggtctagccccgggcagctgcggctcagtgggcagcgggaccccgggaggaggaggcggcacctccgccccacagcctcacccggcccttccctcccgctcacttggctgcaagccagtgtcctccgtggtgagccggcccttgctgctctgcatgatcaggctcgggaacctgaggtcagccatgctgtgctccggcagcccctgcctgcctcctcgcggagcccttctgccccttgggctgcgtgtgccggggcgaggcctgtgtggggcctgtgatggcagctcctggaaaacgctgtggggcaggggtgaggcccacgaggccatggggacagctcaccatggggagcacacctgcaggtggggagggctgcctttccccacagcactcagaagatgcacgtggccggggctgatgagctgccccgagccacccctgggggtcactgagggcagggctggcagcacagatgcccctgctcggggcctgagtggggccagtgctgacaggctgtcctctcgtcctctttttcatggcggcggtccttcttcagatgacgacgccggctctgcacccctgtaagttccagctgtgggggtcgggggtcccaaggagcggcctgctgccccaggcctttaaaacacaaaggcagagcccctgggcttcagtattcgggggtcctgggggccggggtgggcaggggtgacttggagagagtgacttgcgggggacaccctctcacccggcccctcgtgccccaggaagagcagcgggcagcaccagaatgacaaaggcaagaacgtccgccagaggaactcttcctgaggcaggtgcggtgggcgggagctcctcctgagccaggtgtggtgggtgggtgggcgggaactcctgagccaggtgtggtgggcgggatctgctagccaggtgtgggctcctgggtcccgcctgtgggtcgctgggaggtgggtccagtctgagcgcccctccctgtccacaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtg

SEQ ID NO: 90391 - DNA, 1070 bp, Homo sapiens
ttttttgagtcagggtcttgttctgcgctcaggctggagggcagtggtgtggggatcacggctcactgcagcctcgacttcctgcaccaccacgcctggctgttttttttttttccggtagagacgggggtcttaccgtgttgcccaggctggtctagaactcctgggctcaagcgatcctcccgcctcggcctccgcaaatgctgagatcacacgcgtgagcccccgcacccggcctcctttccaccgctcttgtctacagccgcccctcctggtccgattgtattggcagatgtcgccaatacggtgtcaaacggcgaaggggcactgagcgttttttctttctcccgtccttggcggcagcagctcggttccggctacggggctgagcccgtctctcagacgaggaaactggggtccgagaggtgagccggtcccagaggcagggcgagggggaagcgggagtggggtccgcagcggacccagccctgcctcccccctgcaggagatcgtcaacttcaactgccggaagctggtggcctccatgccgctgttcgccaacgccgaccccaacttcgtcacggccatgctgaccaagctcaagttcgaggtcttccagccgggtgactacatcatccgcgaaggcaccatcgggaagaagatgtacttcatccagcacggcgtggtcagcgtgctcactaagggcaacaaggagatgaagctgtccgatggctcctacttcgggggtgagcttgaggggggcgcgcctggagggggagggggcacgcgacccccgcggtgtgcagagccagggggccggggccggggccggggccggggatggggatggggatggggatggggccggggatggggatggggatggggatggggccggggatggggatggggatggggccggggatggggatggggccggggatggggccggggatggggccggggatggggccggggccggcaccagggagagcctgggtgggaagcgcccacgctggccaaggtgcagaggccgggccgtgtgcctgggcggggagggccgcggcgcc

SEQ ID NO: 90392 - DNA, 1050 bp, Homo sapiens
ccccgaatgtaggtggtcctggcagctcccctcctgtggcccgacagggagagccgagcatgggcgctgccccttcctgctgggcatttcttggcaccgcgatgtgtggttagatctggagcacgtggaggtcgttccagcagaatctaccggccacgggagctgggaatgctcaggatgcggggtggtggccctggcaggaggggacctcgtagccgccctcggagctgaggctcccacagcagcgtggggggcggcaggggtggggcgaggaggcttctgggaacatttcctccccctgtactgatacctaacccaggatgtttggggaggggcggggcgaggggtggggcgaggcctgcaggagggtgggcttccctggacctcaagtggagggggctgagcgcagggccaggatgctggtcactgggtggccctgtgagctcccctcccttcaggagtcctccgctctgccacaggaagggcctgaccttcgtctctgtgcacgactgttactggactcacgcagctgatgtctccgtcatgaaccaggtgcccccgtagtctgagcctcagtccacccatgggtggggcccccacactggggcgttgggtaggggtggtgcccagagcctgcctgatcacccctggggatcctctgactcctgcccaggtgtgccgggagcagtttgtccgcttgcacagcgagcccatcctgcaggacctgtccagattcctggtcaagcggttctgctctgagtaaggcgctccctgaccccaactacctggattccccccccaccccaaaacctggcctcagcctcaccccaccctgcttccaaccccaggccccagaagatcttggaggccagccagctgaaggagacactgcaggcggtgcccaagccaggtaggcgggtgggcagcctcgcaagggtggctcgaactgcgggccagggcggggctttcccgccacccacgccgtccgctctgcttcctccgcaggggccttcgacctggagcaggtgaagcgttccacctacttcttca

SEQ ID NO: 90393 - DNA, 1030 bp, Homo sapiens
ccttatgtggaaatagggtttctgcagatgtaattagttaggatgagatcattagggcgggcaccaccgcagtgacaggcgacttcgggagacaagggaaatttggacacagatgcagaggagaccgccgtggggcagcagaggcagaattgggagggaagcggccgcaagtccaggagggtcagaggtggctgtcggcaccaggagctggaagaggccgggagggtactcgcctggcaccttgcacaccttcacttcagacttccggcctccagagacgagagtgtatttgtgttgttttaagccgcacagcctgcttacctggtcccagcaggccccggaagcccattcatcctgcggggacttaggccagccaggcgtgctggggcctcgtgtggtgatggggatgggagacagacgtgggccagagcgctggcccccctccacggccttgcaaaatttattaaaaggaagatgtctccatagggagagggaacgtgagccgggctgtcagtgatccagcagccatctgctcaccagcccgaccacagggtcagcggcctgcagagtgggggtggggcgggggcacagagggatggcaggccccgctgcacgctcccccgggagtggagaccccagccctgcaggctgctgcgcccaggccttgttctggggaacactctgtctccagtgtcctctagaactcggcgttttatccatggcaggtggaaggtctgctctttgtaaaacaataataaagtcaggccaggcgcggtggctcacgcctgtgatcccagcacgttgggtgactgaggcgggtggatgccctgaggtcaggagttcgagaccagcctggccaacagggcaaaagcctgtctctaccaaagatataaaaattagctgggtgtggtagcatacacatgtaatcccagctactcgggaggctgaggcaggagaattattatttgaacccaagaggcggaggttgcagtgagctgagatcacgccactgcactccagcctgggtgac

SEQ ID NO: 90394 - DNA, 1010 bp, Homo sapiens
gcaaagcacgcttcccgccgcctgactcgccacgtacccactctcaagatggcgtctcccgcaaagccacgcgccagctgactggctcagacgccgtcacgtgatcccattttctccccctcccccgactacacaagccgtttccgccttcggccttgaggaataaccgcctcccccaataggcgcctgcgatttctctgggtcccgcccccgggcggccttctggccagtgggaggtgctggcgggggcccgcggggctctccccgccccctggctgcagcgggagccaatgggcagcgcgcgcgggggacgtgtgcgggcgtctccgccattttgtgagtctataactcggagccgttgggtcggttcctgctattccggcgcctccactccgtcccccgcgggtctgctctgtgtgccatggacgggtgagtcgcacgtcgccccgcgccccaccgccctccccgcgccgcagccctgcccccgccgccgcgccggcctccccggggccgatctcgccccctctcgggcgggagggggcggcgggctctccccttcctctccgcgtggcgggcgcgggtgcggggcgggtcaggggcttcccgggggtctggccgcgtccccatcccccgtccggcccgcttccggcccccgcgcgccccgtccctagcgcacgcggcctcccgcgcccctccccctccgcgcgcgtccccgcacttcgcctttgccccgcctcggcggcgcgcggcccttcccgcttcccgtccggccctcgcgcgcccggatggcccttcccgcctcccgtccgctcccctcgtgcgcctgcgtagcccgtcgcgcgtccccgttggccccagcgcgcgtgcgcggccgccatcgggggcgcgcgcctttcccgccgcccggactctgcccccggcgcagccccggaagcgcaggcggggctggggcggccgccgggagggaaagctggcgccggggcctcgccgcgggcccgagtctctgcgct

SEQ ID NO: 90395 - DNA, 1010 bp, Homo sapiens
tgcgcgaggccctccctgggaataggaagcgggagaggctggagatgtttcgcattctttccgttttcctgagaagtttttcttgggttcagtcacttttaaaagtctgttaaacgtggtccgtgcagtctgtggtgtcagaagaggcgcagccctagagtgggtctggaccccttagcatgcgtgcgggcaggtgggtcctgcagacggcgagacgagggctccccgctctcggacccagcaccgcgggctcgggggccgcgcactcgcctcccggagtgaggcaggaggcccggaggctgcccttccgacggacgctccgagtcacttagggcctcgccgggagttgcagtggccgggagaagccgtggggagctcactgttgggtcaggacctggccggggctgaagggagggcctcggacagtccggctttctatccaccttccccccggggtgtcccgaggagggagagtcgggtcgggcggggctcgggttgatcagtaactgaggctgtgttctggtcggtctgttaatttttattgacggtttccacggccgcctcctgctctcctcggtggatcgggctccactctgctgagaggcaccctcttgggggcccacccctacccgggtggaagctctggcccaggcctgtgagtttgccagtttcagcctctccgaggcgtttccaacttactggaaagcacacagcagcccttgaaccctctcagcggcatctagcattcctcggggcttccgatgggggtgtctttgtcttggaacgtgtggggcctggtccagaggtggggcctggggtcctgctgggagggaggggcgccaaaggacaatggtggccccttttcaagttgcagtcaagtggacggctcacttccctgcccttctgagctttctctagcggggcctcgtgcagccagagggagccctgcggaggtggcagctgcagggacctacgggctctcctggcccggggacagctgggtgctcctg

SEQ ID NO: 90396 - DNA, 5782 bp, Homo sapiens
tttggttctcttgcgaggccaccagaagtgaggacggctgcctgggccctgccgtgtgctgctgggggggctggctccatggagggggtcctctgccctgctggctggtggctgaggccccaggcctgtgcccagggccgctggcagcacagtgaggccacgtccacagcagagttggccgtggagatagtgtacgtggtgccctccgtagctgagagcctcccagccccacactggctgagtacccagggcttccagaatttggaaaaaggagcagtgttttggtcgtggagctgtggggtgccgtgcgcgtccatgggctgggtctgcgctcaggctgccctgccgtggaagtgtgggtgtgggtatgggttgggggtctgggaccccaggcagcccaagtgggagcagggccggccggtggggaagggaggctctggcctggtgggaagtgcagctccgcgttgtcccttctcttgcagcggggatctgacgagcttttctctacttgtgtcactaacggaccgtttatcatgagcagcaactcggcttctgcaggtaaggccgggactcggcccagggcaagacccgtgggtgtctttccctggaacaacgttacgttcttgttctgggactctactttccatctccaactgcaggggcccatggtccacgctacagacccaggtccaagttctcgctgcagagaatttccagggaggcgctggatggatggtccaggctggcacttggacctgtgggcgggttgtcaggagctgtcgggagcaggggtcctgactgtgcaggtcttggcctctcgcgctgctggttcacatgcaccctcctggggctcagggttggtctccgtagcaggcagggctctagggggatagcagggaccttcctctgtgggctcctgcgagttggtgcctgcatctcatggcacccccttttcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggtacctgagccgcgtttctccggggtgctcacaccgtgcaggcggggacgaggagggcccagcgctcactgcctccccaacaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcggtgcgtggccccgcggcggaccccagcagcccggggacctcgggggtgggcccagccgcaggggccggggactcacggctgtgcctcccacagcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccaggtgaggtggtcccatcaccgccagggcaggtcggctgctattgctgtgggcacaggcacacgggaggggcctggcagggctggtgggcaccgggcaggagctcatgctgtggcccgggacctgcagattttctccaagttcggcacagtgttgaagatcatcaccttcaccaagaacaaccagttccaggccctgctgcagtatgcggaccccgtgagcgcccagcacgccaagctggtgagtggggctcccgggacggcgcccgccctggccctggcccggcgacgtctcacggtccctctcccctcagtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtaagaggctgcccgacgcggcgccagtgtgcagagtggtctattagggccgctcagtccggagccccggcggcacgggcccggccctgcaccagggtgatgcacctgctgctctctgcacggccagcacagcacggtccagtgtcccccacgtcgggaccacggccccccctggagcagcggatctgcccgcgaaggctctgccggggccgcccgccggccgggttggggcccatcccgcagcacagcgcccgctcgcggtggaggttgtgggtgcgatgattagtgtctcatttatttctaggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcggacgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggtacgtgggcttttcctccgcgccgccgttcctcccggaagagcgagcaggggatgttgtgctcgggctcgggtcccggagcagcgccgcccctcgctgtgtctgcgcctctgccctggcagcccctctgctgcagcgctgagaccctccttttccaagatggcttgagttttcctcttttcctgaattcacatcttggttcgcgttttctcttgcatgatacgcagaatgaattattttttggttacccaaaggcaatctaaaaattacttggagctgagcagggcgcgcagttcagagccccagcaggccgccctgctggtcagcgggacacacagggttagcgcggcggggtgtgggcagcccctgtggctcgagagcctgtcacttaactggtggatccgttatttcccagaatggttaaattcccctcggggagagcttgggtgaaacaagaggcccaaaatatgtaactcttgatggatgggatcctcctggaatcagcatttcaggctgttctgtttcccggcaactcctgtgacttcctcaaggcggtgcccagcctggccctccctcgcgggggcccaggacgcactccctgcctgtgcctcttaccacgagccgggtgctgtccctccagctcctcctgagcgaggccgtgcactaacagactcgatctcccttcacgcctgtaatcgtccttagagactgacttgtgccacagctgcgggagacagcgctgctgcagggcttggctgaggtggccgcgagcggagctgcacgcgcgctcctggggggcgtggttgggatcggcttctgggagcccctccagcagcgctgtctctgccggcatgtgagtgaaggtgcttctcttaccgtgtgcccgtcgaggtaaacctgtaactggaatgtgtgtggagtgtgactgatagaacactacctgattcttatgtatttactgacctgtgtttttttgctactttttttcttttctccccttcccctttccctattttttttcttgccctgatccggaatttctttgccaactgactgcacggtacttctgcttcctgttgttgcttgaaacaaaacaaaaacataaacaaataaaaaacaaaaattccccctcaaaccctgctctccggaaaccaacctgcccttgaatattaacatcctgacaacttcatcatccatcaaccactgcacgcctgcggggactgtcttcctcgtgtggacgattggcaactcgccccccttgacctctccctctcccctgtccctccgctgccttgctctgctgtctctaaagagagtcacaccccaaagcctctttattcttttcggtatgttatcgttcacacttttattaccttgttttcattaattgagatgattttgatgccctgagacgtattatgagtttgcggtttggcactctgatgctccgtggcatccgcctcgttttatggtttgctttcggtttgcgaattttatttggtcccgtagatacgtacgcatggtttatcgccctgcatgcttttcagagttagacctgtcggtggcatatgccaccgtggccacccgctggcagcttacctgtcctggatgctatgactttgctgaacggagctgctcctgttagcgcgccctgtggctgcgagacgcagctccgcagtggccgataaagcaaacccggccgggctgagccgggccttgtgggggtgcgcggggccggggctgacggggagatgggcggggcaggcagcaggagactcaggccccatccctgggcttttgaaggcgtctacggtgacgtgcagcgcgtgaagatcctgttcaataagaaggagaacgccctagtgcagatggcggacggcaaccaggcccagctgggtaagaggccggggcggccccggggtggagggggcaggggcgggggctgcgttccctctcgggcgcctggtcacgcgggtgctgctcccccagccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgtgagtgctgggccggggggctcatggggccgggggcgggcaagggctctgcttggctgtcctaccgcgtcggtgtgtggacttctggcgtttccaga

SEQ ID NO: 90397 - DNA, 2589 bp, Homo sapiens
cacttgaacctgcaggcggaggttgtggtgagctgagatcacgccactgtgctcccgcctgggcgacagagcaagattccatctggaaaaaaaaaagtggaggagcgtggtactctgtttctgcaaacttgtagatgcctggtttcgttagaagctgcttcagaccattgtggacatgatttgataccccatttctgggctcctaaaaggccctacgccttccccggctactctgaaaactagtctggggaaagcctcgcggacctgactgggcgcccccacccccacgcggccccaggctcacgcctttctcctcccacaggccctcagtctccgaggaggatctcaaggtcctgttttccagcaatgggggcgtcgtcaaaggattcaagttcttccagtgagtatgaggcgggctgtccctggctctccccaggctgccctgcggccggccctgaccccctgtcttgcaggaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttcgttgctggcttcctctttctgtgccgcgggcggccccgactcccgcccgggtgtccgccgaagcgccaggtggggccacgggcggggtgggcccggccctgagagtgggggtccctgcgtggggcgtgcgggccagagcgaatgaccaagagccggacctcggtttctgccgctttattgagcatccgcgcggccgcccgcgccctcggcccgccccccgcccgcccccggccccgccgcgctagtcggggaagcggcgcgcctgcatcttgcggaagtagccctcggcctccgcctccgcctcgcgctccgccagccccaggccgcccgcgtggcgccgcagcgtggactcccggctgcccgggcccagcgccccatcggccgcgcccagcgggggcagcccctcgcccgtggccaggttgacggtggccacggccccgaaccgcggctcctcctggtccacgtcgctgaccgacgagcc

SEQ ID NO: 90398 - DNA, 1047 bp, Homo sapiens
tcccagaagtctctgccctgttgggaggagctgcgtcttcacgcaggggctgtcaggcagcggatctgtgggtgcgaccatcccgcatggctttattggaattgtagatgaggagggatgggaatcccggctgagctggctaaggccgagcgagtgttagggtttgcatggctgcaggtctgaggtggcgccgtctccccactgtctgccccatcgggggtgagatggtgccggcccacaggtttccatgaaatcccagggcccaccttgggtcacgtgcccatcctggaaccaatgagtggccgaggcacgaagcgctcggattggccgggcctggtcttctgggcatgggagcagggcggcatgagacctgggaagggccctgggcaggttgcacaccaggccatgctggactcctgcggctgtctcagcctgtctttactccattgccttcctgttttcctgcccctgatttttcagttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcggtacggtggagccagcggcagccacgcggggcctcagttcacaccaggggagttgggccctgagcacaggccacggggtcgtgggagctcacaccagaggacgtgggctctgagcacaggccatggggctgtaggagctcagccttctgggttctgatgggttcccaattaggaggcagatctcatctttcgggatctgtgaggctggcagacagatccagtgttctttaatatgtaaagagtcattgcaaatcaacaagggagcctggggaacttggtggaactccttcctgggtaggcggcatgtgtcctctctgtgctgcagcagccataatgtggtcctgagctcaaaccgtggcatccgtgcccatgagtgagtctgcacactcttcagtgcctaccctatttgct

SEQ ID NO: 90399 - DNA, 1045 bp, Homo sapiens
cgaatcgggctggagcgttggttgacggaggcttgttggagacacgtgccccagttttctagacggtgtgtgtcactggtttttgaaaggtgcgtggtggctgtgcccgtcttctctccattgtttgagtaataggcactcataatacgtggtcattagagaaaactagaaaaccacagaaaattggaatcaaatcggggtgcaaaaaagccacctattatctgctgtggagaggctcccactgttcacatttcggagtcattttcttctaatctggttttaaagacacagttgtggcgcctcacaggcctgctctgttcctgcggggggacagcctgttccctgagctgtcgactcggctgacagcagttctgtgaccttcctggggtgggacacacaccggcttacctggagcctgcctggagtcatcgtcatcgtctgcaggctgtggtgccaggccgtgctgaccatgccccgtccccacagacctgacccgcatgatccacatcctggacacggagcacccctgggacctgcactcgatcccctcagagcaccacgaggccatcacctgcctggagtgggaccagtcaggtgaggcgctggtcccacgtggccaggggtggcgacccggatcccggagcaggggggccctgtgtttctccggtcagtctggagtccggcgctgggtctagagcccctggtctgcagctttgcacctgctgctctttccatagtggcccgaatcattcttgttcagggtgtctcagggcatctctggagtgcgccttgtgccacctgctgtgccctacctgggccgagacctctccactgggctggcttcccccaggcgctgtgccgtcctgcaacgcagtgctctgcccatccctggaaggttcgcaatgatggcttcttgccctcaggctcccggctcctgtcagcagatgccgacgggcagatcaagtgctggagcatggcggaccacctggctaatagctgggagagctcagtgggcagcctagtggagggggaccccattgtggcc

SEQ ID NO: 90400 - DNA, 1831 bp, Homo sapiens
tctgcagtgagggggagatggggaaggggaggccggtgggagctggaccactcaggacctgggtgcctcagagccacctctgcagggcagggagcctgaggggaggccggacactccgccaggcaggcgtgtgagtggccatgcggcctcaggcccagtgcgtttcagggtccccatccgcacagtggaatgagtgccagcggggagtgagatgggcccgaggagagtgctcctgtagggagccttaggtattcttgtgagccaggctcccggacctgcgggcttagggccagccaggccgcagtgaccagcacacaccagctggcggtgacctccctgggaagaagcgagggtggtgcaggtccgaggcacctctacctgccgcggctcccaaattcctcccgttcttgccccgctggtcccgtctgcaggtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctctggcctcgggctatgtgtgtttttcttcggggcagggccgggggcttagtaggtcctggccaccaagggctgcaggtgcccccctggctcctctgcccttggttgcctggattcaaaccctggctctgccacatgcctgccgtgtgaccttgggtgaggagcttgtaggagtgccttggggcccctgtagaccttgagtgagtggcttgtacgagtgccttggggcccctgtaatggagggtctcacacagggggcttgaaacgacagaaggccagtgcagtagctcatgcctgtgatcccagcaccttgggaggccaaggcaggaggatcgcttgagcccaggagtttgaaaccaaccagggcaa

SEQ ID NO: 90401 - DNA, 1047 bp, Homo sapiens
tccgtgtctcctcgcctccctgggctggattcctggctcagtccgcagcccggatcgggacgcagggttgtggttgagttttcgacccctcgcctaggtgtccctccttcccggagctagatttctgggtgtagggatcgtggccggccccgcctcccgcctcagtctccccgttcgtccccccaggggctggatcccggccccgcctgcctcggtttccccgttcgttccctgatggctggatcccggccccgcctgcctcggtttccccgttcgttccctgttggctggatccccgccccgcgcgcctcggtttccccgttcgtccccccaggggctggatcccctccccgcgcgcctgggtttccgcgttcgttcccggcagccgggaggtgggcgcccccgccccgccgcgcagccccaggccccgcccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgtgagcgcgggcgggcggggcgcggcgggcgccgggggcgggctgggctccctcccctgagatcctctccccgcctcccctcccctcctttcccttccctcccctcgttcccttcgttcccctcgctcccgttgctcatcttccggggcttcagcctgtcctgccttcccttctcgcccgctgtggacccccaggctgggtggggggtcttcattgttactcagcggggacaccctcctggcgctccgggggctcgctgggggaggggacccggatccacgtccccatttacctgttccgccccctactccccggtccgccccctaatccccggtccgcgccccactccccggtccgcccccccactgcactggtccgcgcctccattcccgggtccaccccctcactctccgggtccgccccccaactcctcggtccgtgcccccactctccggtcc

SEQ ID NO: 90402 - DNA, 1055 bp, Homo sapiens
gcacctctcgcagacccagggaggggaccccttgtcctgcccccggggacacctggccagggggctggagggggtggcctgcgggttcctggaaccgagccatccctccctccgtccctccccagtcgtctcaaaatccaatccattttactggctggcacttggcattttattcatttcatggaggatttttttcctacctctccaacgctggctccaaaaggagatgacgtttggggtgtgtgtgtgtgtgtgtgtgtgtgtgtgtgtgtgtgtgagaaaatcgccggagtgtagatccattaattagagctgaatgttcccaacacagcggctgttctgctgccccgcgggatctggggagacaccgtcgggaggacaggatgaggaatgcctgggcagggaggaggtcctctgctagatggatagacggatgcagccgcccccatctatcaggcgcctgtgggatgccagggccccagaaggcaccccccgaggcccagaggacataggcaggcttggggactggtagacagcggggagctatggaaggctctagagcactggaggaggggcatgtgagcaagcatccttgtctgggccgttgctcaagccacaagcaattatagagtgcctactgtgtgccagcaaccaaaccagacccaccccaaccctcccagagctgagttgaagagatggtcactaaataagaaggaaatgaacaaaaagatggtaggccgttatggaaatgtgtggaggttgggggtgggtagcagcaggactgaaatggggcagggagtggtgctttctgcattttctcagtggcaagcagggaacgtttttcagggcagggcatttgggactgggttttgaagggtgaagaggagttctgtggcccaagttgcctgcccactgctggagggcagatctactctataggtttccatcagacatgcctgtctcagtttccccagggtgcactggatgttagaacacacccctgggctggcctggttagaaactgacagctccctggatgtgcgagacaagcaaga

SEQ ID NO: 90403 - DNA, 1024 bp, Homo sapiens
gcagcgccaggcggaagaaggcgtgctcgcccagcgagctgagcagagcgctgcccaggcccaggcacagcaacacgaagaggcccgcgaagtggtagatgctcatctgcagggtctgggggcaacacagcaggagccccgcacggtcacgtaatggcaggcccctggggagccttgaactaggggagaacaggttgggccagagagaggggcttggggcagtggagccaggttgggaggcagggactccatggctggggggagtgaggtttcatggaggaaggggcactgcagccggggttttgtagggtgaatagaagtgcgcagaagcagacaaacgcacgtctggggaatgagcactggggttggtcacttcagacaaggctcagggccccccacgcccacccccacccccaccctctgtcccaggccctgccccacctctgtaaccgcaaagacccgcttgccgcaaggcaccatcttgtaccacttgtcgtggagcaggtcgatgaagccggaggacttgtagcggctgatgaactcggacaggttggaggtgagcggcgagttctggggcagtccgatcccatagcctgggggcgcggggccaggcggtggggccaggtgggacagccccaggggaactctgcccgcacacgtgggatttcgccccttcccacctcgaaccctccgtggctccccactgcccccaggaggtccccagagaccccggcgccccgcctcgcccaggtgcctctcaccctcaatggcgaagggctttcccacggtcagcagtttgcagtcggcgtcgatggagacctcgtagtccaggagcgacttgtccatgatgaaggcgttgagcttgggggggtcgctcctgctggggccgggggcgggggtcagccatcgccccgcccaccccacgccccgcccccgcctcaccccgcgcccgggctcacgtgagcatggcgacgccgcggggcgtggtgggcgcgctgtggcgccgcatgtgtgcgtgcatgtc

SEQ ID NO: 90404 - DNA, 1032 bp, Homo sapiens
aggggtagggggctgccagagggaggggcgctggaggcgggggtggtggctgcgccacgcgggaaccccaggggctgggcctggcagggtgggacctgcagccccgacgccctcaccccgccccgcaggttcttctatctctaccacttcgccttctatgcctatcactaccgcttcaatgggcagtatagcagcctggccctggtcacctcctggctcttcatccaggtgaggcctgggcggcaagcagggggcaggccagccgtgcctttccaggcaggagaggctgcagccggggaggatgccctgtggggtcggcccaagcgggcagaggtagcgtggatggtcccgggtgggctgccctctgggagcagcggctgggtggggcaggggcgggcccgtcctgactcccactctccctcccgcagcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcctggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccg

SEQ ID NO: 90405 - DNA, 1034 bp, Homo sapiens
catgctgctgcttgcagggcgggagccgttggctggcagagggccctggtgtgctccacttggtgggtctgagtccagcctcgtctcctcccaggtttggggggtcctgtgtgcatctgagagggccccggcctgctggcttcgtccggctcacccctgaggaggtgcggggcagtcacaggccttgccgaagccccagggcctgtcagagccgggctgcaggtggcagagcccctccggggttggagtggggcgtcccccggatcctcagtcacttggactatgtgaggggctggcccggtgcagtcagcgtgggagggacccagggtcctcagagcccaattcggcttctggggtttccttcctttccccgtcctgggcgtcccagcgcgccccatcacgccccatcacgtaggcccttgggtgtcggctgcagctggccctggggcgccccactgactgccggccgccccctaggccctgtttgtgctcttcgtcctggcctacatccacatcgtcttctcccgctcgcccatcaactgcctggagcatgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaaggtgagccaggcctgggctcagctgcagcagaggccagcgccccgtagatgctggtcgctgaaggggcggttcctgacatcgacaggatgttggggttcttgactttcagggacctggcatgcagacaaggccgcccctgcctgccgtggccttttggtggcctgggggctctgaagcaagaccctcggcctgtcgccctgctagaggcctgggcagggcagggggatctcggggaggacttgggctgggcagactcgggcctttgagagtagctg

SEQ ID NO: 90406 - DNA, 1415 bp, Homo sapiens
tatgcaaaagaggtggcccagatgcaggcccgccccctggagcggccgaggtagggggtgaggcctccgcgggcgccgctggcatcccagcgttctctgcgggcgcaggggggccgctcttgcccggcgtggcgactcgctagcgtcagcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggtgaccgcggccccgacccccgacccttgaccccagcggctgtcccgacccccaagtctgctacctccgaccgcgacccctggccccgctggggacagcgagcgccaccctgcaccctgaggcctatacccggccctaccgattagggctctccctcgcgacctctgaccctgggattggccagggacaccgtctcgtgaccccatcccgcccggggacgtccacccgggaaggccggatcccgctgcactagaagccgctgttctctactctggaaacctcactgtcagctccctccagggcccatcctgtccccggcgaccgcctttcccaggtccccacctacccaggcttggagtccggtcctggcctgcgaggtagcacctcccgccctttgacccctgactgtgccgcctgagaccctcagttccgaggcctctctcccctcccaatgtgctggcccagaacccagcctgacgcaggtctccctcggaccaacccctgtcctggaagtcgactccccactcccctctctccctccttgtagcctttcagctgcgttccccgctcctgagcctcaggggaatgtgacttagctgaggtcacctcgctagggttagcggcaaagtcaccggcagcagcgtaccaccccatccccggcctcttcctccgctgggtccccactcccttcctgcttcaggagctcaggttgtgggtctgtcgcccgtgcctcccctatgaggcaccggcctccgcgtcttgggctctgtccccctcccgccctcctcagatggcagaggtctcagccgtgcaggacaggcatcggcctgactccctctgagaaggagtcttgcttgggtgacaagaggggctcagtagcagctgcagcccctcaga

SEQ ID NO: 90407 - DNA, 1052 bp, Homo sapiens
gcctgggcgacagagtgagactctgtctcaaaaaaaataaaaaagaaaaaagagctgatggttgcacaacattgcagacgtacgaaatgctgtgaaatggtgcggtttcaggtggttgaagtggtaaacgtcaggtgtgatatagcggggaggtgagaaggcagggcggggaggcagatccggccaggtttgtcctgcaccgggagtggattagagctgatgtttatcagtgagttctaagccggttgtcggcctgcttggagggcggtttatctgtgcccgcctgcagtggctggggcgcccccaatgatgggaaaagggagcatctgcgtgggtgtggtgaggggggacctccaggccgctctatctgctgttgccctggagtccccggccccaccctctgcagagcttctgtggggttcctgctgggggtgcccccagcccagctcagtctcgtgccctttgctccaccagctcctgtccaaatatgacccccagaaggaggcagagctccgcacctggatcgagggactcaccggcctctccatcggccccgacttccagaagggcctgaaggatggaactatcttatgcacgtgagtacacgcagggacacaggctgtctcacacttaacaaatcttggtttttctcactttttttcttaattaagaaatttttggggggccgggcatggcctggctcatgcctgtaatcccagcacttttggaggccgagggtggtggcggggggcggtggatctcgaggtcaggagttcgagaccagcctggccaacatggtgaaaccccgtctgtactaataatacaaaaaaattagccaggcacctgtaatcccagctactcaggaggctgaggaaggagaattgcttgaacccgggaggcggaggttgcagtgagccgagatcacaccattgcactccagccggggtgacacagcgagactccatctcaaaaaaaaaaaaaaaaaaaaaaaaaagttagctgggcgtggtggctaaataaataattttttttttttgaggtggagtctcact

SEQ ID NO: 90408 - DNA, 1045 bp, Homo sapiens
ggagggcaggtcccatcctagtgttcccaccctggtgttcccagggggaggcgggcccggccctagtaagagcctgggatttgtagagatctcaggagggagccggccgtgggcctacgaggggaaaacatggcccagccccgaggtccagggggaggagcggagtggtctaggaggcaggcggaccccagcgcctaggactcacccccgcatcccacagtgcctgtccttggacaagctggaggcggcaccctcagaggcagccctggtgtcgcgggccctgcaactgctcgcggaacatcgattctgggccggcgtcgtcttcttgggacctgaggactcttcagaccccacagagcacccaaccccagacctgggccccggccacgtgcgcatcaaaatccgcatggacattgacgtggtcacgaggaccaataagatcagggacaggtcaggcgagggagggggcggggggatgagggactgggcggggccaagagcgtggtgggtggggccaggcagcattcagcctattggagaccatgatagacaggatctgggctgtatcaacagtggtatggtagccagagcccggggctccttagaccaataggggcccgtgatgggcggggcctaggtgcatgaggggcgtggccatgggcctgagataagatgagagcaggtataggttgagggcaatggtgggcggagccaggtgtattattaggtccctggaataagggtggagctaaaattgcaccgggtgctgagcgcagtagatcttgcctgttatctcagaactttgggaggccaaagtgggagaatctcttgaggacaggtattcgagactagcctgggcaacatagtgagaccgcctcccccccgcccccctcccccaccaacctcacgaaaatatctttaaaaattagccaggtgaggccgggcacagtggctcacgcctgtaatcccagcactttgggaggctgaggcgggcggatcacgaggtcaggagatcaagaccatcctgactaactcggtgaaaccc

SEQ ID NO: 90409 - DNA, 1090 bp, Homo sapiens
gaatggagatttttattcctctcagggcttctcagtctgagtggttactccagtgactcctattgtcccttcagctggtcgatcacaccgctcatgtacccagcctccttcttcttctccgtgcccagcacagcctatgtggtgctcacctgcataaacctctttattggcatcaatggaagcatggccacctttgtgcttgagctcttctctgatcaggtggggcaccacgaggctggggcttgggctgggttgggtcgttggactcagcccctgaccaacatccgtctcccacccttgagcagaagctgcaggaggtgagccggatcttgaaacaggtcttccttatcttcccccacttctgcttgggccgggggctcattgacatggtgcggaaccaggccatggctgatgcctttgagcgcttgggtgagaacttcctgtcaggtggggccatggctacagatagctagcacccttggagacctagagttaattatacagagtggagaaaaacagccccccagggagacagccagggttcttaggtggccctaaggttgggccaagttggaggtacaagaaagcagccataaaaagctaattcttagattacatcacaagaggcctcttctgttttctatgccaattagactccagctgagtggcctatccaatttgtgttcctttcccttaagaatccagagtgacatggatggagaaagggccagaaaccaagactctcatggacccagtccctcctttctatatccacaggagacaggcagttccagtcacccctgcgctgggaggtggtcggcaagaacctcttggccatggtgatacaggggcccctcttccttctcttcacactactgctgcagcaccgaagccaactcctgccacagttagtgaggtctatggagagggtggcaggggccaaggacctactttaagcccacagatattctgtccccaggcccagggtgaggtctctgccactcctgggagaggaggacgaggatgtagcccgtgaacgggagcgggtggtccaaggagccacccagggggatgtgttggtgctgaggaa

SEQ ID NO: 90410 - DNA, 1166 bp, Homo sapiens
gagctgcgggcgtggcccgggtaggaggggcagggctcacgctgggctgggaaaggggactgacgccgctctgggtggaacccgagctcggtggggtgtggccagtgctctgtgggggtggggctgaggctgggggcgtggcaggcacacgtgggggctgggccaggcccaccaacacctgctgacccttgactctgcgcagcttcccgagccgctcatctccttccgcctctaccacgagctcgtagggctggccaaggacagcctgaaggcagaggccgaggccaaggcggcgtcccggggccggcaggacggctcggagagcgaggcagtggcggtggccctggcaggtcggctgcgggagctcctgcgggacctgccgcctgagaaccgggcctcgctgcagtacctgctgcgtcacctacgcaggtgagtcccggcatatggagtggagggcgcggggtcccgggagccgctcagcacctggcccctgcccaccccgcaggatcgtggaggtggagcaggacaacaagatgacccccgggaacctgggcatcgtgttcgggcccacgctgcttcggccacggcccaccgaggccaccgtgtccctctcctccctggtggattatccccatcaggcccgcgtcatcgagactctcatcgtccactacggcctggtcttcgaggaggagccggaggagacccccgggggccaggtgagggtgtgggcctgaccggggctggccactcggggcttggggagcagggggcgctgctggggacagtcgttgtcggatgaagcccaaggaaccacagggagataatttggtttggacagggctgttcgggaggccactgtctttttgtgtcttttatgcaaaaaactcagcgaggtctgcattgaatctggcagaggtgcaaaggctctgcggccgcccctccactctcccttggggctggccttgggcctcacccttcacccccagcttccttccccgtttcccatcccggtgctgcctgcagccacaagctccacgctggcccggtgtccacagcctgcccgagctgccactgcactccgccgcgaggtcaattccccgcttcagattttcttttctgggagttgtagtttcgctcctgctgcccaggctgaagtgcaatggggc

SEQ ID NO: 90411 - DNA, 1174 bp, Homo sapiens
ggtgaaaccccgtctctactaaaaatacaaaaaaattagccaggcgtggtggcgagcgcctgtagtcccagctactcggggagccgagattgtgccactgcactccagcctgggagacagagcaagactccatctcaaaaaaaaaaaaaaaaaaaaaaatgcagatcccgggcccaccccagcctgtagaatcgggactgctgggagtgtggagggaccctagtgctgggacaggaggagtcccagcaggaggtggctgtgcccagcccgtctgcctcagaagccccaggagctgtgactccgtcccccgcctgtggagccagggtggggtgggtgggctccctgagtgccggggatcggggtggggttcagggctcttgtccgtctgaaggcgcaggggctgtggtggcacctgggagccacgtggggtctcaccagcccttggtgatgcctggtggcttcctctctcggcagctagtccctgagcacgtcgtcatgaccaaggaggaggtgacagagctgctggcccgatagtatcctttccagccccaccggccccgcccctccctgtccctcgagacttccgcgttccccccccacacacacccctgcccccccaacggccctgtctggcattttcctgacggtgcttcgcagtaagctccgagagaaccagctgcccaggatccaggcgggggaccctgtggcgcgctactttgggataaagcgtgggcaggtgagccctgtggggagaaggggccctggggctgctctgagctgaccactcggagaagggggcttctgtccctccccgacagcccctcccccttgatccagggcctggaggggacctcgagaccacacccccaatatccccctcttaaagccagggccactgggcccagagaagagcgtgacccaggttcccagggagcgggtcccacagcccagggtcagccatctcggacccctgccggccatccccagcccgtgtgctgcccgcctgctgtctggtgactgcagtgagacccctcaagcattcgcagcccctgctctctgtctctgcaggtggtgaagatcatccggcccagtgagacggctggcaggtacatcacctaccggctggtgcagtagctaccgcctgacaggtgagacggccgagggacaggcactg

SEQ ID NO: 90412 - DNA, 1092 bp, Homo sapiens
ctaaagtagggacactttattgccattgcacaggtagggaaactgaggcccaagggaattaaccctgacctggccaggagccaatggaggaaaccctgtacagtttgatgcacaaatatttatagagttcccactaggctcccagaccatccctaggagccgagctgccccttgaccccatccaggcctcagtttccccgctcacacttcgcccccgcctcgtgggattctaaactgttgctccaaggtgggagttgaacggaaactacaactcccgagaggctgtgcggccaaagacacacgagaactacggaggcgagagactcgctcagccaactgccgctctcgtaaggctcgggctgcccttggcgctgccgatccgagacgttgctgcattcaggcattcgccgacgacagaccagcgcggggcggggttaggcggagggggcctgattcggattcggcgcaggcgcagtccgcgcgggttctcgcgcggagaaggggtgcgagcggcggcggcggcggaggctgccatggacgacgaggaggagacgtaccggctctggaaaatccgcaagaccatcatgcaggtgagccgcgcctggtgttgggggcgggggcgcgggcggcgggtgtaggggcccgaggtggggtcgagcacggcgtctcctcgtactctcgtcggagcagcagcgatgaagggccgggccgatacgggaggcccagaggtcgccggggataccaggcgctggacccgacctgagccggcagcggggaagggagggggtttcgagacgtctgggtgcggtgcttaggggtgggtgggcggcttgggctggtgcggcgcgcgtggcggcgagaggaggaggaagccgcgaatggggacggggggcgcccccagactctgcccttctctgtgattcagcgtcgctatttgtccttgcgtcctgaaccccatggagtcttcagcatccgaggctggcagagttggtggttgggaagcagcgggcgagctggggctttcgatggggacgtggagctcggaacccgtgccttggggtctggggcagatggaggccactgggtcgagtc

SEQ ID NO: 90413 - DNA, 3505 bp, Homo sapiens
ccctgatcgtgccactgcacgttagcctgggcaacacagcaagaccccgtgtcttaaaaaaaaaaaggtaaataagagttggggacacttttctgcgagttggagaaaccaaaccccctcgacgagtcttaagtagtattctcaggttgtctggcctgcggccgcgctgctgtcaaccagccggataactgcgctgcctcccgacgcgccgccagccaggccacggcctcctagacacaagcgagcatgcgcagtcgccaacaacaagtccgcacgtccggtcccgcccccccttccccgccttcttcccactccggcctcccattggctgacgtcggcgcgagcgctcaacaccgacgcgtctgaccaatgagcgctctggagggcgtggccgtgggaaaggaggcgcggaaagccgacgcgcgtccattggtcggctggacgaggggaggagccgctggctcccagccccgccgcgatgagcctcggccgcctttgccgcctactgaagccggcgctgctctgtggggctctggccgcgcctggcctggccgggaccatggtgagctagcgccgcggccgttgccggcccggtgaccgttggggcgggcgcgcgatccctgcctccgctcgccggcgtggggaaccctcaggctccagtgaccttggtggggggcgtctgggggctccccctccccacccccggccgggcacggacgcgggtgaccgtactgcgacgcgctccgcggccctccaggccgttgtaggcgcgcgggctggggtcggggaaggggaaggggttgttccacgcgcgcgggtcgtggtcggggaaggggccgtccaggccgttgcaggcgcgcgtgccggggccggggtcgggggtccaggcttgcagggggcggggtccgggacggctggggcggagctggaccgttgagggccacggcggggcgtctccgggccgagcggggctgctgcgcccgagcggttgggggcgcggagggctggaaatcccggatcacgcgcccccgggcgccgccccgcccccgcaccttggcctagcgcggtggcgtcacagtcgcgcagtcctgactacggcctccgggccctttgtccccgctagcggcgctcggggtgggggagccaggaggggcgggagacgggcgggtatgggccgcgcgggcgcaggctcccccgggcgccgcaggcagcggtgccagagccggggcaggcggcggccgcgagcccctcggcggcggaaggccccagcgtgcaggcgcaggagggcgcggcgccggcggaagaagccctgtccccgcagcttgcgaccggagatccacgaatgtcccaagtcccaggacccggtgcgcgcggggcccccacaccggctaatgtggcacattttggggttggaaccctctcccggcctccgggtctccggtaaaaccggaccagaagtacaagggggcgtgtgcgtttaaggaggaggagcgttcaggtcttcagggccgcagggcctcggtgtccccgccaccgacccgctcccgatcccttcctgcctcagggtcccgggctcagcctcccgtccacgctccctgctcagcttcctttgccttgcagtgcgcgtcccgggacgactggcgctgtgcgcgctccatgcacgagttttccgccaaggacatcgacgggcacatggttaacctggacaagtaccggtgggcgctcgcctggggtggggcgcggggtcgggccctgggagggggccgtgttcttctgcgctgacgccgccgatcctcgcaggggcttcgtgtgcatcgtcaccaacgtggcctcccagtgaggcaagaccgaagtaaactacactcagctcgtcgacctgcacgcccgatacgctgagtgtggtttgcggatcctggccttcccgtgtaaccagttcgggaagcaggtgggctgctgcgtccccggggcccgcagaggcgggtgggtgggggtcggggtgggctccagcctggagagggcctgggagtgtgcagggggcccggactgagggggtgccagcccccgactcactcacacaccttggccgccacaggagccagggagtaacgaagagatcaaagagttcgccgcgggctacaacgtcaaattcgatatgttcagcaagatctgcgtgaacggggacgacgcccacccgctgtggaagtggatgaagatccaacccaagggcaagggcatcctgggaaagtgcgtgacctctggggacagtacggctgctggggtgggggtgggggggctgctgggatgctcacacctccctggggcagaatggctcatggctcggggggcggttgcggggaggtgctgggactctcacatcgcgtggcctcctgggggtaagatggctcagggggacatagagggctgtggaggcagccagggatgcccacacctttgtggcctcctggggacaggatggctcgggggcctgtggggggctgttgggactctcacactgcatggcctcctggggtaagatggctctgggggggcttgggggcactgtggctgtggaggcagccggggaagctcacacccttgtggcctcctggagacaggacagcttggggactgtggggggctgctggggacgctcacgtccatgtgcttcttttccagtgccatcaagtggaacttcaccaaggtaagggggctgtggggggtaggggaccagcttcccctggccacagccgtggcccagatgggcagcggacaggaagggcagcctcagccccttgcaggggtggccccacagtttggacaccgtctctccacagttcctcatcgacaagaacggctgcgtggtgaagcgctacggacccatggaggagcccctggtaggtcctctctagggagcccgcttgaggctcgggggcttgggaggtagctgccctaacccagctttcctccccgacaggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacagacaaattagcctgctggatctttctgcgtaggggcttggggggcccttttgccaggggcccctccatgtcagggccagttgccgtcagctgccaggctgggggtgccatggaggtggcgtgttgttgccccctcttcctccaggctcggggggctgtgctggctgcagtgctggggtgcagtgagatctgggcccgttggacacccagccctggctcttaatccgtgcagccccacctgctgtgcacaggcagggcctggtgtagtgccgagtcttggaggagataattctaagtggctg

SEQ ID NO: 90414 - DNA, 1039 bp, Homo sapiens
tgagcgtccccagcagccccccacagtccccaagctgtcctgtctccaggaggccacaagggtgtgagcttccccggctgcctccacagccacagtgcccccaagcccccccagagccatcttaccccaggaggccatgcagtgtgagagtcccaacagccccccacaggcccccgagccatcctgtccccaggaggccacaaaggtgtgggcatccctggctgcctccacagccctctatgtccccctgagccatcttacccccaggaggccacgcgatgtgagagtcccagcacctccccgcaaccgccccccgagccatgagccattctgccccagggaggtgtgagcatcccagcagcccccccacccccaccccagcagccgtactgtccccagaggtcacgcactttcccaggatgcccttgcccttgggttggatcttcatccacttccacagcgggtgggcgtcgtccccgttcacgcagatcttgctgaacatatcgaatttgacgttgtagcccgcggcgaactctttgatctcttcgttactccctggctcctgtggcggccaaggtgtgtgagtgagtcgggggctggcaccccctcagtccgggccccctgcacactcccaggccctctccaggctggagcccaccccgacccccacccacccgcctctgcgggccccggggacgcagcagcccacctgcttcccgaactggttacacgggaaggccaggatccgcaaaccacactcagcgtatcgggcgtgcaggtcgacgagctgagtgtagtttacttcggtcttgcctcactgggaggccacgttggtgacgatgcacacgaagcccctgcgaggatcggcggcgtcagcgcagaagaacacggccccctcccagggcccgaccccgcgccccaccccaggcgagcgcccaccggtacttgtccaggttaaccatgtgcccgtcgatgtccttggcggaaaactcgtgcatggagcgcgcacagcgccagtcgtcccgggacgcgcactgca

SEQ ID NO: 90415 - DNA, 1110 bp, Homo sapiens
gagcagggccaaggtcccctgaccactgctcagaggagccctaggccctggccgcagtgccttcagcgcccgacccgggcccccacctggtcagccctggcggggcccactcaggacagctgggggccggggcgtggcagggccctctctgtgcctctcctcccaagtaggaaggggctccgggtggctgctctgggactgggcacccacaagggctcagtgggcccaaacccttgaaatccgtgaaaccgggtggtcccaagagctagaaactcaggaaaccccaggtgctcagggccccgcgtctcgggggctccgtggggcagacccctgctaatatatgcaattctccctcccccagcccttccctgacccctaagttattgcccgctcacctctcccaggccccaggccgcggagctggcagggtggcgcctgcggtttctatgtatttatagcaagttctgatgtacatatgtaaaggacttttttaaatatatgtgccttttgcctacttcccacggagtctgctcctcagcctgtgggacagggagggaagggcaggggtgtgtgggcatccccccaggctctcctggttaccaggcctttctgcccactgcctgtgctggccccatgtggatgagaggggacgagggctgggagagacagacctctcaacccagtgtctggggcaggtgccatggaccgtccattccacagacccccagtgggggcagctgggatcagccaccctggcaggctgcagtccctctagctgtgcaggtgggcagccaggccgtgtccagacagcccccgggtcccatgaacggtggctggtactgctctaccagcccctcctggcctgtccatccccagccctcacggagggactctgtgcaaacagtaaccacccagccacccccacaccccccagccaggtgaggccccaagggccggtgtgggtgcccaacccatccccagcaccagggccacgctgttcctcgggcctctgcacttctgcttcctggccaggggaggccccagtagccacctcctaacagttaaggcccggggccaggaagcacagccacttagaattatctcctccaa

SEQ ID NO: 90416 - DNA, 1049 bp, Homo sapiens
cgtgtcccggccccttctttccccctagctcgtggccatcatctcggaggcctccagctcgggtgtctccctccaagccgaccgccgtgtccagaaccagcggcgccgcgtgcacatgaccttggagctgccgtggagcgccgaccgcgccatccagcagttcggtgagtccggccccgcccccagcgctgcctggccccgcccccaacatggtctcggccccgcccccgcctggccgggccctgagagcagctctgcccccaggccgcacccaccggtccaaccaggtctccgcgccagagtatgtcttcctcatctcggagctggccggggagcgccggttcgcctccatcgtggccaagcgcctggagagtctggtgagcaggtgggggtggggctgagaaccagggacaggcccaggaaggctctccaaagctttgtggggtgctagaggccagaccccaggtgaccaactgatggcctccccacccctggcagggggccctgacccacggagaccgccgcgccacggagtcccgtgacctcagcaagtacaactttgagaacaaggtactgcagggaaggcagggttggggggcggggcaggggcaggggtctagggagggccggatctaagagcctgggggagggggtagatgggggctggagaacgtggggctcagtggtctggaggagggccgggtctaggacccccaggggggaagggggcttctaggggctcagggaggtggcatccaggggtctgggggaggacccagtctaggacccccggggaggaggtggctgagagctgggggaggtggggtctaggagtctaggggagggcagggtccaggggcctaggggagggtggggttctggggaggcaggggtccagggaaagccagcctcctccctgggcctcctccccgagtcaccttctccccctagtatggcacccgggccctgcactgtgtcctcaccaccatcctgagccagactgagaacaaagtgcctgtgccccagggataccctggaggggtccccac

SEQ ID NO: 90417 - DNA, 1067 bp, Homo sapiens
ggtcaggattccagtccaggctgagcagccacctctgggtcaggattccagcctgaggctcccccggcctcctggcggtcaccacccaccccaggttgtagccctcagtccagcccacctgagcccagctgctgctatggtgcccactttacagatgggggaaactgaggcccagagaggggaggtcaggggttataccactggtcagaggcagagctggggcttggggctgggcagtccctacccctgtggaggcagtgaggtcacagtgtttggtccgcgacaggaggcttagtctcgccccagctggtctcagggagacaagtgcagaaaagcagtcctgggccacggtgccgggcttccccgccaccctgccgtccctcagggttgccccgggccccttgtccttgccctccaggggccagccttgagttaggtgggccctagaaggcagccaacatgtcctgccctgaccctccacctcctccctaggacccctgtgcctcctgcagagagacccgcatggccccggggtcctggagcgggtggagcggctgaagcaggatctgctggacaaagtgcggcggctgggccgggaactgccagtcaacaccctggacgagctcatcgaccagctgggcggcccccagcgggtggcggaggtgggtgggacgtggcagctggagtgtggtgggcggggcatgggcagtgggtggggcttcacgcaggctgtgtgcagctctggtggcccctgctggtcactctgcgtctccgcggccctgcgaggagggggcgtttggggagccctggggcagcagcgtgctgtccagctcggcccgggaggccacgacctcctgtggacggcctgccccatccctctaagccccagatcccccagcctggcctgcgcaggcctctgcttagatcgttgcctgaacgcaccccttggggtgcccagggccaggacacaagcccctgggcctggttctgcggcctcctactccctgcccccgcccagcttcactttttcacttcgtggcgccggctggctgataataccaggcctt

SEQ ID NO: 90418 - DNA, 1359 bp, Homo sapiens
caccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggcccccaatcccctaagactagccccttggc

SEQ ID NO: 90419 - DNA, 1122 bp, Homo sapiens
ccagcccctggaggcccttgagccgtctgctggagcccctccgagccccgaggccacccactgagaccggctctgggagtgggagtgtccggacccctgaggcgctggtgctgattgtgccttgggggtctctgcacagctcgggtcatctgggcgcctggcggggactggggctgccccccgatagcctcctgggctgggatgtgctcagggccccccagacccccttctggcctttgctggctttgcagccagcatccatctggtgggtgctggcttctgagtgccacctgggacacaggcctcagggtggaggggacatctgtcaggcttggagtcaggtcagcctgcctgctcctagaggacatggctgagcttctgtggtcacagccaccccttgcacggcctggtcccagctcctgagtgtgtggcaggtaccctgggcccagaggagctgggtcggaaaactggaccgccctggtgccagcctgacaggcgccactgcttctgggcgtttgcagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggtgagtctggcgggggcccctgcccggctctgctgactcggccaggatgtcccacgggagcagggtgcctgcctgtctgcaacaaggacagcttctgccctctggtggccaatcccacgtccccaaagcctccagcccacctgcaggctgcctccgccctgcgggccgctgggacatggctgaaaggtgtggggtcagcgggggcaccagcccaggcctgtctggccaggagggttcctcaggcgtctctccgggtgctgcccagccaggcaccacccaccggccttggcctgagtcccagcaggagcaggcgggggagccccagggtcgggggagggtaggtgagagtcagggtgcagggtggcccctcagacagctggcatgagagagggtccagtggccctccctcccgt

SEQ ID NO: 90420 - DNA, 1049 bp, Homo sapiens
ccacctcccggagtcgtgacccgggagcacgcgcccagcccctgcaccctccctggcgcgcaggcagcgggaggtctccctctacccaaccatggccgggtgggccctgccagggtgtagctgaacttcttggggtgggggtagccccccacccccgtgatggggcggacagggcgtctggagtccttctcgagccggctgcaccgccttggcgtccccattcctccgagtgcttgccctgcccagcgctgagctccagggcctggcgctaccttgcaggacaggccgcaccggctgtgtgcagttgtgatgggtacaggcgcaccctcagagggccaggcctcctcccccgccatggggatgggagatggaggtccagagagagcccccggggcccgctgggcagagccaagccgggtggaggctgcctccggctctgctacctctccatgagtcactgccccctgtgtgggctcctgctcctgcagggaagacccagcttgtctgcagtggctcctgcaggagaagtaggtctagctggagctgaccaggcttcctccccacagggccctcctccccagttcagaatgcagcccacagccaccatggccacagccgccaccaccaccaccaccaccactgccacagtagccctgacgacgtcgtgggacaatgccactggacgccccacggtgggtgcaggggacaggtgggaggggcaggaggtcgtccaggccagcagcacctgaccccccctgcacacccgcaggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacaggtgcgaggcccccacctcggctgggcaggtgcatggtggttgtgggtgccatcgggtggtggggggtctacctcactggcttctgagtcacagggtgggctatgcctctggagactgggtgatgcgcagggcttggcttg

SEQ ID NO: 90421 - DNA, 1050 bp, Homo sapiens
ggccgctcgtcccggcgctgaggtaggcgcggcgggctcggggctgcggggggcggacgggggacaggccggggatcgcagccggctgtgggctaagcggccggagggagggcgcggaggagtccggcgggcgtggggaccgagatccgggccttgcgccccccacccggctgcctccagagggacccccgctcaggccccgccccagcctcagtttctccctgtgaggtcgggcgaggacgatggcgtctcggctcagccctggcgtcgggtccctgcctcccctggctcgccatccccacccttggccggctcgggggcgcggtgctgccccgtggggaacctccgccctcggctcccgcagccgcctcccccaggagcccccctcttcccctcggcctcctgccatcttccccggcctccggtcaccatcctgcgcctgtccccaccccctccagcctgaactcatttcccgacctacatatgcggccccttcccccagtaccagggcccgggcagcctgtgaccgggagcgctgaggacaccagcccccgccgggaccctgcccggctttgggcctcagtttcccgctgtcgcgtgtgggcggaagtccgggaagggcaggagcggctgccgcctgtgcgctcctctcgctccgggaaaggtctcgcgcgtgcggtgctgacctggggccgccgagcaccccggcgccagccccgaccccctgcgattcccgggcctccccacccggctgcgccgcacagcgtccaggcggctcctttccctggtgccgcgccccgcctcagtttcccccgagcgtaaggcggccggggatgctccgggcgcccgggctgggcacggcggggaggcggccgcggccatcttgcggcttcgcgcccgcccccccgaggccgccgcccccccccaggccgccgcccccgcgccccctccccgccgctccctggcaacccgcccccccagccgcggcctgctccgcagtcgccatgggaaccagcttctccggggctgggaacagatgcgccttctttg

SEQ ID NO: 90422 - DNA, 1059 bp, Homo sapiens
agatgtccttcaccttcgcctctcccacgcaggttcgggcgctgcgggtcgggaccctccgtggccgccgcccccggagtccagggtccccacccccagggcgcgacccccgcttccgggcccccggacccgcgcgccccggaagccgaggctactcagccctggaccctcggccctgcctctgctgcccgagccctgcgctgccctcgtcccgggcacctccccgagataagcgtctcctgggtgccctccccgatctccctggccaaagcctgggtgtcgccggatcgttgcattcccatttcgcggatcagtagaatgaggcgcaactgttgaggaccaaagctgcaacttcggatccctgcgctgggttgtctcagtgcctcacatcagcgccaggtcctgccctgacccattacttagcaggacaggccgagtgcccggtgggcgcggggccggcctgccccgccatcattccccacgctgttgtctgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttggtgagtccggtggagggctgcagggccaggccaggctggggctccacatcccaggtcagtctccgtctcagttgaggctgcgagaaaaaatagttttaggccgggcacggtggctcaagcctgtaatcccagcactttgggaggccgaggcaggtggatcacctgaggtcagaagttcggagaccagcctggccaacatgatgtaaccccgtctcttctaaaaatacagaaaactggccgggtgcggtggctcccgcctgtaatcccagcactttgggaggccgaggcggggggatcacgaggtcaggagatcgagaccatcctggctaacacggtgaaaccccgtctctactaaaaatacaaaaaattagccaggcgtggtggcgggtgcctgtagtcccagctagtc

SEQ ID NO: 90423 - DNA, 1267 bp, Homo sapiens
ggtgggtcagagggagggcctctgtccccaggcagtgcttttgggggttcctccagcttctagtcctttcttgcggcccctgttttgttcttctctagcagttgcccgccatgttgggcccagggccagtcctgtgggtctgtttgcacactcaggacacagacttggatgtttgtggagctcctggttcacagggggctctggacttgaccaggggagtccctgaggctgtgcagccctttggggtctcacgccttccccccgccccattcccccagtgagcagcggttccatcgcagtgaacgccgactcttcggtgcagttgttggccgaagaggccgtgacgctggacatgttggacctgggggtgagtgtcagaggggacctgaggctcagcaggttggagctgtccaggctgcgggggagggagcgctgggggaccaggagccgggctggggtcgctgctggcccctcaccgcccctcaaccccttgcaggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttaccatcccctctgccctgcagagccagccgccaaggttgacctcagcttcggagccacctctggatgaactgcccccagcccccgccccattaaagacccggaagcctgactgtgtgctcggctcttgttcctccacctggcccggtgaagccgggagcgtcctgggcccctgctcacgtcctccatgtcccttgcaaatagggcctttgagctcccctggactatgtcccttagggcacctggaggtccgtaggaagcaggctcgagggggtgggtggggtgcagccaggcgggcaggctgctgaccttcaccctacaacggtggggagggtgaaggtcaccagtgatggggacatcggtcagggaggg

SEQ ID NO: 90424 - DNA, 1003 bp, Homo sapiens
tcccaaagtgctgggattacaggcgtgagccaccgcgcccgaccgcatcatcttttttatgtgacaaactcctagtcattcctcaaaccgcagcccctgtgacccccttccaagggttatcccagcctctccctctctggcctagccctgacccttcggggctgggtgtgcctgtcaaggtgggggccacggctgccgggagcatgggtggcagccggaaggagacctggggaggagcgcagccctgggaggggcgcccatggccagggtgggggtggaggtggtcaggccagataaagggaggggccagatgagtggacaggaggtgctcccgtaggaatggggtccccttctctaaatagaggggcaggacggggcccacctcaaccaggaccatcctcaaaaagccgacggggaagggtgagatgcacaccacattcgtgtctcattggctgtggcctcagtttcttcatctgtaaaatggggtaatgcccaccccaaaggctgggaaccagtgcatgtcctgcattaatggggggtgatggccccaaagtgatcctgccgcatcccctcaccacactcccacccaccctggagaaactgaggcttggagaggccagttacctcccggggtcacagcatagccggctggtgactggctgggcacaaggcaggcctggcactggctaatcgctccataaatgccctctgaggtcaccattgacagatgcaggaggccagggctggccagggcacccccactctacggcaggtgactccagcctgttttcctggacgacagccgctgactcaggcccctcttcccgtcccccccacgcgggcgcccccaggcggaagcaccgggcctggggcgacaggaagggggcggggcagcgagtcgcgctgtacaccccaaaaccctgtcccgctgacgattcggggtgcatctcagcccgcggcgaggcgggccgagacccttggctcggggcattcaaggggagtc

SEQ ID NO: 90425 - DNA, 1041 bp, Homo sapiens
atgagcctcgccatccacagcaccacgggcacccgctacgacctggccgtgccgcccgacgagacggtggaggggctgcgcaagcggttgtcccagcgcctcaaagtgcccaaggagcgcctggctcttctccacaaagacacgtaggtaccgcgcgcccccggccggccgccccctcgggccccggcccccgggcgggaacaaagagcgcgccgcgcggggaaggcagggggcggccagacagggggcgggggcgcgccgcgcgctctcgggcgccctctgctcggcctcgcctgcctcggccccctcccccgcccggggtcgccgcacaaaggcggctgcgagggcgtcccgggccgggcttcggcggccccccttgggggcgggcaggaatcccagggcgttgcgggggtcccggctgcgggtgtgggggccgccaccgccccctcccgcctgcgtccgcgccggcttccgcatctgctcggcggcctcctctgcgtctggctgtctccccccacttgcgtctctctccccccctttgttctcgcctccgagcgctccccgcagcctcccctcccccctggtatttaaatcgcctgcaggcccggagccctccccccgcgggcctccggggacacgcagtgtccatcccagtggaggggcccatcgggggaggggcggagggggagggtctcctttgtctgcgcggcggcggccgcctgcgccggggagggaggaggagggggagcccggcccggcgcaacccccagggcctctcctcgggccgaaacccgtggttcctacaaagaggagccaggactagaattagggaattgggggcaggggctgccctggggtcgtgggggaaggtggcatagagcacactggggcccagaggaggagaaagtgcctggttggggtgcagagggggtgccagagtccagggcgggggttccactggagggaaggggtccgaatcgccaggatggggctcccagcaccagacggagacctctctgcacgcgcttagggccctggatc

SEQ ID NO: 90426 - DNA, 1431 bp, Homo sapiens
tttctgactgagccaatagtggttggggaactcttgaaaaaggggagagaatggctgggtgctggggagttcccccctccgagccctccttcccggcccaacctgagggatgtggatttgggactgtctgggggcccctcctgcagcgaggatgggagggggtgctgagctgtgaatcccctgggcagggggcgacaactccgtgtagcattaacccccgtggcggggtccgctgctggtctaatttggaccccctgcctctcagtgcccctgccctaggggtgtctgtctccagaggggagggacaaatcccctactggggccatttcaatggggtagtttttggatttttttccccactcactttttattttttaatgataatggagatgtctggacccttcctcaccccacctgtcggtcttgtcctggctctgcctgtcccccaccgttgttctcgtaggtgaaccccaggtcctcaactccccccctttatgtgttgaaagttaatggtttcagatgtgaacatcacgtgttataactgtagcgctgtaaatttttttgtgggagggtgggcagggaggggtcccagagggtagagctcaaggattttgggttttgttttgttttcatttttccaaaaaaaaaagaaaaaaaaatagaaaaaaaaggagtaaaaggggcgggtttgttttttgaagaactgtcttggatacctatttaaatgtgtgttctgttttgttttttaacgatttttaaataacgtctgtgcctccactggttgagggtggaacctccaggcaggaaccggctcgccaccctctgcccggtaagggctgcccaagaaagcattacccgccctcggggggtcgggctgtgggggtcccggcacctggcgtgagtttcatgtatgaaaacataaaattgaaaaaaaaaaaaaaacctacacgagcaccgtgatttcaagtaataaacagaaaatgaaacacacattgactcccgcctgctcgcctagtggggggatctggccttggttgggagggttcctggggtgggatgtcagctcagggagtcagagggactgacctgggtcccaaggccccgaagagggggtggggcaggggtcagggccctgagaatttcccacgctccttccccggctgccgggtgggcaggaagcagccagggtgggagggaggagcccagccacttcctggtacccaaggccggaagtcccttagggtgtggggcgagggcctgcctgcctgcttcgtggcctgggcaggaccctggccccctcaggacctgccagtatgggggagacgcgaccaccagctctccccagccacaggagtcggggactcccactctgccacacccacctgctccccttcctggagtctcacatctgtgtggcttgctgcagggaga

SEQ ID NO: 90427 - DNA, 3506 bp, Homo sapiens
gaggtggaggctgcagtgacccctgcactccagtctgggtgacagttagacacactgcccccgaccccaaaaaaataagtcctaggtatgagtttgagataatgaaaaataaaaatctgattttctaatatttcccctaaaaaacacatgtcatttacataaaataggaagcggggagaggtggtgagagatgacccctgttgaggatttcattggtgtctgccacaggccgccatggcatcagatgaaggcaaactttttgttggagggctgagttttgacaccaatgagcagtcgctggagcaggtcttctcaaagtacggacagatctctgaaggtgaggctgctgctgggcccgcggccctgggcgggggggcttgtgctcctcctacctggaagtacagctgggtgctgactgcagacctctctcccctgcacagtggtggttgtgaaagacagggagacccagagatctcggggatttgggtttgtcacctttgagaacattgacgacgctaaggatgccatgatggccatgaatgggaaggtgaggatcagggtgctgagcaggagtcccgtctcgaggatggggcacccacctgctaacccgtcccgccctctgtctccagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggtgagtgccatgagtgggtcccttggggatgctgtgaggtactgctggtgggagctggtactcactttttcctgtatgtgcaggaggaggggaccgaggctatggggggaaccggttcgagtccaggagtgggggctacggaggctccagagactactatagcaggtgagggggaggccggcccaagcacaggggtggttgcgggatggccagcttccgtcccgggtcccaggtccctgggggagctgagatgagactggctgggcaaggagcagaggcaggtggggacccaggccaagaggagaggagactgctcaggacattcgcagaagcgggagggcctgggggacaggctggtggagattttgaacaatttccaagatgctgccctgctggggtccttgttgtgtccccagaagggacggctggcatgggggctggcggctcagcctgttgtggcagagcagaagtagacgggtaccttccggtactcaacgtttgtctgtcttgcagccggagtcagagtggtggctacagtgaccggagctcgggcgggtcctacagagacagttatgacagttacggtaagtcacactccgagggcgccacgctgctgtggcctgcggtgggagctcggttcaccttggtgccctctccaagcactttaggctggacactcagaccttgtcactgtgcttgcccagaagaggcgcatctgtcctctcagagccatttctatcgcaggacgcaaaagccaaatgagactgaccaaaaaggcaagggagagcgagggcccgctgggcagtcagctaggtgcatgtgtggccgcaggccagcctccctcggctgtggggggtggttgctccccggccgcaggccgcgccctggtctggcctctggggtgaagctgcctcttgttgcttcggtgcctttacactgtgcctgcttcttgtcctcagctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgcctttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggaccccggcgggtgtggcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgaagccgattaaaagaccgtgtgaaatgaaccttgctctgacaattcccttgcattgcaccacacactccttgctgcgggctcctgcagccagacctgagcagagagagaaggtggagaagcagcgggtctgcaagccttccctggggcctgcagagctagaaagggaggcccagcagactggcgctggtcagggtaggggagccaggcgggggacgggagcgggcagctcaggcctcagggcagccctgggaggcttctggcagtggtggccagagggctggactgtgcgggcagcttagcagggacagtggacgtgcacctgacgctgacctggactgcctcagtctagaagcaggccagagagcagaggcacgtggcatcccagggcgacctcagacggccagccggttagctagttctgctgttgcttcacgagttctgagcattctctgctagcctatggaagctgcagccctcggaggacagaagtgttgtgcgcccaacagaaccctctgagacgcaagctgctcccttggctagctcatatgtggaaatagccctgtaattcgaggtaactccttccgctcgtgtccacatccctcttgttgagagctcactgaaagtcatgtgcccggggaatgttcctgtgactgttttttgtttttccttttttttttaactttgtttttgtttttttcaattaagctggaactaaagtcaggcccagccattacgctccccacgtgcagccaggtgcagcctgggcccagtcatgcctggctcatagatgaaatcccttaagcaggattgaagaccagtgaacgcccccgccttttggattttttgctcaattgaccgtcttttccagacctctttaagtcacactcttaacttagctttctctgatgtctgttgccgccattagtttttttctagagcccacactggcccacatagctccatcccatacgggtagctggctccagctgcgccaaggtgcagacccgccctgggcatgctggcctgtgacggagcctgaggtcacagccccctgactagcc

SEQ ID NO: 90428 - DNA, 2113 bp, Homo sapiens
ggcagccaaaagagcagtcgtttttccgctcttatttttgtgtgtgtgctgtggtcaactgttaactccccaaattggggagggttgtgagctttgattgtgtaaaatgcctctcctgccgaggtcggaggcaggtcttccgcacggagatgatttattcaggagccttttaaaactgatctagatagaacctttgggagggactgtgctgtattttatttatgaaaaaatgcaggcgcctccctggataccgagccccgtcgtttctgtttgtcagtctgctttttggcattgagcatctcaatgcaagattgtggaattaaaccatctacttgaggctaagtcgagctaacctttgcccctgagggctgtgtctgcgttaacatcgccagcaaacagttgtataaaccaccgtgcaaatttcgttccaggacacattggcgtgagacctgggagtacgttgtgccaaatcattgccacttgccacatgagtgtaaatgatggcggatgccaagtatgtcctctgccgatgggaaaagcgattatggcctgcgaaggtgacagccattattctgtaacttcaggacttagaaatgactttcgggtgacaagtaaaatcttgatcaggagatacctaggatttgcttcagtgaaataattgagccagaacacggttggcactgattctcgttccccatttaatggggttttggtctagtgcttccaaggttacacttccagaaatgtcttttttttttcacactaaaaaaaaaaaaagaatcagctgtaaaaaggcatgtaaggctgtaactcaaggaaagatctggcaagcagccctgtgatagtaaattatggtcgtgttcagggaatgctttccagcaattcagtagacagtgctcagctgcaatgcaaaagcccaggtccttgtctttgtctgccactggcctctcatgcctcagtttccccatctgtgaaacaatggggattggaccaaatatctgaaatcccatggttataggccttcaggattacctgctgcatttgtgctaaagtttgccactgtttctcactgtcagctgttgtaataacaaggattttcttttgttttaaatgtaggttttggcccgaaccgcgacttcaacaaaaaataagagaagaaaggaatattttctagctgtgcaaatcctctctctagaggaaaagttaagtgttgtgttgttttaatactgttttttcccgtgtagatttctgatacttcaatcccctactcccccaaaacagttgaagcccagcccactcttaatgggcttattcaccatttgtgtaattcattaatgctcataataacctcatgagaaagcaactagtttgattttatgtcagtttggaagctgaagatccaaacgaggcattctgtgagatctatggagagattggtacaaacactgaatacatgtaaattatactcagggtagaccctatttgtggttaaaatagggatatttccttttttttttttttttttgactgtttcttaatcagtgccatgccaggaaaatagggatgtttccttcccagagatctgtgtgtcttttttcagaaacgtctgtgacaggcccatcaattttgaaatatttggtttttgagcctgtcactctaaaccagcgtttaacgttcaaaaggcaaataactgatgaccaggcggcacattgttctgctccgtgagtgtctggcactgggaaaggtgtagattgtctagaatgacagcaattccgacgccccagtcagtcctgcgtgattgtggcgagggcgcgtctggcaccgggaaggtgtagatcatctagaatgacggcgattccgacgccccggtcagtcctgcgtgattggcgagggtgcatctgtcgtgagaattcccagttctgaagagagcaaggagactgatcccgcgtagtccaaggcattggctcccctgttgctcttccttgtggagctccccctgccccactccctcctgcctgcatcttcagagctgcctctgaagctcgcttggtccctagctcacactttccctgcggctgggaaggtaattgaatactcgagtttaaaaggaaag

SEQ ID NO: 90429 - DNA, 1053 bp, Homo sapiens
ctcgccctgtgattcgaactcctcatctcttccccgcggagacgtgttgggcagttccagacctcacaggaggaggccatgtgtgcaacaaagcctgtcaagttcgttcacttgtgaaaaggaccccgagtgcaaagtggaccacaagaaggggctcaggaaaagtgaaaacccaagaggcccgttggtcctcccagctggaggtggtgcccaagatgagagtgggtccagaatccaccacaaaaattggactcttgcaagtaagaggggaggaaactcagcgcagaaggctagcttgtgcctgaatggatcttccctttcagaggacgacacggagagagacatggggagcaaaggaggcagctgggcagccccgtccttgccctccggggtcagggaggacgatccctgtgccaacgctgagggacacgaccccggtctgccgttgggcagcctcactgcgcccccagcccctgagccctcggcctgctcagagcctggagaatgccctgcgaaaaagaggccgcgcctggatggcagccaaaggccgcctgccgtgcagctggagcccatggcagcaggggccgcaccatcccccgggccggggccagggcccagagagtctgtgaccccgcgcagcaccgccaggctgggcccgcctccctcccacgcctctgcggatgcaaccagatgtcttccttgcccggattcccagaagctggagaaaggtaaaagtttctcgtggaggaggagagcgcagagggtggagtcctgctcctccgcagccagactgggagccaggcacgtgggtgtttttgaccagattttaatgagatcgttgccaaaatagacttagagcagagacttcctcattcctttttgtctgtctccccactgggctataattgcttcaacttctaaatatttgtcttcttatttttgtttagaagggaagggagttgagtgagtggggagcccgtagaggggcggcgggccacgattgtctgcggcgcggctgggagcattgtggctgtgctgaggccgcagctgcgg

SEQ ID NO: 90430 - DNA, 1282 bp, Homo sapiens
accagcccaagccttcgggtccccggtgcccacctgcgttcagaccagcccaagccatcgggtccccggtgcccacctgcgttcagaccagcccaagccatcgggtccccggtgcccacctgcgttcagatcagcccaagccatcgggtccccggtgcccacctgcgttcagatcagcccaagccatcgggtccccggtgcccaccatttgagcagctcagggcccagacctgtgcctggtgcgtttcccatttaccagagggtccctgtgcgaggcgtctgccagagccccctttgtcagggagggtcagaggtgcgggctggagcgtgagcagcctggacacctggctggtccctgggctctgcgtggcttctgaacccagggtgcttggcactgcctcccactgacgcctgctgcccggatctcattgtagaatcaagccagggaggacttcaaccaggacatcggctggtgtgtctccctcatcaccgactacagggtccggttaggtacgtggggtgctggggaggggtggagctgggcagcaggcgtccagcctctgaagaccccttggacgggctgggccggagctgcctggaggcggggcatatttccgtgggcctggggcattccctgtgggtgggctggggttctggcctggcctgattatttcctaaacagagacgccgggccagcccctggaacacacttcctgggactcctcttaggtctacacagtgctctctcccctccaccccctgcaggctgcgggtcttttgctggctctttcctggaatattacgcggctgatataagtaagtctacaggcacatcttggaaaatgtggtttgccttttagccctttagaaaaacaatcttctatgtctgaagctgtggaaggggacgttggggtcaaggcactgtccgcagccacacagcattgttcaacctctatgaggttttgatgtgaccctgaggctccctgggacctggggctgctggtgtccactggcacagcatcccgagcctgccctggggccctcatcccatgggccacatccagcgtgtccctgctgtggctggtggctgcacacatcagatgttgtgaagaatgtaggccaggtgcggaggctcacacctgtaatcccagcactttgggaggctgaagcaagaggattgcttgaggccaggagttcaagactagcttgatcaacagagcaagaccccatctctacagaaaaatagaaaaaaatgagctgggcgtgtggcttgcgtgcctgc

SEQ ID NO: 90431 - DNA, 1094 bp, Homo sapiens
tgtcccccgcagggcagcagccagtgtgcaagtgtgaggcggggtgtcccccacagggcagcagccagtgcgggggccctggcgcaggaaagcggcaggtgccagtgaagatcgccagggcggggagacggggcagcgtttgggttccttccggggccatgcagtctcaagcaggggactaagactctctcgtgttctgaaaaccccctcgttacctaacgtttgttaagtggcactcgagttgggatcagagctaggctgtgcgggcaggagcctgatggggaagcgcctggaggccggccctgcgtgctgcccgcagctcactgttcccaccccgtggtcctctctgcagctcctggcctgcgcggcttccggatccttggtctgcggtgagtgcctgagtctccagccctcagctgggaggggccttcagcagcgacagacgaacggggcggggggggtggggggtggggggagcgccttgttgaaggtcacgtgtcatgttagggacaggatgcaggtgacggtctgcacgctgcccgtgatgtgccgggaccctccctgggacagtccacgcagtggcaaaggctggacagtcaggaggaaaaccctgtgggcccggctcagtgccgtcagagctcaccgccacctggggtgggaaggcattctctgagccctgtgcagatggcagctggggcaggcctcctgcagacccaggtgactgacagggcggtgagggcgcatgcccagggatcttaccttggtcatgtgtggagggcctgctgccagtttccttctgtggatgatcctgggaccgtccttgcttggacactgttgacctgctgggtacgtcacaaaagaagttccattcaagtctgggccatcattgggggtcggggcgatggccgcatggctccagcggctctggccagtggcccaagtgttgacaggcagaggtgagaacagtctcgcagcagggaggggagaggcaggacaacagtgagtgcggctgggggagctggaggggcctgggacagccactgacccgcgttccatctcccggcagctccagcgtgggcccggctgtgcaggca

SEQ ID NO: 90432 - DNA, 1038 bp, Homo sapiens
gttaacgcagagagttcccggttagacctgcgctactactcgcctgtagcccacgcgctcagagagtggctggagccccctgttgaaatggtgggacttaggatacactgggttcgaggaactatgtgatgaggacagatctcacccgtttctctctattttatgtatttgaatgtggctggtggggcgcgctttacaactcttggggcccggaggccacctgcaggagccgctgtgcctctcacctctgccggctgccgccccgggacatgagtcgggggttctgggtgctccacgtggagtctcacgctgggccacgcggggctccgggggtggcgtctgacccgagcccggcctccgcagagttctctgtggcccatgaccttcggcctggcctgctgcgccgtggagatgatgcacatggcagcaccccgctacgacatggaccgctttggcgtggtcttccgcgccagcccgcgccagtccgacgtcatgatcgtggccggcacactcaccaacaagatggccccagcgcttcgcaaggtaggcctcgtcccagccgcccagccgcccccagagtgagctgcgcacggaccccgcctctcttccaggtctacgaccagatgccggagccgcgctacgtggtctccatggggaggtgagtgcagggcggggggtctccagggacagacgtagcgtgagtgctggcctggccgtgccctgatggcgcttatcaaaagtgtcatctacattcagtgaaatcccacgtggtcccggcgctgcccttcagccgtctcggtgcctccaccctaggcagatgcgctggtgggcctctccccagaacgattcctcccatccacccccacgcagcagaccccacattccgcccagttctctgctttactcacacataagtgatgacaggtgctgtagatagttttataatctcagccttctcacttgccattagttttttttctttttttttttttttttgagacagagtcttgctctgtcaacccaggctggagtgcggtg

SEQ ID NO: 90433 - DNA, 1034 bp, Homo sapiens
caagttacagggaagacctcaggctgcaggttcctagctccgggctgaggtggcttgtggaggcagacagctgttgtctggaagtgcagagggctgggggctggccaggctgttactgagttcagaataggaggaaagagtgtgtagcaaagtcggcgctccttggccactgccagcattcagagttgtcttgtttgccttgccttaaacgttgccttcctggacgcctacaaagtcaggttgtaaccgctggccactgctgtgctcactggcagcccctgatttacgtgaggacctcaagtgtgtgttgggcagaattccccagcgcttcccgtacaccccccacccccagtgcagcatcgctcggtgcgtggctggtggactggaggagtgtgcgtgccggcagcactgccaggcacgtgcctaatgctctggccctgtgtgtttgtgttttcttcccgatttctgagcagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacgtaagtgcccttccgggagctcacacccgctctctgtctcccctgtccttcctctgcttcattttttcctggactctgaccgatgtttgcgttagagtatgtttgaacgtggggtcgattgggaaggattaagccttggtgctgaggctggatattgcaggaggatacagggtgaatggagccggcggggcggggcgggccgggctgctgtgccgtggctgctgttgtgctgacaccctctttcctagagaaacagcctcttattcacaaccagctgatttgaaatttcctgcagatcgaccccaagccatgcacaccccgggggatgcagccggagagaacacggccgaaggaaggatgggtaaggggctgggccgggcggcctccttgtgtg

SEQ ID NO: 90434 - DNA, 1036 bp, Homo sapiens
gtcacctgctggagatgtacagcctgaaatccagcttcctctctgctcatttcgtcgtcgctgctgcctttcccctgccgtcctaaagtccctgccttcacactggagcacttttccacgtggcagtggttgtaattcggaatagctgaggcaaggcacgcactgtgtcgtgggtccgtttagctgaaatgtagctctgcagaaatgctcaatccctgtctccttgggtctctctagaaaagtgagaaagtgtctcagcagagcccagtgtctttggacttagcgggcttgtggagtgttctgctctggctttcagctgactctttaaaccagcgcggattggcctttatgtcctccgcagctcgcgggagggtttggagggttcccgtgtgaactaactatccttcccttcttcaacagcagaaaggacccaggagcgataacagtaaatcaaataagatatttgtcggtggaattcctcacaattgtggtgagacagagctcagggaatacttcaagaagttcggagtggtgagtttctccccaccccggcagcactgtggggacagagccgcttctgctcaggcctgggccttcttggggctggagtggccgagccacaggtgcacgggcctttcaggctgggagctcgctgtctcgtatttccccaacgcctgcgccctccggaaaggtggaaagcccggcctttgccttcatggccatttcgtgtcccagtagggtggttgggcggtgaaccagcctgacagccttcagggcggccgcccgattccattgtgaacaccgtggggtccagtgtcagagaagggcagttacacagaaacggggttcagtgtggcctgggcgagccagccccacagagctgactttccactgggcaggtgggagaatgcccgagctccgttgagcccagtgccagagggagctgggacagccggagggggccggcggggagccctcctagtcacccaaggcaggggcgtgtggtcaccccaaggtcctgctgggactcctgccg

SEQ ID NO: 90435 - DNA, 4061 bp, Homo sapiens
tctcccctctctgaagtcagcagggcaggtgggaggaggggtgaggagtcacctcagggcctcccctcattttccctcagcttcttgcacacccatccatgctggtttgtggagctgggacgatgggcgcccagtttctgtgccccttttccgtggctgctgctgtctgtcccgcccgcccgcatggttttggttcatcagctgcttttggccggccacgtgagcagacctgcagcctgggtctgcccgccacgtccgtgccgcccccgcaccaccggcccaggtcagtcggggcagccccgagcgccaggtggcgccgcagcatgcccaccatgctggagcatagtttgccatttgaacctccctccccacggttaggagtgctcctcctccatgtcggttacgctgttaagtcttagtcgtaacttaatttagacatacatgcttagtgacgtacttaagtgtttcatagtaaagtacagtgatgttaagtaagctgtttttccttttctctctgtgaattgtgtgtgattaacgatatctctttagatttctcttctccaggtgctaaattatatcacacaggtacaggccagtcccgcagtcagaggagggagcggctttgctccagtggggtgtaaacgaagtttcaggtgtttctgtcccgcttcctcagtggtgatgtcgcctcttgacagccgcattcctagacagcgctcagggcgcctcccccaggacccagcgcctcttgcactgtgcccggaccaggcgagccctgtggtttcagacactcctgcagtttgcgaaaatgtctacttctaaatacgttgtttcatcaccgatgctgtgttccaatactgcctctgatcttgggaaacttgagcgcgcgggaatctgagggttgcttctagatcctcccggtccccctccggctgcccagagctggcgccccttctcctcgcgtcctgtcctgtcccgtgtggacgggacgtggcgagtgtcgctgagtccacactggtgtacagagcacttcggggccagcacgtggccacatgtccttagctgttgggctttgaaagtgtcccttgggtgtcaggcgagtggagggccggagagacgctgcggcgctgcttagcgggtcctcccagagagtgtgtccccttcccttggcctttctgcatcttctgagacgggtctgtgtccccctccccgccacctcctccctcttcctctccactgactgaaggtcatggccatgtccctgtcagggaccccgcctgtgtctcgggcacacagtgtctgtgcgggtccctgcttggccctcccacgtctaccctcggcccgcccgctccagccgctgcctcgttcgcctctcagtcccctcaggtcttctccatcctgcgctcctctcgctgtgtgccttgccttcctggtccctcctcctcttcctcctcctcttccccctccccctcctcctccccctccccctcccccctccccctccgtctggttgcagacactgcgtgcacagtcacgctcaggtgcacacgtgtgctcaggacggtgggaggctcctgaaccacagtgacctttgtcccctcacagtctgagctgccctttctgccccgtttccatctttccccgcccccagttttgcttgtcctgtttctgcctggtcccagctacagcagccctggcccctgtctcttcagcttgagaggccccacagtaggctgctccttccgggggccgttgcctgttcccaccccccacggcccttctctgccgcgctcgttcacgcctcacgcccgtgctgcgctgtcccctgctgtgtggtgccttgtcacgcaccctgtgcctctggcgcgggcagcccatcttcagcccggtctcagctcttcccatgtccatctttgttctgtgaggtcttgggcagctgtctgccgggcacttccatctggggaggggctggtgccgcctgggccccgcctcgggaggacggtgtgctttgcggtgtcacgctccacctagccggggaggcctggagagcccggcgcactcctgcgcctagaggaggagacccgccccgttagccgggggccgcgcccaccccagacccactaaacttcgtttatactgccactcttgtgtttgggaaatgctaaattttttttgcctttaaaattttctgttttgatcccatggtgcatctcgctcttgctgctggcagcagagtctgacctgctggaacccgttgtggcctgtatctttgtgcattgtttctctacctgtatagaacatgcatagatgtctacgatatgacctcttctaggactccttgggcttacccaacggtgttgcgtaagcctagcgaggcaccagctatgatagatactgtatctgttaacgctttagaacgatatatggctgctgtcagcactagctgcaaagcaaattgcaagccaagggggagaatcctgggtttcagagaagcatacacacatccacggtgcacacccctgactaagatggcgcattccacgcgggcccccggcctgcagggttcactggcaatctccccacaggcgagagccagaatattcaagcacgggcctctgaccctcccctggggggcgctttgtctgccagtagcgatggaggccctcaccgttcccctgtctccgctgctgttttataagatgtgctccttgttccaaatctttgtgacacggagccccagcccggggtgtctggggcggaggcttgactcaggcctcagtcagcagagccgtcaccgggagtgcggacgtcaccgtctgtccactccgtgtgcagtcgagtggtggctcctggggagggaggcagctgccccaggggcccgcagcgccccacacacagcttagctgaaacccaaggtcgatccctcggcccgtccctaatactgttcatcatcctgttttgtgtcacaacaccctgctaccttgattcactcttcgtcgttggctaggttttggatttattactttcgaggacgaacaatcagtggaccaggctgtcaacatgcattttcacgacatcatgggcaaaaaagtgtgtagttgtagttttattttaccttaagaccaaaccaagtcttaggcaacttaggggtttcactggaaaggaacattccttcacggaaagggtcgggcgagttcgtcctgtgaacctttgctgcgtgaggtgggcctgggtctgtagacgtgaggagggtcccatccttccccagcacccttcctgcggggtggggatctctcagctttgctcctggagcccctccctctgggtgacctgggactgggcgggtagggggctggggctgggaggctgtggcggtgttggggctggctccagtgaaaccgcagcgttgcctcaggcttggtttccacgaccactccttcagatgtctgcaaatccccattgtctgacactgacctgtaatgtgatcagcaagggacctttgagagccgaggttccgcttaaaatggaaagcacagtggaaacatcatgaaggactggttgtttgaattgggtcacttactgtggaactccggcaccagccacatgctctcggtagtactcagccaccatgcagtcaagtgacctctggttgtgtcatcttcatactgtgttacccccggaggtgagagggacaggaggccacccccccaacccccaggccagcccttggaaggcatgtgtcagaaaggggtccctaaatccttgttttacctggacccttggaggttcttgagaagtggactctgaaataaataactggtagaaattctacagtgtggaatttcttgcagttagcaaaagcttaggggtccaggtttttgcaggattcctgtcttggtcctttcaaaccaaggagctctgctggctctgccaggccgcctcacatgcccagtgggattctgacccggcctccttggtgcggcagcttctcccgttaacggaagaagacgcttagcccctctgacagggccatggttgttttttcaattaaaatgtcctgg

SEQ ID NO: 90436 - DNA, 1009 bp, Homo sapiens
tagacattttaaatttaaaaatctaagtaaaacaccagccgtgtttctcaggtatgagttaaaagcacaggtgggcgggctccaagcagtccagagggcgatgaggatgccgattgctgggaagatcctggtccctttttgtccccatgttttcaagaggaaggaggacgctgccattttacttgagtgaaagacccttcgtcacgcacgaaacccccgagggctctgggctcggtcctgctgccccgcagtgggcgggctctgtgtgtcttacggttgcatctgttgtacctgagaaacattttttaaacaaaaaaattcaacacaaaagaattttttaagaaaaaaatgctactggcctaaataaggtttatagttaagtatttagtcttaagttgtaagatgctaagtgtagtcataagttacccgagggtgtgtctaaagggaagggggtgctgggacccgcagcctcgccctaaaccagagctcggtttgtttaggtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggtaaggctgatgcagaggtgcccacgggaatgtcccccttctcggacttggcccgcgcgccctgggctgtgccgtcgctgcggcctccccacctctgctgtgcatgcacagagccgcggttcacagtgtccttgagcccccgcgaggtgccggctgacagccagctcccgggcagcacccgcagcctcctcagtagcggggtggccacggcttaggtgcccgtccggggcctgggactcattgtcaccgggaagagctgcagtgagcgtctgcacctcgcgaccgtgtgccacggcaggtctgagcacgaaaccctgagagggctggcattgccaagctgagctcagaatcgggg

SEQ ID NO: 90437 - DNA, 1297 bp, Homo sapiens
ggtgtgctggcccctcagccagtggtgtcactggggcagtcaggttgggcccagaaacccttccctgacacgtgccaccgatggacgtgccctgacaggaaggacaacgtggggtctggtctgcgacggaggggcaggccctgtatcgctgcaagggcccgtcaggggttttctgaaactccgagagccagctttctagaagcctggtccaccgtgccttgggccatgtgtgtctccaagccccgaggcttctctacctcccctcacccccccaaccacgtcttcgggattgaacagggaagcggtgaggttacgtgggccatggagggctctggaagccgcttttctctgtgtgtgcccctgctcacatgtttttgagggagagaacatgcccggggtcctctccccggcccaggtgctggcctcagaagggccccacccgcaccccgtgggacccgtggactcaaggcaggctcggcggagctgtgtccaggtggcctcgctcgacggcagtgccaaccgcccagggaccgccccgagctcacaggactttctcccccagcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgt

SEQ ID NO: 90438 - DNA, 1081 bp, Homo sapiens
gccgggaaagcggaagcgcgtgtgcgcgcacggccgagggggcgggacatgccggcagtctcgcgataactgcgcaggcgcggaccaaagcgatctcttctgaggatccggcaagatggtgagtgttgcgatttggcgcgtctctgccgggcctatccggctccatccaacctctgaccgtctcgcgggggccgcagttcgtccccgcggctacggcggcttgctcccgaccctgcaggcggctggatgttggggcgaggggcggacttggtgggtgtcgggacgacgcggggctgggaaggcctgtccgggccttcatgtccgggtcctcgtaacccggagccgcgagtgatccccggggacgggtcgaagcggtgtgtccctgtcgggcttctgtccccggcggcgccgcgcgtcttccgcggtgtcctcgggcccggtggccccgggagatgggtgtcgggatcccgctgacgcccgatccgcgcccgcacaggcagaagtagagcagaagaagaagcggaccttccgcaagttcacctaccgcggcgtggacctcgaccagctgctggacatgtcctagtaagggcggccgcgggggtcgcgggcaggggctgggccagcggtggggcttgtccgggtgagggcggcggggcgggggtccaagcgcctctgcggcggtgggcgggcacggtctccgcgcgggtttggaactgagtgtggtcttgcgcccagaaaactgtccagagacgttgaggtttttgcttatttgcaacctgccccccgttgttcacttttccgcggcttagttggaaggtgtagcccctgtctgtagcccacgtgacttagaataaggggctgcgttagactccttagattttaagggcggtggaggtcgctgggtcctttccaggcagggtggtggtgggcatctggcttgcgcttttattttttaatttttgattattttgaggcggagtctcatcctgtcgcccaggctggagtgcaatggctccgtcccagctcactgcagcctcccactcccgggttcaagcgattctcttgcctcagcctctcgagt

SEQ ID NO: 90439 - DNA, 1427 bp, Homo sapiens
tgggattacaggcgtgaacaccgcgcccgaccttgatttttgattatttgtggaaacagcgtttctctgtgtcgtccaggttggtcttgaactcctgggctcaagcgaccctcccgcctcaacctcccgaagtgctgggatcacaggcgggagccactgcgccctacctgccttcccctgcgtttttagaggcctttggcccgagctgtacgctgcagcaccttgtctgaggctgtggtctccgggccgcttgttctctctgaatctctgcagtcacacggtggctcttgcatgtgaggggtgagtcgcgcatatctggcgggggtgccagagggacttggcgtgttcattgtagtcactacaatggacagtgacaggtccactgcggctctgtccctggagagaaccaagccttagttctctgtccgccggagtgcgtagggtctccccaggccgggccgctcacaaaactgcctggtgcatcctccccagcgagcagctgatgcagctgtacagtgcgcgccagcggcggcggctgaaccggggcctgcggcggaagcagcactccctgctgaagcgcctgcgcaaggccaagaaggaggcgccgcccatggagaagccggaagtggtgaagacgcacctgcgggacatgatcatcctacccgagatggtgggcagcatggtgggcgtctacaacggcaagaccttcaaccaggtggagatcaaggtgtgtgcggccgtccctgccggctggggtgggctggggtcgcctgatgcaggcgggatcagctgacacccagctttgctcttggtctcccgcagcccgagatgatcggccactacctgggcgagttctccatcacctacaagcccgtaaagcatggccggcccggcatcggggccacccactcctcccgcttcatccctctcaagtaatggctcagctaataaaggcgcacatgactccagtcctttgcgcagcttgttcttcctggcgtcccgagctctgggaggggcctgggcctgcttcaggttcgtggtgtgaggaggttcaggttggacgttcgggggtgtgtggtagtgttgtgtggatggtctcttggtgtcgaagactgacagctgtgcgggccctgccccaactcggctgcccctgctcctgtctgcagggacagctgtggagctgggtgcccaagcccaggtgtgtagctccgtcccttttggccccctcagcgttcttgacctcggggcagctgcctggcctcactctgtcttctgggtacctcacgtagagggggccactcctgggctaagtgcagcccctcaagccctcacctggcctgggctctcctttctggcttccctcatctcctgtggagggttcccgcaggaagtgaagcagcagcaggaacctttgggccacctgagcc

SEQ ID NO: 90440 - DNA, 1093 bp, Homo sapiens
gccatcagggctggaccggggcaacagatggggccgggtgaggtaatgctgtcggagctcgggaggaccatgccggtgggcacggcgccccgagttcagcacccacgtgtggtcatgttgggggccagtggcggtcactgtccatcagcctcaggacacctccaccctccctgcgtcctcagaccctcagctccttaggactggccctggagcattggggggcagacgaggaccccttgtcaccctggtgcagagaggccaggtggccaggcaggggccgcggtgggagggaggccttgcagtgggcgtaccttgagttgattgtccagagaccgcggactgcctgtccccttctggagacagctggactgggcggtgaggtgtggctgtggcccccacggcaggggatggagaaggcgaaagtgagctcaggactcggggtgggggtgggaggcggggctggcagccatgttgcgcaccttgctgctgggcaaggcgtcacgggcaggagccagccagacccaagttctgtgagcttccaggcgtctccccatcatcgctgccaccacgctcccccaagaggtagctctgggagttccccacggcccacatggggaaacagaggcagggagctgggagggcgccgcccagagacttacatatgtggaaggcaatgccgcaccaccttcctgcataaccctggccctgtcaccagcgacctggtggctggcttcgccatttccctaccctttggcaattaggggcgcagcgggccggggcgagtgtgagggtgagcacgtgtttggcatccccaagtccaaaagctcagaagagaccaccaggttccccctcgggccatggatggggacagcaagtgtgagacccccgctgtgtcctgaaagggggctcctggcaggcaggaggtcgccccactcagcctgcattttccccgctctctgctcagccatccatgaccccctcttcccccaaaacaacctgacagccttgcctggctgcgaggtcctaggagggagcattgggcacctccagcacctgctgggtggcacacctcggtgacttatggacgtcctgt

SEQ ID NO: 90441 - DNA, 1021 bp, Homo sapiens
atcagccccgccctccactggtctcgccaatgaatcgcgtcccgtttctccaatcggctcggatgtttctttagcccctccccccggttccgcccccccacgcctctcctcgccctggctccacccttcagccaataatcccatcctctgacaccgcccttccaatcagctacgtctcgctccggcccggccaatcggtgccctgggccgccgcgccccgccctctcccggcggggtctgggcagcggcggccgtggcggagggctatgcggcgggggagacggggcaggcccctcctcctttgtccgccctgccctcccattggtcctagcggggggccgggggcggacaccggcgcggggccggagcatcgcggctcaggctgcgggaaagcggtgcgcgtgcagcggggtgggtgccctggtccgcgggcgagctcgagcagccaaccccgggcgcgtcggggccatggacggcctgaggcagcgcgtggagcacttcctggagcaaaggaacctggtcaccgaagtgctgggggcgctggaggccaagaccggggtggagaagcggtatctggctgcaggtgagccgtcggcgctagcccgtttcgccgacgggcacaccgaggccatgggcctgggggtcgcagaccggactccttccccggctacggggtccggtccggccggtggagcgcgcgaggtgactgggacctcgaggtccgcccgcagcccttcccttgcccgcgccctgcgaccctgctcccgggccacccctctctagcttccgcccctggccgccccccgacgcctccttccgggcgctgggtgcctgccatgccgaagtccggttcttccagttgcccagtggccccagaggggtcgggatgccagtgtcctgcgcgtttcgccgtcccccttcccccgtggaccccggcctggctgcaacagtagagatcttcccgtttttctgaggggaggctcctggcgggaaggggaacggaccgtcctgggggcctgcc

SEQ ID NO: 90442 - DNA, 1047 bp, Homo sapiens
tccccagcagctgggactacaggcacacaccgccatgcctggctaatcttttgtatttttagtagagatggggtttcaccgtgttagccaggatggtctccatctcctgacctcgtgatccacctgcctcggcctcccaaagtgctggggttacaggtgtgagccaccgcgcccggctgcaaacacttcactgggcagctattccgcacccacccccactgcccagcgtcgagctcctgcctgcccttggggagctctcaaccccggtgggggacatggacacgttgaccagttacaggcacaaggctcagggcctagaggcacgatgggggatgtacaggcacatcaggggcagtggacatatcctggaggcggctcctgggaggaggtgacggttgcagtcttcgtcgactgaaaggcggcctgggtaccgtcgtgggggctcagcgggtccccagccctggcacaccaccgcctctctccggcaggagccgtcactctgctaagcctgtatctgctgttcggctacggagcgtctctgctgtgcaatctcatcggatttgtgtaccccgcatatgcctcgtgagtgcacggctggctgcccacgcggggggttctgggggctccctggcagcccctgaccctgctgcaccctccctgcagaatcaaagctatcgagagcccaagcaaggacgacgacactgtgtggctcacctactgggtggtgtacgccctgtttgggctggccgagttcttcagcgatctactcctgtcctggttccctttctactacgtgggcaaggtgggccctgccagggcgggcacagccgtggagcgcatggggcttggggattcctgggaggcgctggggccagaaagtccggaggataccaggagatgggggatgtgaggggaagactcagtcccttccctggggaaacgagccctgtccgggggctgatggtggagggcccaccctgaagggtgtctgatggtggagacccaagcctgctccaataggatgtccgatggtggagggctcaccct

SEQ ID NO: 90443 - DNA, 1046 bp, Homo sapiens
gtcctactgggacaggcctgggtctccaccgtcagacacactttaggggtgggccctgtgccatcagacatattattggaataagcctgggtctccaccatcagacaccctttaagtgagccctccaccatcagacatcctatttgagcaggcttgggtctccaccatcagacacccttcagggtgggccctccaccatcagacatcctgtagggtgagccctccaccatcggacatcctattggagcaggcttgggtctccaccatcagacacccttcagggtgggccctccaccatcagcccccggacagggctcgtttccccagggaagggactgagtcttcccctcacatcccccatctcctggtatcctccggactttctggccccagcgcctcccaggaatccccaagccccatgcgctccacggctgtgcccgccctggcagggcccaccttgcccacgtagtagaaagggaaccaggacaggagtagatcgctgaagaactcggccagcccaaacagggcgtacaccacccagtaggtgagccacacagtgtcgtcgtccttgcttgggctctcgatagctttgattctgcagggagggtgcagcagggtcaggggctgccagggagcccccagaaccccccgcgtgggcagccagccgtgcactcacgaggcatatgcggggtacacaaatccgatgagattgcacagcagagacgctccgtagccgaacagcagatacaggcttagcagagtgacggctcctgccggagagaggcggtggtgtgccagggctggggacccgctgagcccccacgacggtacccaggccgcctttcagtcgacgaagactgcaaccgtcacctcctcccaggagccgcctccaggatatgtccactgcccctgatgtgcctgtacatcccccatcgtgcctctaggccctgagccttgtgcctgtaactggtcaacgtgtccatgtcccccaccggggttgagagctccccaagggcaggcaggagctcgacgctgggcagtggggg

SEQ ID NO: 90444 - DNA, 1057 bp, Homo sapiens
ggtcaggttacaataaaccggagagaaaaggtccgcttgcactttttttagttttcttatttttagacacccctcccctccagggtgatctttaaaaaagcaaaacaaaaaacacgacttttccagcgctcagcgttttttcctttcgtccgaagccgttttctgatttgacttttctcgccggccggtctcaggccgcacagacgttccagaggaggagggtgacatttttactccctttttggggctaaccatttatgcttttgtacatcaaccgtgcgcggccggagggggcaggggggcgggggcgaggggcgttccaatcaaatttctaactttctgttaattattaatcccctttttactgcggtttctgttgtcatttttaaaatttttttaatttttttttttttttacttttactttttacctcttgtgtatatgtagggaatttatagggaaatatgtactttatggaataaattttaagaactaaaatatattttattttaaataaagtaatggacctttaatcttacacagctaaattactgattatatatttgctgagctgatttaagggttaaaaaaattgtatcaagagttttattttttgacttcaaagccttcttaataaagcctcttttctacatgtgagcacacggcttcagcgtggtgtgggggatgggcaccaggaggggagaccccggggcaggggacacccggatccagcccctcaaccccccagttccgtggtccaggccctcaccccgaccaggcactgtcccttgttccagacgaaggaattgggtctgtgggggagggtctagctgggctccccgtgagcaaacctcaggtcctccccatccctgtgggtgttcaaccatggatcccacagagaaaggggacccaggctgtccttcctcagggacatctgcccagctctctgggtgtgtgggatccatcccaacagaccgtccagcggtcgtgcagatggggaaactgaggcctggaaatgcccgtcccaggtttgaccccgatgcatcctggtctgtga

SEQ ID NO: 90445 - DNA, 1043 bp, Homo sapiens
tcaccgacgcgggccccgacagcgacttccacgccaacggcaccgacgtctgcctggacctgctcggggcggccgccagcctctgggccaagacccccaaccagggacgacggccccccacggccacggccggcctccgcggggacacggccctgggcgcccccagcgcccccgaggccttctacgcgggcagccgcggcggcccctccgtgccggacccaggccccgccagcccctacagcggctccggcaacgggggcttcgccttcggcgcggagggtcccggtgccccggtggggacggccgcccccgacgactgcgacttcggcttcgacttcgacttcctggcgctggacctgaccgtgcccgccgcggccaccatctgggcgccttttgagcgcgccgcccccttgcccgccttcagcggctgctccacggtcaacggagccccgggacctcccgccgccggcgcccggcgcagcagtggggccgggaccccccgccactcgcccacgctgcccgagcccggcggcctccgcctggagctcccgctgtctcgccgtggcgccccggacccggtgggcgcgctgtcctggcgacccccgcagggccccgtatccttcccaggcggcgccgccttctccacggccacctcgctgcccagcagccccgcggccgccgcctgcgcccccctggactccggcgcctccgagaacagccgcaagcccccttcggcgtcctcggccccggccctggcgcgagagtgcgtggtgtgcgccgagggcgaggtgatggctgcgctggtcccctgcggccacaacctcttctgcatggactgcgccgtccgcatctgcggcaagagcgagcccgagtgtcccgcctgccgcacgccggccacccaggccattcatatcttttcctagagcgcggaccaccacgtggccggggccatctgcgggggccaggggtgggcgcgggagacggggcgggacccggggtgggagagggacggggagggggcgaggggcggaggccgagggggc

SEQ ID NO: 90446 - DNA, 1050 bp, Homo sapiens
ccatgctgaagtacagtggcgccgttactactcacagcagcctctacctcccgggctcaagtggttctctcagcacagcctcctgagtagctgggaccacaggtatgcagcgtgacacctggctaatttttgaattattttgtagagacaggagtctcactgtgttgtccaggctggtctcaaactcctaagctcaatcagtcctcccacctcgccctcccaagatgctgggattacaggcgggagtcgccacgcctggcctaacttgcttttttttctgttatgaatgtagtaacacaagcgggagagggaatttagaaatggaacccaagttggggttccttccaagaaggtggcagctcccattcttggggcatttccgtggcctgtctgggccacagctgccccgtggtgacctctccacttgcggctgtttgtccactgcctggcaggggtgggacctggctgcacggatgagacgctgctgtcggccatcgccagcgccctgcacactagcaccatgcccatcacgggacagctctcggccgccgtggagaagaaccccggcgtatggctcaacaccacgcagcccctgtgcaaagccttcatggtgaccgacgaggacatcaggtagccccttggcctggtcccctgctgctccaccctgtctcttgtggccgtggggaccctgagtgtccccgtgtgcctgcgtgcttcccgtctccccacgatgctgctggggttttgaaacagaaacagccagggcaaggggacccatcgtcggagcagtatgaaccgtttcacccgcgtcctgggttcagggcgagccaggcaccccttggaggaatgttcttgaaaagagtgtggtcctttgagtccgtgaggactggctatgctgggtgctgggctccatgttgggccctggagacggagggacagggcaggccaggagtctctgccttcagggagatggctctgggtgcctgctgaggggcagttctgatgtgcagagcctcggaacgaacagcagggaacacggccgctcagaaa

SEQ ID NO: 90447 - DNA, 1050 bp, Homo sapiens
caggctgtagtgcaatggtgcggtctcagctcactgcaacctccacttcctgggttcaagtgattctcctgcctcagcctcccaagtagctgggattacaggcgcccgtcaccacaccggacttttttttgtatttttagtagataaggggtttcaccatgttgaccaggctggtctcaaactcctgacctcaggtgatccacccacttcggcctcctaaagtgctgggattacaggcgtgagccaccccatgtgtattttttattcttatttacaaacgtccactggatccctggctgtggaaagcctgggcagggtctggagacccaaggcagtgggaggggagatgccccattgggacccacatggggcaaggaggccaggtgggcctccctggagcccagcaaggacctggagtggggagagggcagggccactcttgaggttcacatatgtgtctggggcagctcttctgggagaagaagctgagcggcctgaacgccttcgacattgctgaggagctggtcaagaccatggacctccccaagggcctgcagggtgagcgggcaccctgaggggaggcggaaggggatgtgccgggtggggtggaggtgctgcaggtgccctcatctcctggcagggtggatggctgttcctgctttgggtgcttagggcaaatctgccagcgactggggcaggaggaggggacccagtggggttggggatgggtaagggcgcttgggctgggcccttcattcttgaccttggagaccctgcgggtggggctttgtggcttccaggtgtggcgcaggcctggggctgttttcacctgcaggacgtgcagttttgccatggagatcctaaataaacaaacaaggacagctgactttgcttctgtactctcccagcacgtccacaccacagaacaaagaatgcagctcttgcatggttttggtggttgttttttgagacagggtcggctgggtacagtggctcacacctataatcccagcacttggcggggctggggcaggagtttcacttgatctc

SEQ ID NO: 90448 - DNA, 1032 bp, Homo sapiens
gtaggtagtagcgtttgtacccgaactcagcgtctgctgtgcctgacgctgccagggcctacggtggggaggattcagaggggaccggggttgggggtctggagcaaggatccgatgtggaggctggggctagggccagggtgtgaggatcggggccagtgctctgggtctggctggcgcccagatctaggggccagttgtggggtgctggggtctgggatgaaggtctggggtcacgccagggttggggtctggggctggggccagggcctgcctgggtttggggtcagggccgtgttggggtctggggctggggtcgcgacctgaagctggggctgggactgggtttgggtctgcggccgaggcctgggtttggggtctggggtccgcccggggcgccgaccgtcccgcctccccgcagcccgagcgggaagaagttccgcagcaagccgcagctggcgcgctacctgggcggctccatggacctgagcaccttcgacttccgcacgggcaagatgctgatgagcaagatgaacaagagccgccagcgcgtgcgctacgactcctccaaccaggtcaaggtgagtggtggcgtcacgcaggtgacgtcggcgcggggcgttctaggcggggacgcggccatgacgtgagctgcaggcgacacagcccggcgtcctgagcgcaggaggtcacagcgggcggagggcacagagcggaaggcgcaggccacagggtgcagagcgcaaggcgcatggcgaggacgcggcccgcggcgggcgttccagagccggccggaccgaccctgcgggagcggcctccccggaccgtgggggtcctggcgggcgcgggggacacgaggggcgccggcaaagcagggggtcacccgggccccgcaccccctgaggctccgcgccgccggggcgcccccaggccggactgcatatccttcctcccgcagggcaagcccgacctgaacacggcgctgcccgtgcgccagacggcgtccatcttcaagcagccggtgaccaagat

SEQ ID NO: 90449 - DNA, 1040 bp, Homo sapiens
gatcctcgccagctgtgtggcctcaggtgagggcctcgccctgtctgttgtttggtgtcctcgcctgggaacagggactgtgatggcggcacctgcctgagtcctgcagctgtggcagggatggatgaatttctgcagactgcagcagaccggacccatcatcatggtggttgcaaacttacaaacacctacacatgcgccaggcccagcctccccccagctccactcccaccccagcagccccttgagcagttactggcttcctgagagccggcagcatgggcagggcctgtgctgctggtgccagccctcagggctcacagcactgggcgggcacaggtgccaggcccgcacctcagccatcaccgctcaggacggggggccggggtgggcaggagagggtcttggagaaagggtccagagcaggcctgaccatcccctctcctctcgcagggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtaagtttcagtgggctgcggtgggtggactgcatgatggccggatggtggccgaagagtgggttctccaggctcccagagccggggcggcagccctcactgctccccctggagagacctgcattcgagagtggggccctgggtgccccttctggcatctccggcccacgggcacagaactgtccgccccgcagccttgggttgtgtgattggggtgtgggcctcgccctccctctggacaatcccagtgagtctttgaggcaaaccttgcttccgtctcagtgggcactgcagcctgaactgggtggggcccatgttacagacagagggggaaggtggaggctggcccacagtggctggacaccccatgagctcttggaagcgcctgtgaggccctggacgcatccacgtgtttctccagcatgccagctgccccct

SEQ ID NO: 90450 - DNA, 2205 bp, Homo sapiens
accagccgtgtacctgcactgcagtgcctgacaccagctgtgtaactgcactgctgcccacaccaacaccagccgtgtacccacactgctgtgtccaccaacgtaagccgtgtacccgcactgctgcccacacccacaccagccgtgtacccgcactgctgcccacaccaacaccagccgtgtacctgcactgctgcccacaccaacaccagccgtgtacccacactgctgtgcccaccaatgtaagccatgtacctgcactgctgcccacactgctgtgcccaccaacaccagccgtgtacccacactgctgcccacaccagcacaaacacaagtagctggataccctctccacaacccagccctgccctcccacccagccttggcgcatcactaacagaggcctcggtgctgtgacccagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgaggtaggctccccggccagggctgccccagcaccctctcccttccccacacccaggtgcagatgctggggtcctcctgtgcttgccgcccccggactctgtccatgtctgtctttgtggctggactcagacccagtgatgttccccagacaccccctgatacccactctcttctttacaagcctccaccccatccccccagccttctcaaggaaggaggtgagagccggaaatacaggaggccacacgtgatggggctctgcccccacccccccccccgacatcctaccccccactcccacctcacatctttctcctccctgggaccgtctcccacagagctctcccccctccctccagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccag

SEQ ID NO: 90451 - DNA, 1050 bp, Homo sapiens
acctgctgctccagccccaggatgacctgcacggcctgctgcaggatgagcagcttggtctgcgctttgtccgacttgaggtgcatctggcacatgcgccccagctcccggaaggcctcgttaatatcccgcacgcgcacccgctcccgcgcgttattggccatgcgcctctcccggtccctcaggtctttctcctccagggacagcacctcgtccgtactgctgggtcacagcaccgaggcctctgttagtgatgcgccaaggctgggtgggagggcagggctgggttgtggagagggtatccagctacttgtgtttgtgctggtgtgggcagcagtgtgggtacacggctggtgttggtgggcacagcagtgtgggcagcagtgcaggtacatggcttacattggtgggcacagcagtgtgggtacacggctggtgttggtgtgggcagcagtgcaggtacacggctggtgttggtgtgggcagcagtgcgggtacacggctggtgtgggtgtgggcagcagtgcgggtacacggcttacgttggtggacacagcagtgtgggtacacggctggtgttggtgtgggcagcagtgcagttacacagctggtgtcaggcactgcagtgcaggtacacggctggtgtcgggcacagcaatgcaggtacatggctggtgtgggtgtggacagcagtgggggtacacggctggtgtgggcagcagtgcgggtacacagcttacgttgctgggcacagcaatgtgggtacatggctggtgctgctgtgggcagcagtgcagttacacagctggtgtcaggcactgcagtgtaggtacacggctggtgtcgggcacagcaatgcaggtacatggctggtgtgggtgtggacagcagtgggggtacacggctggtgttggtgtgggcagcagtacgggtccacatgctgatgtgtgtgttgtcacatgcgtgaaaatgtgcttctctgtgcacgcggcgaatgtgctccctggaatgcagcagagccccatggtggggcgcctgtgtgtgtacgcg

SEQ ID NO: 90452 - DNA, 1633 bp, Homo sapiens
ggggtttcaccatgttagccaggatggtcttgatctcctgacctcgtgatccacccacctcggcctcccaaaatgctggcattacaggtgtgagctggtgtgagccactgtgcccatccgaagtgttccatatttttaagttaatgattgaaacagtttactttcaccaaaaaagaagagtgttcttttagcatcttagtagattcctgccattgagttgctgcagaatttctacacactttgttccaaaggtggtaaaactgtttccctttcatcttgtggtccttaatctgtctggcattggtagctacacatggcgtgaggtagggatccagttctggttgttggttttttgtttttatttttggccaagacctggtttttccaggaaagcccaagtccctcaccacaggagcacaaagagatatgtcagttggccctggaggccgacgcaggcccctgaccctaggcctgttgcagggctagggcgagcaggtgccacggcggccgccagcgagatcaagcgggaggagaaggaggacgaggagaacacgtcagcggctgaccactcggaggaggagaagaaggagctgaaggccccccgggcccggaccaggtgccaacccacccctcggcactccccaccctcaccccatcaggacgcacatgtgcacaggccacacgcacaccgcacccacactgggaggccgtcggcgggccccacgctcttcccccaacctcactgtctccctctggccccctcccggcgccctccccatagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgaggtcagtgggggcgcgggccaccagcgtccctgcagcgccaccctccctcgtgttcctgccctcgttctccttccccgcccgccttcctggagccagccctccctctgcagcagttgcctccttgcagtgactgtgcccttcacccctctgaccgcattgccatgactgtccactcctgactgccagcccttctccctgcctgcctcagcatcccctccacagtgggaggactggactctttctggacccctagtccttcaggcctgggctctgtggctcagaactgtatctcccagctccacggggctcccactcgccgtggtcctcctttcttgggaagcccagaacccagctcacagaggccagtgtcccccgatcccagagacaggagctggtgtgcaaaccaccctggccccttcccgtcaggcagatgccacgcaaggccacatgagcccatcccctgtctctgactcagtttccctatctgaaggtgatagggaaacttcctatcacccccatttcccagggccagggggaggaaggatacagacagaccctgtccccacccgcagatgtgagctgactccttccccccgctggcgctggcggctgcttc

SEQ ID NO: 90453 - DNA, 1046 bp, Homo sapiens
agggaggcgggaggtgggggctggaaaaggagtaggagagagagaccaggacatcataagaacctcaaacttggccaggggctgggatttacctaaaggggggtggctttacagggaagggaaacggggtggtagatgtgctaccaggaggggacaggaggccggcaaggtgcatgggctgatcgtggtccctccgtcctgactgcaccccccaccgcccacccgcccgcaggtgtacccacccagctcaggtgaggactacggcagggatgccaccgcctacccgtccgccaagacccccagcagcacctatcccgcccccttctacgtggcaggtacatggcagggcgggggctcgccagggacggtagggcagggctggggttccccactcggcccccaccttaccagctcccctccacagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatggtaggacccagggcagggggcagggggtgggcggagggtggcagtgcccatctaacccaccctcctcctgcctgaccccccagggctaccagctgcatggagcagaggtgaacggtgggctcccatctgcatcctccttctcctcagcccccggagccacgtacggcggcgtctccagccacacgccgcctgtcagcggggccgacagcctcctgggtatggcccctccctgggatgcggcctctccgaggggacactgggctccaggcagggtctgggtggggggtggcgaggactccacgggaggcgcaggcgcgtctgctggccctgagagcgggttgttgtcagttctcattgtccgctgtctgcagggcctgccacgtgcgttgggcttgggatgtctggaaacagatctttgaggagcggctttcccgccttacagctgggaaaga

SEQ ID NO: 90454 - DNA, 1027 bp, Homo sapiens
cccgtccccacctggggacccctggggaaagtcgagactggaggggcctggagtgcatttctttggaatggaaatttttctctgtacctttttctgggggtggaatgggtcttggcaggtggatcccccatcccccatcttagaatggagccccctgggaccacgcgggagcaccctggtcttgagacgctctccccgctcatggagggcaggcaagggatgttgtcaaagttttgcttaaaaataattcccggatacatcgcgacagtaaagcaatctagggctgttttttttttctttcctgaatactgttggggttttcttggggggagggagattgagggtggaggaaagctttgctggtccctgcataggatgcgcgtcccccccacccccggcactttaagtcttgaagcttgtaaaagagtttcgtggttttctgacttgtggatttccttcatgttgaatttgggggcgacctggtcttcaacgggctgtgccatctgctgggggaggggggaatcaccaaatttccctcggggcggggtaggatcgggctgttcctccctttcccgggggtagggggcctcagaggaagcccggggttggttggaaatgagagagttggagaaaggagaggttctggctgccctgcgtgcagtttaaacttggcaacttgatgccctggtgttccctgggggagttagggagtttatatttgcacaccctccccccatttttcagactccctgtggtctctggggaggactctgcagggacctagactctggaattccagcttccctgcgcctgctcccagggctccccgtgcccccagggctctgctggaactcagaccccagggcggttgagggttttttaggtggcttttagcactctgtgctttgaccactcacaactcttctcccctccctgtttctccctgtccatctgtccccacatccaccaagcagggtttccaggcctgaggtgcccgccctggccccaggagaatgaaccagccgca

SEQ ID NO: 90455 - DNA, 1060 bp, Homo sapiens
aagaaacagaacaagccagagaacagaaaggtatacctctgcctctctctctccctctccctctctctccctctctctctctcttgcgctcgctctctctctctcttcctttctttcctaaaggactcatttaaataagaaatctgtaaacgccactggtcctttctgccgcagtctctctcgcgatcacgctccctctaactttccctctggtctccagccctgacattcaatgcgtctcccacggaactcgtcaaagaaacgacatgccatcgtctgcaaaattataatttaacggtataaagcttcaagtcacgtattccaaaaactagctaaggatttttttttaatcacataaactatacattaaatattttgaggtatttcagagaaaattgtcaaaggctcgaaggaattgtgctggaggtgttgatccctgcatggagaacgcatgctctttggtatgtgacagccaagtgggcatgcggggaggcaggagagggcctgaggggccggcgggcaggtcggggatagagccttctgtgggggtctggccaagtttggggtggggtccggaaacaggtaggggtgtgtgtgtgtgtgtgtgtgtgtgtgtgtgtgtgtgtgtgtgtgtgatacgaagatatctgaaaaggatccaggagtcctgggccactttatttatttttttttgtagaagtggggtcttgctgtgttgcccaggctggtctcaaactcctggcctcaagcgatcctcctgtctcggcctcccaaagtgctgctgggccacttctgtgaccaagaggcttgacctgatctgaccacagttcagcatagctaaaacattccacaaccagaacgatcccaagccaagtcctaaatttccagcaggggacaaaactggaggccccctagcgtgttacccttggggccttgaaggccaagcagagggcatctaggagacccagcaccccgccaggcccgtgctccggccagtgcctgaagcccaggcatcgattttctaagaagctcactgggccagggctgcagcgtgattctc

SEQ ID NO: 90456 - DNA, 1138 bp, Homo sapiens
gggtgctgcccggggcagcgctgccaagaggcctctgcagagggcactggtctccctggatccaggcctgggcgtcctggctgccacacgactgccggggcctggtctgcttccagctccaccaagaggctgaggcctcctgtcctcagtcctcactccctagtagggctcggtagatgcaggtggtcagtgccccgggggctgtggagtgggcctggccgggccctgactgtgtgtctgtgtcccctgcagtggccggaggctgggagacccagtacatgtgctgctcggctgccgccggctctgtcggctgccaagtcgcaaaggtgagccctggcgtcccagtcccctctgcctgttctcaacagacttctgcctccccatcgttggtgtggggtctcgggacacagcacagtcctgggctcagggtctgggcccccgggcagcctttcttgtgttacccagagaacgtagcacccgtaggccccaggccctgtccctggccacttcccatcctgggaagccgtcctccctgtgtcttcttggcaagcccccttccccacctgctcaccagggtcccaaccagtgaatgggcgtgatggatggataggatggtcccgaagggctcagagatgtgctgctgctgccacccccgcccccactgcaccccgaagctgccctcacctgccttctccacccccagcaacacgtgcaggatggccggaaggagcgccttgagggcttcgtgaagacctttgagaaagagctctcaggagacacccacccggggatctacgccctggactgcgagatggtgaggctgttctctgcccagcgtcgggttcaggattggggaggacctggcctggtgcggccgccccatctggccccatctgggcctggctcaccggccagcgctcagggtttctctcgcagcaccggtgcctgtggctcctgccctggaccaacaccccatacttcccagcagagccaagcacaccgggcactgggccccggctctgcctctgaatgggaggcaggagggctttgcgaaagggggttactgaggtcacaccccactcggcctctcctagaagtcccacagagtctctggtcactgcctctgcctggaggggct

SEQ ID NO: 90457 - DNA, 1030 bp, Homo sapiens
cacgttgtccaggctgatcttgaactcttgtcctcaagtgatcctcctgcctcagcctcccaaagtgctgggattataggcgtgagccaccacgcttggccttgttttgtttttaattaatagactttatgttttttgagcaactttaggtttctaggaaaattgagcagaaagtacagcaagttcccttgtgcccccatggcctcagtttcccatgaccttagttccgctgccctcagtttcccctgctgctcctgtcttgccttggcgtgtctgtccctactgcagccaggctgatctgtcccagcgcacctcactcttgcctccagccatgggcacggcctcatcgcgtctgcgttccccgctggaggccttgtggaggccctcacccatggcagcttttgccttccctctagagtttaaagaaacccattatccccaaagagtttgggggcaaagtccccaccgtcatccgccagcgctatctcaacctgttcatcgaggagtgtctcaagttctgtacctccaaccaggaggccatagagaaggtgaggtcctggagttcctatctggccggtcgggtggggactaggggtccagggtggtccccagacatcccccggcctctcagccgcagctgtgacccggagctgcctgggagagatgcaagtccccgaccccatggcgaccccaccgctggggctccccggcaccaggcaggcatggcctcagctgggcaccgcctgtcccccaggcactgaacgaggagaaggtggcctatgaccgcagccccagcaagaacatctacctgaatgtggccgtgaacaccctcaagaagctcaggggcctggcccccagcgctgtgcccggcctcagcagtgagtcctggcgggtgggcgggggaggctcagggttgctcttggggtggcagctgggctgggaccctcgctgggaccttcacagccctgagctcagccacagtctcagacaaaaggaaagcgcggtgctgtgggggggctgcctgctgcct

SEQ ID NO: 90458 - DNA, 1070 bp, Homo sapiens
ggtgccgagcccccagtccagaagcccccctgccacacagacgtacatgcccaggttgcagctgcccgcgtggccagccctccgaagcagcccctgcaggcctggcctcctccctctggtttgtgacttcatcaaagggcaaggcagaacacagaggccgcagggcagggcaaagccaatgagcaggtgggggcacccgagacccttcggtcctctgtccgggagccagggcctttccctcagacatcgacgccttgggcttggggtcagaacacgtggcagaggcctggaccaccccaccggtgacgtgtcctcagcggcctccgcagcctgacctgtgtcctctgcctcgatggacttgcctgaaggcagctagagcctgatgccattgcgcagccccagcccctcaccctggcccggccccctgcacgcggagatgcacgtgctgctggcgctgagcggccgcggctgcctggtgctccgccacgtggtgatgggcagccactcgccctgtgcccacaccccctgtgccccgccagcccccacaggtgccaagaggacccttgcggccagcggcagccagtcctccaacggccctgagccaggtggccagcagctgaaaacacgcacattgtcggggatggcgtccaagactaccaccaccatcatccctaagcgaatcgcccacagtccatccttacaggtagcccctcccatctcggccaggaccaccacccccaagaccacgccctgaggcccggccacatgggacctgcggagggccagcctcgcccctgccctgcgggccttcgtgctccacaccgcagtacagccttcaccttccctccccatgccttggtgttttttttttttttttgagatggagtctcgctctgtcgcccaggctggagtgcagtggcacgatcttggctcactgcaagctctgcttcctgggttcacgccattctctggcctcagcctcctgagtagctgggactacaggcgcccgccaccacgcctggctgtttttgtatttttagtagaaacggggtttcaccatgttagccagg

SEQ ID NO: 90459 - DNA, 1970 bp, Homo sapiens
gcggccggcagaggcccaccccgccccctccagctgcccgacaggaagagcaccaaggccccgtcggggaagctagtggagcggaaagcccgctcactagacgagggcgcctcccaggacgcccccaagctgaagaagcgggccctgagccacgccgacctctttggggacgagagtgaggacgaggccgcagggccaggggtgccgagcgtgtggccctctgccctccccagcctcagctcggactcagactccgactcagactccagcctgggcttcccggaggcgcaggggccgcccaagcggctcaaggcctccccgcccccctcccccgccccatcctcctcctcctcctcctcctcctccacctccagcgcgggggcggatgtggactactcggccctggagaaggaggtggactttgactccgaccccatggaggagtgcctgcggatcttcaacgagtccaccagcgtcaagacggaggacagaggccggctggcccggcaggtgaggcgcgcgggtgctggggctgggctcgggcagaggcagagccgagggcctggtgagagaccttctatctggagtggtttccagttggctcggaggcacggggtggaggcagctcctcagtgctggtccctgagcccgttgaaatctcaggagctcaggagcacccgggcagccctgttgctcctgttgcccctcacccacccagaggtcactggcccgtggccaccagccaggcttctgtggccacgtgcacacggtctgttcccactgactggcagggggatattggcccacccacccacctcaggggaatccacctccggcacacccttctagcccctctcccctcgcctcccctttcctcccttccccctctcttctcccctcctcccttcccccatctctgtctcttctcttccagctcctctgtctcctctccttgcctcctcctcatcccctccggctcctttctcctcccctccctcctccctactcccagcgtggcgagctcttgctctcctgggccagccctggacccctgggtctcctggccccgtgtccccaaattggccaccagggggagctcactccacacagactgagcccaagtgctcagcccgcagcagctggttcggcccaaggtggcctcgctttcccagtgtgctttcattctgcagccctggggtctccaagctggggccctgggtgcccaggagaggtagccttgggcatctgcagaacgtgtgacacctgcccacccctccgactgcacccacacaaagcccagggactgttggccctgagccctcagctgctgtgcctgggggctggactgttccattccccacttgccgggggcagtttgaggttggggtgtgttggtgttggcagcgagggcagacctgtgctgacggacggacatgtgtcttagccccccaaggaagagaagagtgaggagaaggggctttcgggtctgaccactctgttccccgggcagaagaggaggatctcccacctttccaagcaaggccaggaggtaaggtccgcagaggccaggccagcaggagccttttttttttttttttttaaagacgaggttggcctggtttggtggctcacgcctgtaatcccagcactttgggaggccaaggcgggtggatcacctgaggccaggagttcgagaccagcctggccagcatggcaaaaccccatctgtactaaaaatacaaaaattagctgggcatggtgatgggtgcctgtaataccagctactagagaggctgaggcaggagaatcgcttgaactcaggaggcagaggttacagtgagccaagattgcaccactgcactccagcctgggtgatagagcaagactctgtctcaaaaaaaaaaaattataaaaaaagggggtcttgctttgtcacccaggctggtcttccaactcctgacctcaagtga

SEQ ID NO: 90460 - DNA, 1044 bp, Homo sapiens
gacaatcaactctcccttaacgacgactgcggctgttgggctgcgctgccctccctggcctgcaggtggggccgtggagcccatgcccgccggggttgcaggctcttccgggcctgggctgcagcctggcccggccctgcttccctggcctcccctccttctcctgggtgcttggaagaggtgggtcctggcccgtggttgaggtcttgcctcgtggactggaagcagagggctggctgtgcagcctcctggggtagctcgttttttttgcaccgggtagaatattttttcaggcacggattcctttttttctgggcccccatgggtggtccggcatcctcagggggtgtgagtgtgtgtggggggtctctgagctgaacttgggtggggtggggacttgttcctcgggggccacctttgtgtccttgtcagcggtcgtcctgctgtggcctgggttgcatttcctcttggggggggtattgaggacccccagcctggaatgagaagggtccccggttccatgtcagacccagaaaggtggatccccccactgttggctgcaggaggtttttggtacccccttttgttccagaaccgtcctgcctctcgcttggggacaggggggctttggatggcactggtgtgcacctggacccagccccggcctggcaggatccagggatgggtgcctgggatcctggggggagggaggcaggggacgcccttctggagctgggctcggagggtcctgccccatccagccctcggctctctgtgttctctgtccctagcctcaaaccctcttctggcagcgctagtgagatgccttagtctgtgggggtgggtgggggactggggccccgttttcctttgtgagtcttggttggccccagccctggcaggggcctgtctggagcaggggtaggtagggctgtgggttccagaactctataactgggcccctctccagtgtccaggggcttggagagacctgcgcccacccctccactctcccaggagtcgctgatcactgggacctggttc

SEQ ID NO: 90461 - DNA, 1142 bp, Homo sapiens
cacccaagaggcgcttccataggcccccgggtattggggcagcggtccctaagccagcagggaggggagggatgggtttggagtcctgggaaggcagtattgttatcccgggattgcagtaagaaacaggcctgggggtgcccagtcgggcatccccaggggtggatgcagttgtgctgatggcgcgccaccgtctaccctgtgtggtgggggagggcagggcggatctcctggcaccctcccccaccccttgagcctgctgacgtcccattccaaagccccctttacagtaacgatttggggactgggagggcagtcccaggcccaggcaccttggattcggtttccaaagggttttggatacttgtggctttccaggctcctcttccgggcctccccagcccccaggaccaccaaggggtctgtgtaaacggcctcttttagtggaaggtggtctggtttttcagcccccggaggagggagggaatggctgccgttaagctggttttgggggacaggaaggccatgcgtttttttgggagggagccccattgcagggctgtccctgaatggagtggaggccgggaaagatccgcagacgaacccgagtcaccggtggctgcagggctgtcccgggggccattgagaacgagttccacccccacccacccctgcctggagtgcttctctgtaaagggaacaccagtcgtggcctggccccatttttacagataaaccaactgaggcacactggaggagccccacctgtgatttcggccacatttggccctgggagcagggaggccaggggagcagtgggatgttcttcatgggggcagcaggcggcaggactgcacctcccgtcccctgggtctggcccacagcccctatcctagcccggccagctctcggctctctctcccctgcgtggggcggggaaggactttggaagctgtgggtgatgttgacgccgttgctatggttacggagagtgagcgagccagcgagttggggcgggggcgggaggagaggctggctgtcggctccctgctctccaaaccccctgcatccccggagggccccccccccgcccccggcatgccagtgcccggcacaccgtcagcctgcacctccagagggtt

SEQ ID NO: 90462 - DNA, 3599 bp, Homo sapiens
ttctcccaggatgaagtgcaaactctcgggggcgcgacctcacccgtcccaggctctctcttaggacccttctgctcacttcttcctcccagggtctgctctagccaggagcctgctctgtcacctcggattttgctcctgcttgtccctctgtcccatccccctgtcacctggcccgtttgtctgccctctgatatggccgcgcctccccccaggcgggtttcccaccctgactggttgagtgaggtgcagtcaccgtctcccatatgtaggtcatcttccagtattttggctgctcggttgcttgctggtcctcagaacacctctagcttgcagagggttgcccagttaagtgcgtgggaacggaattggtgggattcagggtgtcaagggtgtgtgcccagtgagtgaggcgtctgggtttgcactccccagtccacgcccattagtgacactagggaggttccaggtacctgtggctggagaggagaggagactagactttcccttccctgtcaaagctggcggaccttggggattcttttcctcctgtgcttcctccttaattctgtgctgcctaccacctgcccattcctttagtgagtggcaggtcatggtcctgctctcatagagtttctggtttggaggtggggggagatctggccaaacgtgtgaaaaatacaagctgtggaaagagcgtgtaaggggtcctgtcccagctttgaggactctgagagcgttggcagtgaggtgcaaagggtggttgggttgggcaaggctgtctagtgaggttggggaagggagttcctggcagaggagcagaggcaggaaggggcaatttggcttgtcttgagggagccaggagtggcagggtgtgagatgagtgagtctggagaggtcggcctgagccggaatgcggacctggcaggctgtggggagggctttgatctctatccagggaataatgggaggcccccaggacaccccaagagggaagcggctccattgcatttgtgtcgtgaaagattgtttggctgctgggggagaatgtcctggagcaggtgatcagcaaggagggaggctgttgctgtggctctggtgaaaggtgatggaggcagggaccgggcggtggctgatgggagacaggcagagccaccgggctggtgatggaccggctcagatccagtgggtggaaggaggtgtcaaggataacatctttgtttctggcctggatagtggggccctggccacctcggtgtgccccttcgtctccggggtctccaggggcctgctgctgtccactgggctctcaggacccagctgcatgatgccacctaaactgcagggccctccaagtccccagcaccagcggggcagcaccggtagggcctggacctctttgagaatatgttgaaaagctgacatcaacctcgacgctgtggatgttgggcctgatcattctttggggtgggtctgtcctgggcactgcagggtgctaagcagcctccacccagtccccagtggtgacacccaaaactgtgtccagacattgacaggtgtctccaggagggagactcgcctccatctgagaagcagaaccagcctgacagtccacctcccggctgaaaagtgcttgcatgtgcgatttgccttccgcctgggagtctgggggcactgggatgccatccttgccccaccctggctttcagagctctctcctctcctcctcgtgtgcccatgagtccggctcacaggaacgtgggtctcacatcaggtcctgagggagcaggtgtgtttctgggcctgaggctgctccttggtagtgagggtgtccccacgagccgtgtctgtggcgcctgcagctgcctgcatgtccatctgtgtccacatctgcctttgagcctcatcttcctggccccacggttttctcatgctgtgacccaaaagccaagcattccagggtgttctgctgaaattgagttgtgagcgtgtctctctcctcgctccagtctgaaggagaagcgtggtcggtagatagacgtctcagaccttcgtgttttcttcacgtctgtctgttggcaggtccttacactattgtggttgctttagcaacttagctgttgtcgacttaatgtgtttcatgacgttctgcagcaaggaagaaggtccgagtttccactctcaatcaggcaccttcgttcccctcccccctcacttgacttcctgtggggtgtgtggtgtctgcacttatagatgagaatgctgaggcctcaggagggcaagggactcgcccacggtcacggaaccctaagtcaggggtggagaaggaccccctgacgccagcccacctcccctgcccctcagcaggcctggctccagcacagagaagagccattgttgctgctctgggggccctaggagcctgggatgtatcctgcctttgtttctagagcctttgtttgttgtatttcctctgtctccagacatcgcaggccggtgggacccggcgcctgtgcacgctcacgtagcggggcctgttcgggtccctcgtgggtcccttcagttcgagctctgtccttgcctcagcggcccgtcacccatagggtggcagagatgggccgggggagggagtgggcagcagtgcggaccgagtcctggcgcatggggtttccctggtgctggagccgggcgtttcgggggtgtgggcggggctggggtcatatcccctgcatgccccgcatgccatggctgtactcacatggcaagaggtggtgatcgccagctcagggaaggtgggggttccttcatcctgtggagagggggctgaattggggtcccctgagctgtagggtgcagtgcctgacaggccgtggggagggccgaggggatggggactgacaggccccgggcccatgccgccccctggcacgggtggatgccccgcctcccgggggtgcccagctggactgtggcacccccaaaggaccccacatgtcactgttcccccgcagggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcacccccacccctcccctgccgggccaggccgggcggcgttgttggcgggggccccggtggaggcccggcctgggcggcgcccgccatgaatgggctgtcgctgagtgagctctgctgcctcttctgctgcccgccctgccccggccgcatcgctgccaagctcgccttcctgccgccggaggccacctactccctggtgcctgagcccgagccggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgcgtctcctgcatgtatgttcgctgcgtgcctggtgccaggtgagcagctgtggccgc

SEQ ID NO: 90463 - DNA, 1024 bp, Homo sapiens
cagcgccctggctgggcggctcttctccacgcaggagcgcgccgccatgcagagccacatggagcgggcggtgtgggcggcccggcgggcagcagcgcggggcttgcgggccgtgggggccgtggtagtggacccggcctcggaccgcgtgctggccaccggccacgactgcagctgcgcggacaaccccctcctgcacgccgtcatggtgtgcgtggacctcgtggcgcgcggccagggccgcggcacctacgacttcagacccttccccgcctgctccttcgccccggccgctgccccccaggccgtccgcgcaggcgccgtgcgtaaactggacgcagacgaggacggcctcccctacctgtgcactggctacgacctgtacgtgacccgcgagccctgcgccatgtgcgccatggccctggtgcacgcacgcatcctgcgcgtcttctacggtgcgccctcgcccgacggcgccctgggcacccgcttccgcatccacgcacggcccgacctcaaccaccgcttccaggtgttccgcggggtgctggaggagcagtgccgctggctggaccccgacacgtaggcgccgccctcctgcctccggacccttcccgctcccggccgtggggcgcccctcctggacttccgggcctcgatttcttccgcacaagcctgaccgtggatttcagggacacataccgcctccagcggggagcacgggtgctgccttccgtgcggatcgagctttcctggactcggtcattggggccaccccgtgccagcggtgcccttctgcggccgcccttgctgcgtttgtgtcccctctgtctcgcgggccgggaaactgctctgatgggaaaataaacagcccaaaaccaagtgggtgtctgttaggaggtgtgtgcctttgtggccagggtcccgagtggggtggggtctgtacagggcctggtggctcagccggaggggacctgctgagccacgtgtggtcagagacctgggctgattctggggtagagca

SEQ ID NO: 90464 - DNA, 1081 bp, Homo sapiens
cagcgcgagactccgtctcaaaaaaagagtcataaacttagttccttaaaacagtgaaatcagttatctgacagttctggagaccagaaacgctaacatcaagctgtaggccggttcccgccttgcccagcgtctagaggcgcccccatccctccactcagggcccctttctcccccttcacagcctcagcgcagcctcttcccgtttctctctgactcccaccctcccgtctcctctcgtgaggctgccacgaggaccctctcctgtctcagcgtcctgccctcaatcccaactgcagagtcccttctgccatgagaggcaacccagccttgggtcgaagggatgaggtggggcctccttcaagagacaaagtctggttctgtccgtgggttctctgtccctacagaaaaggagaacaacttcccgccactgcccaagttcatccctgtgaagccctgcttctaccagaacttctccgacgagatcccagtggagcaccaggtcctggtgaagaggatctaccggctgtggatgtgtgagtgcgcctgggggcaggaggcgggaagcgggaggcagggctccccgagggagggagtggcattcaggcaggggcagcccgtcgggggcccaccgtctactgaagccgtcctgggcctggtggtccctgcggtgaacgaggctggtgtccaggccccagtgtcttggcttgcacagttcatcctcgacatggggtcactgggctggggaggcggacagcgggtgccccattgctgggcccatgctttcccacggccacaccctcccgtgcctgctcatccgtcctccctctctcttcgcagtttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccggtgagcagagctgccgggggccgtctgcacccagagggaaccagggcccactctgcaccccagtcccagcccagctgtgaggag

SEQ ID NO: 90465 - DNA, 1050 bp, Homo sapiens
ttttttttttttttttttttagacagagtctcgctctgtcacccaggctggagtgtagtggtgcgatctctgctcactgcaagctccgcctctggggttcatgccattctcctgcctcagcctcccgagtagctgggactacaggcgcccgctaccgcacctggctaattattttgtttttgtatttttggtagagacaggttttcaccgtgttagccaggatggtctcaatctcctgacctcgtgatcctcccgcctcggcctcccgaagtgctgggatgacaggcgtgagccaccgtgcccggcctattttttatattgtagtagagacagggtttcaccatgttgtttggactggtctcgaactccagagctcagacagtctgtctgcctcggcctcccgaagtgctgggatgacaggcgtgagtccccgtgcccggccgccatgctcattttctgtcttctgcctccctgtcctctgtccttgcaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagcctgccctgcccccaccgcccaccacctcctccccttcattcctgctgctacccctggtcccgagggctgggagtacctggggccccatccccccagctgggatggtggaagccggtggtggccacggaccgcccccctcctgccagggccacagaacccgtgttcatctcatccgagagcggagttcctcacaagcactccccagcagcccttggcctctgccgtccacaggacgccctcttgctcccggaaacgtgtggtcacccgccgtccactgcacggctggtacggccttgtcttcaggtctcgaggcctgactccgggggacaggtggcagcaggtcggccgccctcccgtcctcccagagctgctggcg

SEQ ID NO: 90466 - DNA, 1048 bp, Homo sapiens
gggcgaaggggccggggcgggcgcgcgcgtcgttaccttggctccgccgtggccgggcccgcgggcagcgtctgggcggccggcccggcctcagcagcgcagcgcggacccccgctccgggccccgcgccccctcgcgctccggctccggtgccgcttgggcccccgctccggctcccgcgccgcctgggccggcctccgcatgttcgggacgggaggcgccgggctcgccgcgctccgccgcgcccgctccggggcccgcgcgccttacgccgccagcgtctgccagcggggggcggcagccatacgcgccccactgcgcagccgcggccacggcgccgggggcgcgcgccgccgacgtcacagcgcggggcggggccaacacccggctgggcgtttctcgcgccgctttgcgacaacggatggcgccgcgcgacggccacggcgttttgcggccgctacgaggccgccgggccgctgcccgcgggggacaccgaaagcgcgtggccgcgagggcgcgcgcgggcaggaaagggggtctaacggtttccacacccttctaggggcgggccttccgccgcccgcccctccccgcccgctgttgccatggcgacgcgtggctggtcgtcctggcaccgccctgccgccgtgtgttacgtcacagtctcgccacctgacgtcacggacgggcggcgccgcgggatgttccgtgcgtggggcggtggcgggcgcggcgcggggaggcggcgggctgcgcgcgctaggccgcgaggtttccgggacaggcgctggaaggggcgactggccagaaaatgagctggttcagggcaagagggtttttccatctggctttcctgggcgaggaggggaaaacagttctagaataactgctccgtgttcagggggagaacagcggtgacgtgggtgccccgttgtcttcatccaccgtgacatcagcaaggagcagagaggaagtggccccggacccgcggccggcagctagacaaatgcactgctgggactgccatgcccagcacgggccgctcccc

SEQ ID NO: 90467 - DNA, 3181 bp, Homo sapiens
ccgccgcacgcccgtgcgtctgtcctccgccgcagagggcgtccctcaggtctactacttcggtccgtgcgggaagtacaacgccatggtgctggagctgctggggcccagcctggaggacctgttcgacctgtgcgaccggaccttcacgctcaagacggtgctgatgatcgccatccagctggtgcgcggcgggcggggcggggcggggctcggagggaagagggtggccctggaggggagcgcgtgggacggggaggggcccggccgacaccgccgtgcccccctgcagatcacgcgcatggagtatgtgcacaccaagagcctaatctaccgggacgtgaagcccgagaacttcctggtgggccgcccggggaccaagcggcagcatgccatccacatcatcgacttcgggctggccaaggagtacatcgaccccgagaccaagaagcacatcccgtaccgcgagcacaagagcctgacgggcacggcgcgctacatgagcatcaacacgcacctgggcaagggtgagctgcgcgcgcgcggcggggggcgggcgcccggaccccgctgaggctgcgcccctgtccccgcagagcagagccgccgcgacgacctggaggcgctgggccacatgttcatgtacttcctgcgcggcagcctcccctggcaggggctcaaggtgggcgaggaggccgggcaggcgggcggggacgcagggcgggagcaaggctgaccacagacccccgcaggccgacacgctcaaggagcggtaccagaagatcggggacaccaaacgcgccacgcccatcgaggtgctctgcgagaacttcccaggtaaggggtccctgcgcccccgccctgtgccccccaccccccaccccccacccccacccccgccgaggccccgctggcgctctctctgcagaggagatggccacgtacctgcgctatgtgcggcgcctggacttcttcgagaagcccgactatgactacctgcggaagctcttcaccgacctcttcgaccgcagtggcttcgtgttcgactatgagtacgactgggccgggaagcccctggtaggtgggggggtgccggtatgtgggagcgggggaccgggaaactgccctgagggagatgggaaccggcgctgcagcccatcctgacccctgctccctcacccacagccgacccccatcggcaccgtccacaccgacctgccctcccagcctcagctccgggacaaaacccagccgcacagcaaaaaccaggtgaggcccgggcgggaccgaccgccccagggaggggcatgggcggccagcgtgaccccctactgcccccaccaggcgttgaactccaccaacggggagctgaatgcggacgaccccacggccggccactccaacgccccgatcacagcgcctgcagaggtggaggtggccgatgaaaccaagtaaggctctggggcggtgccttcggggaggtgggggtgccctgggtccccatgggggtgggagggcctgaggcctgggctgcccccgccctgcaccccggtcctcctacctgagccactgccctcctcagatgctgctgtttcttcaagaggagaaagagaaaatcgctgcagcgacacaagtgaccctgggcgcgtgcagccccctgaatcttctccgtgcagccccttggggcgcgaccttgtgcgaggccctcggggcccacccacagcggcccagggccagaccctggctggaagccagaacgcagactgcaggggccgcgcctggctcaggcggccccacccccgggacgtggggtcacttccttcatgtaagactttggccgaaatttctacacctgtgtctagtcctcccctccaagagcattaactatttaaaacaaggaaaagaggaaaaaaaaaacagaggcccgccctaccccactcctgcccctccgtttctttgctgaagtgagtagtgtgatcctggaggccccccggcctggccccgccccgccagccgcccccgttagcgtcataaagtccagcttgtctccctcgatccaaaggccgttttctcgaggggagggcaggcccggcctggaggggtgctgtggagctgtcttgcccaggccctcctgggagggggacaggcattgttgccaggggtgaggccgtgccccaggcctccccgaaaccaaaggggaaggcaggggtggggccgtggctgaagccggctccccaaccaaaatgctgcaccaaagctcgggcgccgcgggcacggctgctgcagtctcttcccagcctggccctggcaaggggcgggtgggcgctgccaggcgggtgcttctcgacgcacttgctcccggaggctgcgccccggcgcctggaacccgaggtgggaggaccggttggtgtcaccctgctcggccctcagccctgccgcgtggggcgcgtgggcacggagcttcctgcctctctgctccgacacccggcaagcagccggagacaaaacgccttaaagcccccggcccagccctgcaggtatattgcaggggcctgggggcggccctggactggcgggcggttccccagtggggtgccctggaggctgccgggcagagtggagcagcttggggccgtgcccagggcggtggctgtgagtctagtttttgctttaccaagtgtacagaaatggcatttacgtttctctgatgctcccttgaagccatagaatttaggggcttttttaaaaaaataaaagaaaaatgaaaccaaacccaagtgtagagggatttgtctgggctttccacgaagcttgacctggaacgggcgttgcttccatccccatcctgcctgtccgggacgagtccggagcggctggcggcctccggtaacagaaaccgactgatgaggcggaaggtaaggaagatggaagcagagggcagagctgggctctgtctggggagagggcaggagacgagtgttcacgtaccatggaaaggggaagtcacacacatgcgacttggccccgggggtcccgttccccgacactacacaaatatacctgaaagcctcagcgacggggcccaggcaggatggtcctggctgctctgacggcggaaggcctccttgactccctctgttcacgcagcagggcagaaaacatctccacgggggccacgaca

SEQ ID NO: 90468 - DNA, 1056 bp, Homo sapiens
ctgcaacgccccttttgcctaaagcagcaggccctgccgacagggacctgagcatctttttcttccttccttggcctctgaggtcctgagagggaactccccaactctcccgccccagtcagcggtcacaggggagtctctgggcccacaacagggccggcctggtggctgagaccctggtggctcctggccacgctcaggaaggcccgtgtggtcagggctgcatttgaaccggccccgcactggggatctgccgagggctgggtgctgatgtccccaccgcgccccccgtcgatgtctcttgccaggcgcgactcttcgatgaaccgcagctggccagcctgtgcctggagaacatcgacaaaaacactgcagacgccatcaccgcggagggcttcaccgacattgacctgggtaagggcccaggagcccaggtgtgggaatcccagcggggcctcggcgggagggtccggggattgacagtgggagctttgggcctgggggagttgcacaggtgagctggggcctcaccacttgcagcaggtcaggagtttgggtcctagcacagccccacgggagtccggggccttggccaggaggccacaggccagagcccaccatcccagctgatggtgaccatctcgtcctccgatggtccatggctttgactttgctgttgaacagcttttgtcaaagctactcaagtctgtccttgtggcttaaaaacaaccacagccgaggaaaatgaaggggcgtggtcttgtgttgataaagctttatttataaacacactcacagggccagatttgggccacgggccatagttgccagcccggctttaactgctggtcctcacgttagtctcactgcctcctgcagggtgggcatgtgggtgtcgtgttcacgcagccccttcctccaccccacagacacgctggtggctgtcctggagcgcgacacactgggcatccgtgaggtgcggctgttcaatgccgttgtccgctggtccgaggccgagtgtcagcggcagcagctgcaggtgacgccagagaacag

SEQ ID NO: 90469 - DNA, 1074 bp, Homo sapiens
gtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgctgtgtgcctgagttttagttttctgtcaccgcataaggagccatccacaaccagttggtgcaaaaccacgttgttgctggtgatgctgagtcaggagttttgagggggtgcgctcctgtggggtctgtctctgctccaggatgcctggatgcactgctgggaagacaggcaaaaagctgagctcggctgggagcagtggctcacgcctgtaattacccagcactttgggaggccaaggcaggtggatcactcgaggtctggccaacatgatgaaatcccgcctctaccaaaaatacaaaaattagcccggtgtggtgcaacatgcctgtaatcccagctactctggaggctgagacacaagaattgcttgaacccagaaggcggaggctgcagtgagccgagatgatgccactgcactccagtctgggcgatgagcaagactgtctcaaaaaaaaacaaaacaggcctggcgcggtggc

SEQ ID NO: 90470 - DNA, 1015 bp, Homo sapiens
gttttttaagctatcgccagccggtgtccagcgggctgcccctcctctgcctggattcccaggcactaagctcagctgaggggggtgttttatagaaggtttttgcttttgggttttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaa

SEQ ID NO: 90471 - DNA, 1028 bp, Homo sapiens
ttttgcagaagtcataggtctcaaatgtgtctctgagggctgtcagggtcacaggtggagagcagcctccactggctttttttttttttttttttttttttttttgaggcgaagtctcactctgtcaccaggatgctggagtgcaatggcgcgatctcagctccctgcaacctccacctcccgggttcaagtgattctcctgcctcagcctcacaagtagttgggattacaggcgtgtaccaccacacccagctaatttttatattttcagtagagacagggttttgccatgttggccaggatggtctcaatctcctgacctcatgatccacccgccttggcctcccaaagtgctgggatgacaggcgtgagccctgctttctagagttgcagggcgttaagtgtggtgaattccagccgtggcagtggagtttctggccccttctcgactatgagcgtcccaccaacccaggtgctgtgtcctttcgcctgtttcagatcattgagaagcagccaggccacattcggagcagggttttcagggaggtggagatgctgtaccagtgccagggacacaggtaggtgagccacccttgccaccgcactggcctgagctgtctttcagtggatgaagggcctgagtgccacatcacccccagcaagcgtctgtagggcacccagtttcccaggccctgcattcccctccctgaagcaggctggctgacagccccaggcgggcagtgtgaagctggcctattgccccagtcccagcttccggtggacaggccagcaccaagagggtgggcccctcctaggccgggcagcaggtacccaggggcctcaggaagcctcagctcctctcctgcccccacccccaccccaggaacgtcctagagctgattgagttcttcgaggaggaggaccgcttctacctggtgtttgagaagatgcggggaggtacctgggggctccaggctgtgaggagggagggagctgggaggtattacgggatgggggcctagtgccac

SEQ ID NO: 90472 - DNA, 1048 bp, Homo sapiens
ggagtgcagtggcgcgatctcggctcactgcaaggtccacctcccgggttcacgccattctcctgcctcagcctcccatgtagctgggactacaggcacccgccaccctgcctggctaattttttatatttttagtagagacggggtttcaccctgttagccaggatggtctcaatatcctgacctggtgatctgcctgcctcagcctcctaaagtgctgggattacaggcgtgagccaccgcacccggccattttttgtatttttagtagagacagggtttcaccgtgttgaccaggctggttttgaactcctgacctcaggtgatccacccaccttggcctcccaaaatgctgggatcacagacttgagccaccgtgcctagcccctgcacacacttttaaaatatccatcttttttccttacacagggtgagaactctgtctcagtcgacgggaagtgcagtgactccacgctactgagcaacttgttagaagagatgaaggcgacgctggccaagtgttgagagctgcctgcgagccccgcaccaccccgcggagcacgtacccagggaccgcagccctgacgtgtctcgcctctcctcagtcgtgtgtactgtacccaagcctgagtgttaatttaactctatgttgtccgccgtgtagacatccgaggtcatttgttgcgttgaattatctgaccatccttttttactgtgactcttcccattctctttggcaagaagtccccttctcgcccccaaaccagcaagggactcccccacctgggtctgtgccctgccccgcgctgggggccgagtccttgaatgtggcttcaggggctcctgtcctgggccagggcctgatgggcaccacgtgaggggcacttggtggacagggcggggctgacgtggcctcctctggggtcgcctgcttttgacccaaaggtcctgacggttgcgtccgggggaggggaaggaagggccgctgtcgccaaggttttctctcccagaacccacagtgggaaagcggtcttgccaggcgttgtcc

SEQ ID NO: 90473 - DNA, 1409 bp, Homo sapiens
aggcccctggaagtcctgaaggctggaggggtgagaccaaggagccagcagggcaggctcctcctgaagcctctcctcggcacggcttggcgtgcggcaccccctcccccctgagtcctcacaggccgtcctctgcgtgcctgcatcctagcctatccccccagtcccttcctacaggacatccgtccttgtcggaggagggcccatcccatggcttcaggcacctctgtgacctctttaaagacaagtcattgtcagtttctgggtgtgacggcttccgcacatgaaaatgagccacaccttccaggacccccaagacctcccggcccagacacacaggagggtgtccaagcgcagcgtgtgtggcaggttttgttggcctctgtgccaggaagcctgaggagcccggccccaccgcagtcagcctccctgtccctcccacagtgacgcctttgctaagttgctggagtctggggacttgagcatgagctcaatcaaagtcgatggcattcggatgtccttccagaatcttctggcgaagatctgttttcaccaccatttttccggtaaggagagtgaggggctgatggattgcacggggctttcacgcacgcggcagctgtcccttcctattggagccgggcctgtggccctcccacccaaactcacaccctttgggatcccgggtggctggtggccccgaggcctgggagctggtgcgggggctgcattccccacaccccaggcctctcagggccacaccctgctcctacaggcctcctgaagctgtggccaagggcagcccaagaaggtggcccctgctctgggggtggggctgcagccatgcaatgtccgggaagcctaacactgcccgctctgttgcagttgtggagcgagtggactcctgcgcctccatgtacagccgctccatccagggccaccatgtctgcctcctggtgaaaaaggtgagcctcgggctgctgtgcacaccctggctcctgccacctctcctggggtcatgcccaggccttcatccccagaggcgcgctttgggacttagagggctcgaggacagtgatggcagcactgctgccatgagcccctcacctgtgccagccccactcagcagcacagactctccctcagcaagacagggcttctgcctcctgctgcgctgctcaccgcaggctgacacatggctccaggggccccactcccactgcactcctgcccaccaccccacccctgtgcacaaggcagccaaggccctggggtcggactctccacctctcactgctgcgcttctagaatgactcctcgctccctccgctccgggcctccctctcctgagtactgcagggtggttgtcttcgcagtgtgtcgactgccaaacgcagtgtgtgaatatt

SEQ ID NO: 90474 - DNA, 1025 bp, Homo sapiens
cgctgaaaattcctatgttaaaatggtgagtggcagccgctcccaggggcagggtgggccagcccacactctttggcatgggatcgcgcggaacccgggcagcccccacagctcccggatgttggtatacccagggcctgtgattcctggcaggggcgttgcttgggcagcacctctggcttggggtaaggttggagacatgccctgagacttggactggcaggagggtccccgccatgcactcaaagagcagccataggaggcgcttggcctgcggctagggggcgcccctctccgtgccttcctgtgcctgtgggacccctgctgcctctgtggtcattaagagacaggtggctgtgcctgttccctgtggcgggcccgcctgccctgctaacactggccatgccctgcagacctgtgacatccggggcagtctgcaggaggacagccaggtcactgtggccatcgtgctggagaacaggagcagcagcatcctcaagggcatggagctcagcgtgctggactcactcaatgccaggatggcccggccgcagggctcctccgtccacgatggcgtccccgtgcctttccagctgcccccaggtgagccctgccccactcacggcctctcctggggactgtgggagcgcagtggcagctggtgactgcccggatccgctggttcttgttgcttcctccccatgtcccctttgtccccaggctgcacctcagtacctcctgagtgtcggggtctcgccacagctctctgagaagcgcaatggcctcggatggacctggctagagtcccaagggttgtgctgggggctggattctggggccttcttgggttccacggttccagtggccaagtctgccctctgaaacagggatgggaccaagtccaggccaaattagggacaccagtagcctcttgtttctgctcctgtcccctggtgctcccttgggggctgagctcagtttcctaatcagccacagaggacttgggactgaggacagacctggag

SEQ ID NO: 90475 - DNA, 1045 bp, Homo sapiens
gaatattcacgtaaaaaaagtgaacgaggatttgcttctctctgctcataggcctgtggggtcactcgtgtgacaagctttccagtcctcactgtcttaaagagtcgggtcctcgggatgcgctcgctcacggcgctcctcgcggcccagggctctggcaggaccccagctccttaggatgttggggctgcgtcacgctccctgcatccccgaggcttgtcttgcacgtgtgtcacccctcggtgcaccggtaacgcctgggtgttgcctttgcagcggtaccaggacaccccgggcgtggagcacattcccgtggtgcagattgacctctccgtccccttgaaggttccaggcaagtgtctccggtgtgtcggcgccgcatttgtcacatgggctgtggggtgctcccgccgccctccccgtgagcccctggggtgcagtgctgagtggctgcccgctgccggcccgcagggctgcctatgtcagatcagtatgtgaagctggaggaggagcggcggcaccggcagaagctggagaaggacaagaggaggaaaaagaggaaggagaaggagaagaagggcaagcgccgccacagctcgctgcccacggagagcgacgaggacatcgcccctgcccagcaggtggacatcgtcacagaggagatgcctgaggtcagcctcgctggaggtcccggtcctaggatgtctatctttccgcatgtgtgtgtcctggggccatgcacagtggcctctccccatggtcttcgttggtggctgggatgaggccccaccccggagagcataggaggagaggcctctctgtcctcgagcacgcgtcccgacgcaccgccccagggccagcagcttcagaggcagatgcaggttggctgcgtcctggggcccagccgcccttagtgcctagacgctgagcggagcctctggtggagccacgtcactgcccacctgtgcgtgtggcccgcatgggcagtcccactgcgtcccagatagatggcgttccaccaggccacaagggcgggttccagtga

SEQ ID NO: 90476 - DNA, 1048 bp, Homo sapiens
ttggagctgcccagcctggctgtgtctgagttggagccagcacagaggcggggagcccgcgggggccgagggaggtggtgcttctggtgtcggggcactgacctgatgggaggcatttctgcagtgggcaaagctccctgttgtgcccccatctctgttctgtttccggactggtctgtttctgccgcttcctggcgaggatgatgacgacagagacggcatgaaggctgggctctctgtggctatgtggctgtaccagggggcccacacgtcactgtgccaggggctgagccaccccgtgtccctgaaggtggccgagtggccttccgggcaggtgccagcagtgacccctgtgtcccccacaggcgtcctgcatcctgcagctggtcaagcacatccagaagcttcaggccaaggacgtgcctgtggcagaggaggtcagcgctctctttgctggggagctgaacccagtggcccccaaggcccagaagaaggttccagtccccgaagggtaaggatacgggggtgggggcattgcaaccatggccctgacatggtcccttgatgcctggtggcacagcgggggctcctgcacccctgaacagccaggagggtgtggggctgattggaggcctcaggcgggtatatccctcacacggactcaccaggtctctcactggttctgggatctggcttctgcctggggatgctccctgcgaagtgggcctgctcccacccttgccataaagctctgaggcagcctgagcctgccgtgggggccccactgtgaccctgccgcagtcttcctgggtccctgcgtcctcttaaggggcagtgacacctgcctcgctggccctgtgtgggtggcaggccccactgtttgggatatcacatggccaggcacgtggtgagcctgctcagggcggacgcctgcaggcgcgtgctcggtcacacactgccttgtgtggccctcctgtccggtgcagcctggacctggacgcctggatcaatgagccactctcggacagcgagtcagaggacgagaggc

SEQ ID NO: 90477 - DNA, 1025 bp, Homo sapiens
cagtgctcatctcgctgtcctccggcatgcccaaccacagcgccagcatccaggtacgtcccgcactgggcggggcccatggggtcccacactgcagaggccacacctttccacaggcgggagcttgcccaccctgtgaccaaggtgctggtccccccacgccatcttgcggcttgggagggcacagccgcgtcctgtgtgcactacctacccgagcctgcttgggatccccatcatgtgtctgtggggtggatgcatggggcactgaggagtgggggagagcgcccgtgggaagcagggcctcccttgtctccagtgccccatgtgggccatgcttgtttccctcctgggctttgattggtgggtggggctgacgccgggccttaggccaggttgaggttgaatctggagggtacctgtgggactcacccttggtttagaggatgtaaccagcatcgtttttttcttcttttcagctttgtgttcagaaattaaggatattgatcgaggactccgatcagaactgtgagtcatcccctccccagtgctgtcattttcgtgtccccagctctgtgaagttaggggtcctcctagtgtgaggaggaagtggacacggcatctgcaaccccagctgtctccctgatggatggcactctgcctcagaggcagccctctgccagtgccctgtggcgcccttgcaccccgacctatctgcgtggggtggctgggaaacaccagctcctctgagccccagtcccaggggagatgcagggggcatggcaaaggcccccactggggagatcctggcagttggacagatgccactcactgagcaccttggtccgaaatttctggatatttcagcctctgcatgtttttgcgggggtgcgtgaggctttgcgttgtgagatagagcagcacacagcacccttgcccaggtgcctgcctgcatgtgggtgcccccgtgctgctctgttgaggaatcagaattagcggcccctgcctggtaccttgtacctgggcgg

SEQ ID NO: 90478 - DNA, 1293 bp, Homo sapiens
aaggccctgtgtgcaggaggggagaccccagccctaagcccgggacccgatgggcgagcttctccctggagtggtgggcatggatgcagcaggaagactccctgagccccgatggctgggcagctgtttctggagccctcatgctgaaacccccactcagagggccgctgtcaggctgtcctgagcttggtgacgcttgtgcgcacttgttcctggcaacagtgccgagcaatgctttctcagcgccaggagctggctgctgtggcctgttccctggaggatcaggtctgtggctgctgtccctgtcaccaggaggaggtggcagagccagggccatgttcagtgggagctgctgcaggccccagaacttcctcgcgggccaggaagacagtaggatggttttctaggtggaaggacaggcatgctgatgagaaccccttgttccccaggggttcagtcggctgccgtcaatgtcatctgcgagctggccagacgcaaccctaagaactacctgtccctggccccgctctttttcaagctgatgacgtcctccaccaacaactgggtcctcatcaagatcatcaagctggcaagtactgcccgggaatgtggcctcctcaccctgtgtggggcattccctcaccctgtgtggggcattccctgcgggtgaccgaggccccccctgtccctcaccctgcgtggggcattccctgcgggtgaccgaggccctgctgtccccacagttcggtgctcttactcctttggaaccgcggctgggcaagaagctgatcgagcccctcaccaatctcatccacaggtgagtgcaggccatgcgcggtgggggcgggccggctccacggggtgcagtgtcggagcggcgggggcgggccggctccacggggtgcagtgtcggagcggcgggggcgggccggctccacggggtgcagtgtcggagcggcgggggcgggccggctccacggggtgcagtgttggagcggcgggggcgggccggctccacggggtgcagtgtcggagcggcgggggcgggccggctccacggggtgcagtgtcggagctgtggggcgggccggctccacggggtgcagtgtcggagcggcgggggcgggccggctccacggggtgcagtgtcggagctgtggggcgggccggctccacggggtgcagtgtcggagcggcgggggcgggccggctccacggggtgcagtgtcggagctgtggggcgggccggctccacggggtgcagtgtcggagcggcgggggcgggccggctcc

SEQ ID NO: 90479 - DNA, 1128 bp, Homo sapiens
cctctttcagttcacctagggcgtagttcgctggttgcagggtacagttctatacgttttgacaaactcattgggtggtgccctgaccagtgctgccgtccaggtgcagaacccccagcttccctgcggcgcccccatcctcagcttgcctgggagctcctggctgctccccacctggccttacctgtagttctgccattctcagaaagttggctgaatggaatcaacagcatgttgccctttggtcctggtggctttcaggcggccaaatccgtgttgctgcaggtttcaaaagttaccccatttttttgctgactgtaaatccattggacagttgggccacagattgttgacgtgtttgcctgtgggtcacaggactgtgggctgtttccaatttttggtgattagaataaacccgcactaaacaccactggcgggatttttggtgaaagtcagtgttcgcgtggcgaggttctcaggggtggaccgcacggcctgtgctaagcgtctgtttaacatctgcatcccaacagttgccacttgtcagtgctaagaaacccactggaacccagcgtcggggcctggggtagtggtcttgccagggaccctttgccttttccttggtactgaagtgaacattcacgtgaaggcagccctggtgtccccgcccgcatgcctgctgccctgcctggccagtgctccattgtaaatagtaagggcgagagctggcgggagcgggctttctagtggtgggcgggactgtgccgtgtctttccctccctggccaggccctggcttggcagggtgtgctggtcctggcgccgtctacggcctcttcctgctctggttggcccactgccgggcccagcatcttcattcgcccaagtgccagaggcagccttctgacaacctcgccgtgacatttgtcattttctgtgttcccgttgaggaattttgctttctcacaagaagtgaggggtggttctgattttcttttcttttctttttttttttttttttttgagacagagtcttgctctatcgcccaggctggagtgcagtggcacaatctccactcactgcaagctccgcctcccaggtttcagtgattctcctgcctcagcctcc

SEQ ID NO: 90480 - DNA, 1048 bp, Homo sapiens
cttatttttttgagagggaatctcgtactgttgcctgggctggagtacaacggtgtgatctcggttcactgcaacatctgcctcctgggttcaagtgattctcctgtctcagcctccccagtaggtgggactacaggcacccgccaccacgcccagctaattttttgtatttttagtagcgacaggttttcactatgttggccaggctggtctcgaactcctgaccttgtcatctacctgcctgggcctcccagagtgctaggattacaggcatgagccaccgtgcctggccctgcgtggtatttctagggcaggatggccctgcccttcttctagtgggaagggcacaagtggcattattggttgtttgctcggaaagaaccttcaaaggccacagaacgggaccttccccctggtgactcacaggctgtgggcgggcaggggcggcctccactggccaagggtccggactctctgactctcattaatgagtgagtacatgttccgcctgacagcctggcctggagcccggctgtgggcggcggtgagtgggcagccagcagtgagtagcagccggggcggggtgagctgtccccaccgtgactcagaaggtattttctgctgctgacctctgagcttgagtgtcctgagtaatcccagctcccccggaggcagattaacctttaggcagctttgtgtgagtaaaggagtcgctttaaataggaaggaataatagaaaaaacccaagtgttccgttttatagcaaatgcacactgctttgttcctgctggcctgaaagaggttgcagggggtactggggcggggaattgtccagaaactctgcagatgatacagggacactccagcctagcctctgaggagagttttttttgagacggactcgctctgtctcccaggctggagtgcagtggcccaatctcggctcactgcagcctccgcctcctgggttcaagtgattctcctgcctcagcctcccgagtagctgggattacaggtgtgagccaccacgcccagctctttttttcct

SEQ ID NO: 90481 - DNA, 1050 bp, Homo sapiens
cctctcccaccctacattgagcctcagtcagatcctgctcatgagccttcctggggtgccataagattttatcagccaggttgctgtgtgtctgtgtgctggtgacgtggggataatttgaggtggacggcagcctttccagacctgcaaagtcttgggcagccctgtctgtctgaacagtgaacatcacatagggccctgagactcaaaatggattctggtttcgggggccaccaagtgatgtccatggatgacgcgttgtgatgaccgtcccctcgtgggggctctgtcaggggcctggtctctgggaaggatcctgagtgaccttggagcatcggatatgtgtggagactgtggcctcccctgtgggtcttcatggccgcattcttgtggcctctgtctccgagcctagcacggcctcccgggtggcatctgagcgctgtgtggtatctgatggatctctctgatcataggtgtgggccaggtcgtgctccaggttgctgctgccaccaactgcaaacatcactatggcgtcgagaaagcagacatcccggccaagtatgcggaggtgagcggatctgagggccagggtgtgttggaggcaggggaccatcagagaaagtgacgccctgggtgcctgcaccccactgctgtgggacttccgagtctgggtggcgttctttccaggcccaagacgtcttggttgcctgcagcgtgtgcctgtgaatagggtgcccgatcgccctcacggcccattacaggccggccctccaggcctgtccaagcgctgcaggggtgtctcggagcctgtttcatggcacgtgccactagtgaggcgagaggtgctcagctctacctcgtggcacagccctccgagaagcggggtgttttgggtggcctgcccaggcaggcgcattgaggccctgttgctctgagagtttgttgttgtttttttttgttttgttttgtttttgagacagagtctcgctcagtcgcccaggctggagtgcagtgactcgatctcggctcactgcaagctccgccacctgg

SEQ ID NO: 90482 - DNA, 1059 bp, Homo sapiens
gaggcgtgaaggatttacaggacttttgtggacagagacaggcccacggtgggaaggagccggcccctcccatgccccctgcctgccttactgtgctgcgtgctctgtcagctcccagccttgcggggcagcacggcctcctctgaggggcttccctgaggagcgcccacccgggaggtgcctgtgttgctggatgctggccgttcttgcagccgtgatctaagtcgcttccagatcttctccccctccttttccattccactcagctgggtttgtggctgtttttctgaggttggaggggcccaggccaggtggtgttgaatggtgcacctccctgggccggcctctgtgggccactgtggcctgacgcagtgtgggagaagagggaagacgcgcagctcaggcttctgtccccacgcctgccctggggtgggtgaggtctgcatggaggggctgtgggcaggcgcaggccccggcctcacctgtggctcctgcagacatcggcaccatcatgcgcgtggtggagctctcgcccctgaagggctcggtgtcgtggacggggaagccagtctcctactacctgcacactatcgaccgcaccatagtgagtatctcgctgcgcctcagccgcagggccgtcctggtcttccaccccgcccacgtcacactgctctctcctttctcatgtggcctctgagaccctcccctcagagccctcaacgccccccggcccctgagctcaggcccagctcctcaaggcccctcagtactgcttgcaccgcaggacccaccagggtcctcccaggcactgggcgtgtcctgggtgagggctgagtgctgtctcccctagtctacgctcagctcctggggtggggcggggccatcagagtgatgtgtgaccataagggtcccggccgccatatccagaggcccctgtggataggagtcccacgtccctgttcccagcttcctccatgtgagagggtcctgagcggggagacaccagggtccatgggtggggtctgggatgcttcttccctccctgtgttccccagggtc

SEQ ID NO: 90483 - DNA, 1330 bp, Homo sapiens
ggaacggcccgaggtggccggcgcaccctgtgttccccttcccgtgggtcgcgccctccactaactcacatcagagaacttgtgcatggcgtcccatgtgtgggcctcggtgcctttcgaagagaggagagagggcaggggaggctgtgggctgtggcttctaggtcctgctgcctgaggggcttctcgtctcctgtcttggatgtggttctttttctctgtggctcacagtctggcttcttactgacaggcatctgtgattgtgggagtggctgtgaatgccgttatccgtgcccacgggtcacgtcctggcctgcggggccccaagcagcccactgctgtctctgggcctcagtttcctgatttgtgccacagaggacttgcagtggacagagttgggcccgtggcccccttgagtctgagctccgcgtgcctctcggtgcaggagggccgtgggcagcgctggggcttcctgtggctcaacctgctctccttccaggaggaacaggaggcagcccggcgccgccagcagcgcgagagcaagagcaacgcggccacgcccactaagggcccagagggcaaggtggccggccccgccgacgcccccatggtaaggccccagcctggctcctgctgctggagggcacccgccccctgcccgggagaccccatgggtgggaggctctgtgcccatccctgttcttcccttgtgtcctccaggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaactgcactggatgccctgcacgctcagaccgtgtctcagacggcggcctcctcaccccagggtgagccgcccccacgccacggcccccgctctccccgagtgcggatgcctggggtcccctctgctgggacgctgccctcctgagccccgtgtgttcagggtgtccctggagcctccctgttgtggctgtgccttcagggtggccccatcctaaggggttgctgggcacctgccccatgctgacgcctctgcccaccgctctcccgacccgccctgtgctgacgcctgccctccgctctcccagatgcctacagatcccctcacagcccgttctaccagctacctccgagcgtgcagcggcactcccccaacccgctgctggtggcgcccaccccgcccgcgctgcagaagcttctaggtgagcccgtgtgaggcg

SEQ ID NO: 90484 - DNA, 1023 bp, Homo sapiens
ccggccatcctccaccacgtgcggcctggcagcctgggaagaggcggccgacagctgtctctggggttcggagtgcgatgcgctgcctgcaagcttcttcattctcggctgtggggccttagtggtggtgggcacatcaggagggggcatggggggctctgggattgcggggtggtgtgtgaggaccaggaagaaccaggacaggggctgtactggccgctgggcagggcatcagtttcctcaggagaccctggggtgcagacaggagcctcctggggcgggggggctctcctgccttggggtcccgggtctgtggtatgtgcatccattgtgtctgtctgccctcaggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcggcgagtccaggggcccggaggggggcggggcctggcagcaggggcaggaggtgcctgctcactgtgtgtgtgtgggtgggtgggtggggaggaccggcaggctcttagggggtgccctggatgggaggaaggcgtctgttttgtgaggggcctccccacaggtcctgggccccgttccgggcagggccggcctcccgggccattcggggtgggacacgagcagggccatcggttagaagaggcaagctgaggaggagctgagcgcagcaggagagaagcttcagcagtgaggcgttggaggtctcatccacacgtcttgccgagtgtattacagtagctttattagataaaattcacatatcgtattctccatttaaagtgtgcaattcagaggtctttggtatatccacattaccactgcctaaatccagaaccttccatcatgtcctgagaaaatctcatcatcccc

SEQ ID NO: 90485 - DNA, 2271 bp, Homo sapiens
gggatcgtcaccttgggtcccctgtttgctttgcaccctggccttccccccgagtggtgcctgcgtcctcagtgaggaccctgacctgctctggggcagccccaccttccctcccgcaggctgctgacctcagcattttccccagagctcatcccgcatggcctctgagacccgcttcagctgcctctgtcctgtcttccgccctcctgtcccatccagtcccgtcccctgccatctcatcctgtgctgtagtcctcctgtcccatcccatcttgtcccctcccgtccccttccctcctgtcctctcccatcctgtcccgcttggcatcttgagtgtctgtgaccagccctgcctgcagagttgcccgggccgtggcagcagccccggttagcctcatgggtagcccgggcaggtgctctgggctcacggcttctgcctttcctctttgccaggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtaggcagggcggccgtccgtccgccccccgccccggcccccgccggaggccccttcctttgcaggttcccttccgcactctcttgcagcaggagctgagctgcaggtcccctggtgccggccggcccccgccatccgtgcacggtggcgaactccagtcctgtggggagagggctcacgctgagtccgtgtgtcttgggttctctggttgtaaccgcgtccctcttgttttcagaaggccaccgtgcgcagggccaccagagcattactttctcccgtggaggtcacctgctaggtgtggccgcccgggctctggcaaggctctgggagctggtgttgggtaagagcgagtccccgcagtgcctgcccagacagggcggagaggagccgccggggggagcggcctggccctggggctgctgcggggcggggggccggagggcggagggcgggccaccacgagcctggccgagccgctgcttgtgcttggtgcccgcacacgcctggcggcgccgtttcgcttccctttttgtgagcctgcggctgctgctctgcgcttgcctggatgctgccgcttgttgaagctgcgtttttctctcctatttgcaggtgtctttaaccacgcggtgccctccgcctctgctcatccgtttggagcccgtgtcggccgcggggctgcatgtggcagcgccacactgggcccgagcccgctgcaggcggcggccagcgcctcggcctcttcctttcaggccccggcctcggttgagacccggccgccccctccgcctccgcctccgcctcccccgctgcccccgcctgcgcacctgggccggtcccccgcggggccgcccgtcctccacgccccccctccac

SEQ ID NO: 90486 - DNA, 1523 bp, Homo sapiens
ctctgcttgcccctggccttctgcctcaggggcccctgggacacaggccttcctgggcgagtccaaagcccaccgggcaaggagaggaggactgggagccaggagccaaggcggaggctgtggccagggctggtcagcctggcgggtcaatgcgggcacctgcgggctggacaagctatgctgggtctcttaggagatgagctgcaggtagggtggctttagctggactcggctgtgtgtctcctttggaggaaggctggagcttggccggcgtgtccaggtgtcaggctccctggtctgtcacggggcacgcccgtcgtctgttgtggttagaggagctggcactatgcctgtcatggtgctggccccaggtggcgtgtgtgctcgtgggaggcctcggtccccagcctgggtgagtgttgggctcccccaggcgcgatggtaacctcaggccgctcttcccgctgtgcccttctgcaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcc

SEQ ID NO: 90487 - DNA, 1866 bp, Homo sapiens
cccacttctgactccggagtggctgggcctacaaggccccaccaccacacctggctaatttttgtttttgtagagatggggattttgccatgtcacccaggctggtctcgaactcctgagctcaagcaatcctcccaccttggcctctcaaagcgctgggattataggcatgagccaccgcacctggcgacaacctcattttgactagtttatatgcaaagaccctgtttatatacagggccatactcatgggttctggggggtcaggacatgaacacatctttgtgggggccagagaagggacagtttatgggcaatggcaagaggaagctgcttgtggctgtgggtaggaccgaccacaggtgttccatccccaggcttcattgaggaccctgagaggaagtatcactttgagtgcagcagcgaggagcagtgtcaggagtggatggaggctctgcgtcgggccaggtggggccaggcggtggtgggcactgctggggtgggcacagcagccatgcagagcgggcatttgaccccgtgccacccttttccccagctacgagttcatgcggagaagcctcatcttctacaggaacgaaatccggaaggtgacgggcaaggtgtgtgcagggctgcagagggccggggtggggctgcaggtggcagaggcagtcctccagccctggctcatggccacccgtcctccccacaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccacactggatggcggtgaagtgaaggagaggggaggggcagccagggagcccccacccaagggaagtaaggctcagggtcctgagaggcagtggctgggcctcctgcactgaggggagagctagaacccccagccaggacaggtggaggctgggacccaggcctggggagaacagagctgctgtgtggtatcaggaatcctgtggtgacctggggtcctgcctctggcattcacgggccctcccggagtgtggctggggcctgggcgggctttggtccatctgatgtgaaaaggactttgccgatgtcattggggtcgcagatctggttttccgttcatcaaaaggcactttgcctgtggcctggtgccctcataagcctccccttgcctgtggcctggtgccct

SEQ ID NO: 90488 - DNA, 1810 bp, Homo sapiens
tgcggccactgtgccctgtccctcagcgtgcccctgcacacctgcagacactgtgacacatcactgcagacgcagtagttcagatgacacggctgtatcagcttctggttctggggtcagagtccaaacagtccacagggctccattccttctggaggctctgggggacaactcgtttcctgcctttcccagtgtccagaggcacctgtgtgccttgcctcggggccccttcctccccattcacagccacagcgcagcctctctgactctcagcctcccgcctcctctcatgaggtcacccaggatcacctgccattttaagatcctcaagcccacctgcacatcccttttctgccatgaggggacatgttcacaggtcccagggattaggatgtggacatcttttgggggcagtgattcactcagtctcatgggccccatctctctgagctcacccaagacccttaaaccagggcccggggccaacattgagcaggcaagggaaagactaccaggagatgagaggaggctgcctggaactcagatttgcacagagcctgaaagggcgtgggagaccttggcagaggcctgcatcaggaagaggatgttggggactcagcagagccccctgcgccacaagcagatgtggcagatctcccaggtgttactcagtgaggatgcgaagatcagtgtcctcactgatctccgcctaacaaatttacatcgagcccaagagattaggttgggacaagtaagcgtagccaaccagagagggaattcagaggaaggcgtgaacactaggggcttgggcagtccgggatggcttcctggaggtggtgactcgtttgtgagatcttggtcttgtcttccctttatgccttctctgggctccctattacaatttcaggtctccaggccttggcaccctgggctggagcggcttcctctccatccctcatgcctggtcacttggagacaggctccagcttccttgtgtctgtgcctgtccacagtgggcctcagcctcctggaagagactgggtgcgctatggggtggccccctcagggctggttagaccctggcgctgggagtgcagggtgaggggcagtctcgagggctccagcccagcccgcccagggaggtcccagcagcagccccgagttctgagccatcttcctcactctcctcttggcctccacaggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggtgggccagccaccgtgcagctgcctgtggtgggtgctgggctttccagggcagccctggagagggtgccagaggctcttcttgggcctccgcccaggctgggcgatgcagccccgtgtccagacgctcccctgttgcccccgagcagccacagctcccatctgtccaccccagagagcagaccctctgtggctctgagtcccatgtggacatgttttgttctgtccacagccttctgttttgcattatttaattttctgggagtggggagagctgatgtcagtccagccagatgtggtgaagggcagcctttgattttagcttgtgcagaggcaggggtgagccgagtcccctcagcaccgtggacatcggggctggagcactctttgtgtaccctgacatgccccacgggcctggcctatggcaagggctctgttaccgtccc

SEQ ID NO: 90489 - DNA, 1177 bp, Homo sapiens
ggccccccgccctgggaaggttgggctgtcctgggcggcgccgcccgaggagtcggggctcagtgactgctgcccttgtaggtgcttggggcaggcgttggagctgccttcgggaagcctcgggggtgtgggaccgggtgggcccctgcctgggcggggcggggtcttttggccgaggcaggggtggggatgtgctgaaggccgcccggacgccctggaggggtctccgcccggagcctggcgctgcctcgtgacctgcatcatcttcagttccagggtctccctccactgctgtagtaacccgggtccggggcctcggtggtgctcctgatgcccctcacccacccctgaagatcccaggtgggcgagggaatagtcagagggatcacaatctttcagctaacttattctactccgtgagtatggggccgggcctgctggggctgctctggggccacaggtactttcttgtgcaccttgctgcccgtacctgtgattgaatgtaatcgtgggaaccctgagtttcatcagagccggcgcacagtctcctgcagcccaggcgttgcctgagctcaacacggcctaggcccaagctttagcgctgccgggttcttggagtcctgtggggtgagtcagggttctgaattgggctgcaccccctggacaggatgatcggctgaatgtaacagaggaactaacgtccaacgacaagacgaggattctcaacgtccagtccaggctcacagacgccaaacgcattaactggcgaacagtgctgagtggcggcagcctctacatcgagatcccgggcggcgcgctgcccgaggggagcaaggacaggtgaggggcaaggacaggcagggagtgctcacccaggggagcagggaccaggtgaggggcaaggacaggcggggagtgctcacccaggggagcagggaccaggtgcgggttgctgcccaaggggtgcagggacagatgagggagggcactgccttcaggcagcacatatgggggccaccatcgctttgttggtggggacagggtccccccttttttttttttttgagatggagtcttgcttttgttgcccaggctggagtgcagtggcatgatcttggctcactgcaacctctgccttccgggttcaagcgattctcctgcctcagcctcccgagta

SEQ ID NO: 90490 - DNA, 1054 bp, Homo sapiens
gccgccgcgcacgcggcccagcgcagcccccgcgcgcccccgccaggcgcgccgaggagaccggcgggcggttgcgcgcggcggcggcgcgcacggcggagcccgggaggcggcggcggcggcggcggcggcggcggcggctgctcgtgtcggctccgggcggcccccgcgccgcagcccgcgccgtgtccgcggcggagccgcccaggtgagtggccgtgccggggcccggcgtggggcgcgcccgcagacctggggacccctcacctgcaccctgcgaccctgccgcccaaagcccccaacccgcgaccccatcctcagccgggggaaattgccccgcgcacccctcccgggctcatcgctccttgccaggcccccgacgctccccctggaaactttgggggcgaactccccaccctggggccccccgcccctcctctggggcgccaaggagcggggaatcgggtgggcatctccccggggcactggggacgctgggaggatgcgctcctctccaggaggagatgaagggggcactggttgggtctggggtgtggggaacgtccgaatagagcctgcagcccgcgccttcctgccctgtctcccccgagccgggtctggtccagcctgggggtgcggagctggaagacgcaaagggtatctggggtccacaccggagcctgctccatcgctggagctgacggcccggcctggcggggagggacctgggggcatagggctgagtccccctgctctgggggcgtctgaatagcaccagaaatggtgggcctgggcaccctgagtgggtgccgccacctcccgggcctctggggcctggccaggggaggccctgagtcccattcaacaagtttaggggagcagcacctcgtgccttggtccgggcacaagaaaagccccgggtccttacgctggagaccaccatgtaactgggtttctcaacgtgtgcttggggcgctaacggtgccggtgtcccggcccccccagttctgaggagtcagaacttctgaggcgatgtgccccagaagctgcattt

SEQ ID NO: 90491 - DNA, 2437 bp, Homo sapiens
tgccgtgtgactcgaagcctagcgccctccctgcgaagcatcagacgccacccagccctggggggaggcccacgcctgctggaccaacgcgggttctggggtgcacagcgccaggttaacgctgaagcctgccccgctgagcccaggagccgggaggcctgcgggctgacccagaatccgatcatgcacctgtcctcatgccagcggctttggctggggttggtctgaagcctgcacgcggcagttctttgttaaagatctgagggactcctcagtcctggggcgtcgccgcctgcagcctcttccaagccctgcgtccagcgagcgtcacagcacaacctgcaaaaacggagctgggctgcagctggggctggcatggactttcatttcagagattcggtttttaagaagatgcatgcctaatgtgttcttttttttttccaatgatttgtaatatacattttatgactggaaacttttttgtacaacactccaataaacattttgattttaggttctgcctctgagtttattcctgaggggaagctcgagccggggcctctgccctaatgaagcggatgtctaagaaagatccctccacccccaaggaaaaaggtcactggctagtgtagctagtgtaaacaggacccaggcgatgcatgggaccctgcccttttttttctagtgagcctccgacgctgttgcacaagctgactcttcgtcacgtgatgcgaccgggctccgccccggcggcaacacgctgtatagacgcgccgggtgcctcgtgcgcatgcgcggcaggcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcaggtgcggggctggccggggacgggcgctgggggcgacagggccacccctgggggccgacgtcgcggctaaagcctcgcgtgtctccacagaggatgacggacaagtgtttccggaagtgtatagggaaacctgggggctccctggacaactccgagcaggtgagacccgcggaggttcggggcaagggtcgcgagggcctagattcgaggggggaggtgtctgcgcgtgcgcagactaacggggaggtgcgacggagtggtcactgcacgtgcgtagtctgcagcccgggcgtcctggagccggggtcagggcggtccccggggccgcgaagtcccgagctgagccgtgcgcccctccgctcccgcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacggagagaaacctctttatttccctcctgaggggtctctgggaagaggtgacgcgtgtccctggaaccccagctcggagggtctcagcctcccctgggttgggagaagtccatctttccccttagtgccaccgggctgctgagtcacgaggaatgtgttgctgctgccacccctgccccaaaggctaagggggacagccttccccttgtcagggcttgctttgaccctgcttcgttccaccccgggtcctggtggagcaccaggcaggtggtcctcgctgtgacactgaggtgctgagccagtgagctagggtggaggggctgtgtt

SEQ ID NO: 90492 - DNA, 1124 bp, Homo sapiens
taagtttacaaacaaggctgacccttcaaaggccagggtctttgtaacatttacagaggatgcattaatttctccccaaatggtcgtcctgggtccagaacaggcaggagaggctgggaaagcccatgcctccagggtggtcccaagcgctggtgcctgtcacttgctggactcctgacagtgcagggcagatgatgagggcacgtgtgcctttgcctgggcgcgtggggccgcgtcgtctgcaggacgggaaggtctggggctcggaggcctcggtgaccttgtctttgggcttgcctgacgccccctgaggtgctccctgtggccccatggaccttgcccctccccactcacttgccctcttgactttcagcgccaagaagagggagggcgagcttacggtggcccagggccgtgtgaaggacctggagtccctgttccaccggagcgaggtggagctggcagctgccctcagcgacaagcgcggcctggagagtgacgtggctgagctgcgggcccagctggccaaggtaggtgccaggagccacgggacgccccagcagggtatatgcaacagacagattgtcacaccagctcgctgtcctgtgtctcccaggccgaggacggtcatgcagtggccaaaaagcagctggagaaggagacgctgatgcgtgtggacctggagaaccgctgccagagcctgcaggaggagctggacttccggaagagtgtgttcgaggaggtgagtgagtggcctggcctccagcctggcacagcggaaacgcaaagtccaccctcatggctgtggagggcggaagcctgagggcaccgtgtggccggggtccctcccacggctctagggaggctccttcctgcctcttagggtgcccttggcttcggctgcgtctccccagtgtctgcctctgtcttcccgcggctgcctcccctgtgtccatactctgtgtatcctacaaggacacttgtcattggatttggggcctgcctggatcatccagagtgacctaatggcatctgcagagaccccatttccaaataaggtccattcacagctgctggggatcgggatgtgggcacgtctttttttgagatggagtttcactctg

SEQ ID NO: 90493 - DNA, 1002 bp, Homo sapiens
ggggggagggcgggtggcttatctccagaattgatgtcctcccctccccttcctccttccaggctctggggcagcggtggggggtgggggaggggtgttccccagcaaggtggtctacagtgggagaggaggaggaaccagtttctacctgctgcactgggggtgggggtgtgtttatggggagggtccagaggttccccgggggtcagtggtttgaacctaaacaggcaaattcaagtccctaagcctccgttttctcttctgtgaaatgcgagccactgttggggcaagtaaggtgacaaggtggagaaaggccctaggcagtgccctgtacagcggagaccccgatcacaattgtgatcacagtcacaagggcttggggccggtgggcagggcacttggctgtgcctgttggttgcaaaggcaccttctggattatcaagggtaacagatttgccaggaaaagaaaagaggctgatgaaagcgccagctgacacagtccccagttgtgatgagccaggcaaacttctgggcgcctcggcaatgccaactcatgtgattggctgccgggtttgtggactacatgcatagtaatttctcggcattcggaggaggctgggggtgctggtggtgggggggaggcggcctgtgctgcagaccctgccctttcctgggtgggcgccctgagaggcgggcacgctgctgtgcagaaagacgccaccaagaccggcctggggtcctaatggccatgggttctgtggacccagatccagcctttgccttgctgcgggcactgaagctccagcccccatgagcagtactgtcctccccgctgggtctggaatccctgaccagaaaggcgcttgcactcaacagccccgaagcccacgccacttcccacctccaccgcctggggggtgcgggtggagggagggggtcgtgggcaccgaggcaggagcaggaggggctggctcaaggtcacagagcaggggggtggaggcg

SEQ ID NO: 90494 - DNA, 1050 bp, Homo sapiens
aacactgactcccattcattgcgcagctgtgacgctctggagtccaggtgtccaaacgcggctgcaccacgtggccggcccagcaccacgtggtcagctcggcgaccggctggagtcagccactgttccaccgtgcaccgcttcattcccgctctagagggcaaaccagacccgatttccggcctccattaggtcgcagaggtcagttgccctaacaaccagctggttcccgcctctacgttgcgtcacttccttccacgcccgcctccatcattaacgcgcctgtgcagaagggaagcaactccgggcgcctttcttttgcgcaggcgtcgcgccctggggccggggccgggcggcaccgcggtgcgcaagcgcaaccgtcggtgggtcggggatcggtcgcctgagaggtgagtgaggggcactgcgctgagcctggtgggtctggggtctgcggctcggggcccacggggccccaaagctcgtaagagtttggggatcgtgaggccagggtcaccgcgacccgcggggtcctgtgagtaggcggtgcggaggggaaactgaggccgggcgccatcgggcaggcccttcgagccctgatctcccttccccaggccccaggtcctggaaatgctggtccgcggcctggtggcgaggacggcgggaggggaaggcgccccgcatgtagtgagcgctcgctgggtgttcgctgccgttccgctcttattaaccgcctggaaacgtcgtccctgtgactcagggacccccgtttgtggggactgaagtcggaactctggttccagcgccgccagtccctacctgggtgaccttgcccagcctcttggcttctcggagcctcagttttcccctctgtaaaacgggcgttgttcaaaagtccctgcctaggagaaggagagccgcagggtccagcggaatctgagaactccaaagaattagcaggcgttcgtcttatatcatgtttagagtcttcttctgcatatcgtgctagaggtgggggaaatctgggattcaggaccgtccaccaccacc

SEQ ID NO: 90495 - DNA, 1050 bp, Homo sapiens
tattccgggctgatcgttctctgctggggccgtcctggtcactgcagggtactaagcaggatccctggcctccacccactccacgccaggagcatctgcaaccgcgacagccacatgtgtcctagatgtcacccagggttccctggatgggattgatggcagagtagcctcctgctctagaggactggtcagtctgtgcttccctacaagagccctggacctcactcttctggatgagaagcgggtgatcccttcctttccctctgccctcctgactttgaccctaactgaaccgaaagcagacccgcccggcactgggttttgtttctgcgtagcctgtgcaggagacatggcggacgcagcatctccgtgctctgtggtaaacgacctgcggtgggacctgagtgcccagcagatagaggagcgcaccagggagctcatcgagcagaccaagcgcgtgtatgaccaggttggcacccaggagtttgaggacgtgtcctacgagagcacgctcaaggcgctggccgatgtggaggtcacctacacaggtaagtcccaggcagggtctgtgcgtgggccgcaggtgccgagggaggtggcaccgcaggcgggagtagcccagcccgtggagccggttcagaacctggcttgaagtgtcaccagcaccctgcccctgagcacagggcagcgccacctgctcccaggctggtcgtggtggctaaatcagatggctgggcggaagcgtctggcaggtgctggtcactagaggtgtaggagagaggcagttcctcccgtgctccgctctgcttcacagcctcgtccattcaaaggactccctggttgtgtgatctgagagccggagatgagaaaatatgtctaaacagcacgcctctccagcctctcccagagccagcagccttgaaccctgaccccgtctggcctctttccctggcccgggaaggcgggtatttgtttctctctgaatgactgaacttggcccccttggcttctgcctctgcgccctccggcgggggtgacctcatgtcctcg

SEQ ID NO: 90496 - DNA, 1072 bp, Homo sapiens
ttatgcttttctagccactgacacttcctctactcaacctaaagcacagatgtgctcaggaaattgtaagtagtttatgcatttaaatgtgaccatcggcagctgcagctctctctggaatggaattccgtcagcctctgtttcgtcgtacccagctctgttgggtcctccttggcttggagggctttgagttgaatccttatttttcttcggtctgtaagatctccaaggacacaggcaacagcacctcctttctccatcccagggcccagcctggaggggacggtggcgtgtgcctctagtcccagctacttgggaggctgaggcaggagagagttcacggggggattcagcagacaggcctgggagaggggtccgggcaacacctgccagttgtactggggcctgttctcacacctgtctccctggtctcccctgttttagttcagaggaatatccttgacttcccccagcatgtttccccctccaaggacatccggacagccagcacagaggccgacaagaagctctctgagttcgacgtggagatgagcatgagggaggacgtgtaccagaggatcgtgtggctccaggtgagggggccctgcggggagtgcaaatagcctcccaagtaactaggattacaggcgcccgccaccacacccggctaatttttgtatttttagtagagacggggtttcaacgtgttggtcaggctagtctcgaactcctgacctcaagtgatccgcccacctcggcctcccacagtgctgggatgacaggtgtgagccactgtgcccggcccattttttgtatttttagtaggcacagggttttgccatgttggtcaggctgttctcaaactcctgacctcaggtgatccgcccgccttggcctcccaaagtgctgggatcacaggcctgagccaccacgcccggccacacatgtgcactttcatttcctttcctggccatcctagtgtgacccaaacaccccatccccacatggcgtgagctggcagggcctggcggcatggctgcgtgggctcctgctcccccggatgctcctcgca

SEQ ID NO: 90497 - DNA, 1050 bp, Homo sapiens
ttgtaagtctctggcagaggccgtcattgcgctttgctccctgttgggaaggtactcacggcattgagtgtactgcactttttcatactgttggtcacctctcacaaggacataagctctgtgtggctcagttccccaggctgtcagcctcacccctcttcctgcgcacatgggggaggcggtgcctttgctgaagtgggatgtgtggaatgttttaggactgcgtgatctttgaggaagtggctgtgaacttcaccccagaagagtgggcattgctggatcatgctcagaggagcctctacagagatgtgatgctggagacctgcaggaaccttgcctccttgggtaagggtggtgtcattccctcactgcctccttgggtaagggtggcgtcattccctcactgcctccttgggtaagggtggcgtcattccctcactgcctccttgggtaagggtggcgtcattccctcactgcctccttgggtaagggtggcgtcattccctcactgcctccttgggtaagggtggcgtcattccctcactgcctccttgggtaaggatggcgtcattccctcactgcctccttgggtaagggtggcatcattccctcactgcgtcctggagagcaaagagaccttggttttctttttttttttttttatttttttgagacggagtcttgctctctcgcccaagctggagtgcagtggcacgatctcggctcactgcaagctccgcctcccgggttcatgccattctcctgcctcagcctcctgaatagctgggactacaggtgcccaccaccacgcctggctaattttttgtagctttagtagagatggggtttcaccgtgttagccaggatggtctcgatctcctgacctcgtgatccgcccgccttggcctcccaaagtgctgggattacaggcgtgagccaccgcgcccggcctaagataccttgtttttctttttatttgagctcaaaaattgaaatatgttggaaaagagatagacatgatcccaacacccatggaacatgggagtcaaa

SEQ ID NO: 90498 - DNA, 1631 bp, Homo sapiens
tgaaaggaagcagttggagagagggagggtgctttctgatggggttgaaaaccactgggaggagcagacatgatggcccacttggtagtggggctcctcctggcctcagggccgtccccctctcctctcccaggatcaggaggaatcactgcctctcctctcccccgacccccttccagcaccagcagcaggtcttgggagccattgagagggccaagcaggtcaccgctcccgagctgaactctatcatccgagtatgtatggggacctgggcgggtgggcgggggacaggtgggccccaggcagctaatgttcccctcccccgccctgcagcagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcggtgctgtgtccctgcctctgtgttgtggctgcccccgggggaggacggggttccttccaatgtgagacatcctcctagaacatcaggagttcctagctgtggcccggtgcggtgtggctcacgcctgtcatcccaacactttgggaggctgaggcaggcagatcac

SEQ ID NO: 90499 - DNA, 1032 bp, Homo sapiens
ccagaagacctagcgcgccaggcaggcacttccttttctctttatccccaacttccttccaggtcgcaaggtcacgtcctgtccccacctttcgcccctcaccctagctcccccaacgccaaagacaaggttaagaaagtgatatcgcgaaatagttttttaaagcattttattgcattttatgacttggagtttatgtgaaacctcaacggtattagccgaacagcctgccgcaccttccgggagttccagagtgggcctacaactcccacagggctccgcgagcgccggacggacggactacaattcccgacaggcagcgcggctggcggggcggttcgccgcggtgcccacaggacctcagggcgagtgcgggctgccccgcgcggcgcccgcaggaccccggcggctacccatgccgaggtgagtccgcgggagccgccgccgccgccgtcccgtcccagctgccgccccgcgcggccccgccgccggccaggatgctggaggaagcgggcgaggtgctggagaacatgctgaaggcgtcttgtctgccgctcggcttcatcgtcttcctgcccgctgtgctgctgctggtggcgccgccgctgcctgccgccgacgccgcgcacgagttcaccgtgtaccgcatgcagcagtacgacctgcagggccagccctacggtgcgtgtccccggcccaccctcggggctccccgggctccccggccacgccactccggcccggcgatccccaggccgatccctagctccggcctgggctgcccgacccatgctcaggccccaggcgaggcagagccctgccgccctggacccccgggcgccctggaatccctgctctccttgcctagcgcccagggaccccccgcgctcgctcccacagcccccggcccctgcctaggtctccctgccccggaacccatggccgggccaagcgtcccgcgtccctggagccctaagtcccctctctcctgtccccagctgggccggcgtctgcctgccttgccgagtttct

SEQ ID NO: 90500 - DNA, 1020 bp, Homo sapiens
ggtctcctaggctggagtgctgggattacaagtgtgagagctaccttgcctggcccaaagtccacattttaaaacattgtttttgaatcgtgaaggtcccgggtggattctaagaccctgacccgtaacacgaggatcattgcagaggccctgactcgagtcatctacaacctgacagagaaggtgagccctgagccctctgtgccgccagacccagccccagccctgcccccggccccggccccacccctggccccagccccactgcaggggcctggactcagggccatcccctcctctctccgcaggggacacccccagacatgccggtgttcacagagcagatggtaagggggccaggccagtgggtgggtgggtgggcggggccaggccatgactaccaccaccgtccctacagcagatccagcaggagcagctggactcggtgatggactggctcaccaaccagccgcgggccgcgcagctggtggacaaggacagcaccttcctcagcacgctggagcaccacctgagccgctacctgaaggacgtgaagcagcaccacgtcaaggctgacaagcggtgaggctggggctccgcgctggccccgttcagcctggggccgagggggacctccccctactgcatctcccaccccctcacccctgggggatgccaggtggagcaaatacaaagagagggtgggatgagggccggacacggcggctgtgcctgcaatcccagtactttgggaatccgaggcaggtggatcacttgaggtcaggagttcaagaccagactggccaacatagtgaaacctcatccctactaaaaatacaaaaattaggcggatgtggcagtgggcacctgtaatcccagctacttaggaggccgggacggaagaatcgcttgaacccaggagttggagaccaacctgggcaacatagcaagaccccatctctacaaactttttaaagtttttatttatttgtctttgagatggagtcttcctctgtcacc

SEQ ID NO: 90501 - DNA, 1068 bp, Homo sapiens
gaaaagagaagaaaaagatggggggaaaaaatcaaaccacaatggatttttgtttcctagttgggagtggggtggggtggggtgtctttgtgagggtgcctctgtacagctgcccaatccgcgacacccacgtcaaagcacagcatcaagttcgtttggacatccggcaaggcctcttaccaaatgaggcgccagataacttaataagctcaaaagaaaaaaacatttaaaaagaaagaaaaaaaaaaaaaaaaaaaccaagcatttccttttctttctaccaaaatgtgttgactgacccggagggggggcggtagggtgggggaaaccacacagaaaaaaaaaaaaaaaaaaaaaagaaaagaaaaaagaaaaaaaaatagaaaagaaaaaaaaaaatcttctgaaccaacttgtttcgatattccagagtttgataattgtttcgagactctcctctagcgtgcctgtgttccgtgtgtccccgtgtgcaagcgtgtgccatgccaatctgcctcgagggggcctcacccgtgtccgcggcgcccgccgaggcccccgagggcctgcttgggagtgtgtgccggtgtgcagttgtacgtgtctttctggtccatgtttactggctgtaaataccatttttatactccacatcgcagacctgcgtgatttgtacaatgtactttatttctgctacgagtaatttcatgaagtttcaacttgcaaactgacttttgggacaaaccaacacacacacagaagagaaagcaaagaacttggaactttgggttgactcggtttgagttttgtgtcaaagaagatttcccgcggctgaagaggttggtgttcctgttacgtgtttcaggtgagaagcagcaaagcgtcttaatgttcaaaacgcctctctttggtctggagaaaaaaaaaaaaaaaaaaaaacaactaaaaatttatttaataaaagttttacttgctaaagggctgactcttctctttctttcctctctctgtcatccacacagaccaagtgtatctggccccatccagcacctgggctggagagaaatg

SEQ ID NO: 90502 - DNA, 1058 bp, Homo sapiens
acctgtcccgggctgtctgtggggctggcctggagcacgggagcgtcgtagccacccggagctgtcacagggtacagcccgggtccgagggcctctgggttgactcctgcctgggggatgcctgggattcccagagacagcacaaccccctcccaggcagaagaaggtgatggtttccagtgtgtgaaaggatggggctgttcccgttgctctgaaggtgaaactgaggcccagagagggcaggggagcagcctgaagctgcacaaccctgagcagagggaggaggcgatgacaccagagtgagatccaggctgggtggcctttgcctctcagctcactgcaacctctgcagtgaggcttcctcagcaaggcctggtatgcagctggcgctcaataagtgcgccagtggaggtgacacttggcagtgtttcaggcccttctccctaataccctctaattccacgaaccgactcaatccttgcgtagctctctgtgaagctaagacagccatcgcctcattctgcatttggggaaactgaggcacggagcaaggtgaagaaggaattgccaagtctgcacggcggatgaatgctgggctgaaacagcaggtgctctatcaatgcacagtgggcgccggaagagtgtcaactgtgtgcaaaatcctggataatatgccatctgcccagcaacccacaggggtggcaccaaggagccccctgatctagatggggaaactgaggcacagagagatgaagggatttatccaaggtcaaacccaaaccctatcacatctcctgctccagacaggcctcccccaagccacgagggtgtgtaggtacacagctccccacccccgtcagacacatgagtggtccaccttggggagggtgtgggatttgggagtggacgcagcctcccccgctcacattctttctgagcactggccctttaaggtagccacgctgcctgggcatgtcccagggtgaccccaaggggcgggtgtggccaggaacaagaggcccattcagctgccccgttgccgccacctccgggcagcc

SEQ ID NO: 90503 - DNA, 1154 bp, Homo sapiens
tgtgttaaccagaactccagtttcactgggcatcctgtactgtgtctggaagcctccctcagagacaaagtcacttgccatgggtcacccagcaggttgttagagcctgggatggggaaactgaggtcacagggttgcaggaggtggggggtgagcgtgggaagaggtaaaccatgtctgcagcagagtctgacccctcgacttctctccctttttctctctccctctttctgtcgccactgggccactcagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcc

SEQ ID NO: 90504 - DNA, 1043 bp, Homo sapiens
agcagtgcctcacatgtctgctggtgtggctttgggattctcctgccccacccccccgtccatggcagccccctccccaaggctttgctcacacctgagacaggaaggaggaaggggatccaataggaatatgggccccggaggggaagtcatgcacccccaagccaccaccccccagccttccacgcacatctcctggctggaagagagccctccaaaaaggggacacaggctgccccggcccctcaactgcatccacaccccatcctctcatcttgggtcccagccaggcccccccaaaaccaaagccccctcaagtcctggggtcccagcctgtgcccccagcttcctgcccacccagccctgagcattctcacacagagaaagaacaagcaagggctccagggggacaggatggggcagggcatacagtggggggtgggggggcagctgggaggagggagggacaaaacaaaacattttcctttgggttttttttttctttcttttttctcccctttactctttgggtggtgttgcttttcctttccttttccctttgagatttttttgttgttgtttcctttttgtattttactgatatcaccaggatagtttactctccttctagctttctgcttaccgcacactggataacacacacatacacacccacaaaaatgctcatgaacccaatccggagaaggttccagcaggtcccccaccctcccctcctcctcctacttctcctcttgacagcgaggacaggagggggacaaggggacacctgggcagacccgccggctctccccccaccccaccccgcccctcacatcatactccaatcataaccttgtatattatgcagtcattttggttttcgcggacgcgcctacctaagtaccatttacagaaagtgactctggctgtcattattttgtttatttgttccctatgcaaaaaaaaaatgaaaatgaaaaaagggggattccataaaagattcaataaaagacaaacaaaaaaaaaagaaaaaagaaaaaaat

SEQ ID NO: 90505 - DNA, 1038 bp, Homo sapiens
tctgataggcctataggcgagaggcagtgcagagactgaggcccagagagggaaagcaacttacggaaggctgcacagctagtagggaggttggagctgagctttcagcgtagatgctcaggttggtcagtgggtaggaatttgccccacccaggtcctaggaacagacaacgcactggtgaagggggcttctaacctgggctctcatttttctgccacaggttcttacatccccgcgtccccaggtttagcctgagcagggttgtggaaggccgggacccattgacagcacgatggtgacggagcaggaggtggatgccatcgggcagacgctggtggaccccaagcagcccctgcaggcccgcttccgggcgctgttcacgctgcgtgggctcggcggcccaggcgccattgcatggatcagccaggccttcgatgacgattccgccctgctcaagcacgagctggcctactgcctgggccagatgcaggatgcccgcgccatccccatgctggtggacgtgctgcaagacacccgtcaggagcccatggtgcgccatgaggcaggtgagcacctgtctgtgtcccgggcacctgctccctcctgcctcacttcttcatgaccccacgtgtccccttcctcactcaggtgataaatatcagagtggtcaactgccccatagagcaccagatagtaaatacctgcagctctgcagccagacagcgactcaataaagccagcgcaggtcatctgtcaccaaatggctaaggctgtgtgcccagacaacctcaactgggcagggggcggtggctcaggcctgtaatcttagcactttgggaggcccaggaaggtggatcgtttgaactcaggagttcaagaccatcctgggcaacatggcaaaaccctgtctctagaaaaaatacaaaaattagccaggcatggtggcatgcacctgtagtcgcagccacttgggaggctgaggcgggagaatcgctggagcccgggaagtcaaggttgcagtgagccatgatcgtgcc

SEQ ID NO: 90506 - DNA, 1342 bp, Homo sapiens
tgaacgactgcatttcttcctttttttattcctcacctacttaaggttcgagctccctgagcccattggccaacacctctggagtctgaccacgcctagaaacactgcgcatgctccgttgctagccagcccaggcagggcgctgaatcggcacaaaccagtctcacttcttgtaccgcagtggggaggttggagagaattttttcccatgaaagggcatacgttgcccgtccccttccccgaagaacgcactaggaatactgttcctgcgtttgcatgagctgtggcaccagcaccgactcagccttccgggcctccctcatgcacggagcctctcactaggtctcacccgcggctgcgttggtgccgtccggcacggtcacgtgggcgagaaaatggcggcccccagaccgcactgcgggcgtcgcggcaggtgaagcggtggtggcagaggcgcctgcggttactggccgggccgacgggtcctgagtctccagagctcggtgaggcgtcccggaggcggcgatcacggtgtggggcccgggtctggcgggcggtggcaccgggagcgcctcgttagggaatccggtctcagggattcgttgactgtggatggggcgggttaaggggtctcgagtcccggcgatctctttcctctgggattttttacatgaaagagtgcccacctcacgtcctgaagctcctatgtcgtacggttgggtctcaatggtccccagtgccctgccagctcgcacaggcctgccctctggtttctgatgacccctctttaaaggtgtcactctcctttgatggtcacctgtgcttaggtggctacactgccctcgtcaagcccaggcagccttgctgacgccactgttcaccagagagggctgccagcatgccatagccagcctgtcttgagatgaagcatccgccaggttctcagccgatctggaaagagaggggtcccttctccccttggctgtgttcttttatcctaagtcattcaacaaagcgttggtggtttagagcccgactctggagccagacttcctggattcctaactcttcacgctgctcccaagcaagttcccaagcacagtcccaaactgtgcctcagtttcctcacctgtaaaatggggacaatcttagtaactacctcacagggtagtgatgtagatcgaatgaattaatgaatgtaaagagcatggagtgcctggcgcgtagcaaatgctacataagtgtcagctgctattgtcacggttgtcgtttttattttatttatttattttgagacagggtcttgctttgtagctcagtctggaatgcaatggcacgatct

SEQ ID NO: 90507 - DNA, 1148 bp, Homo sapiens
gggcgaggctgaagggggcttcccagggcatagtggcctggagctgtgactgtgtcctcccccagagtccttagagtggaggggccccagccccccatgaggccatggtcagtaatagaagtgtagtccaggcctagagcagcccagagatccccttgctgagggcacaccatggcctggcagtgttggcctcagacaaggggcagggtagtcaggaagggctgcctggaggaggtgtggggagcagagccagcacagctgtggaagggaggccagggcagccagacacccgagggtgaaggcctgtggggctgtccctgggtttaggatcacatggtggcggtggtgattggaggggccggactgggctcctggggctggcagggaaggagacacttcccaagcgtttgcaagaggtgacccaagtgccgtggctcacggatgccacgtggccgcctctgcagccagaagctgctccggtccccccggaaacccacccgcaagatctccaagatccccttcaaggtgctggacgcgcccgagctgcaggacgacttctacctcaatctggtggactggtcgtccctcaatgtgctcagcgtggggctaggcacctgcgtgtacctgtggagtgcctgtaccagccaggtgggtgctgcgtggggtgtgcatgtgcatgggggcctccccagctcccagcagacctcaatgtacccaccgggatccagggagcatcagtacgagccaggcgcctgccatggccctcctagctggggcctcccagcctcccagccacagccctcccagccactaccctcccagccctcccagccatggccctcccagtcagggcctcccagccacggccctcccaaccctcccagccatggccctcccagccactgccctcccagccagcagtggcatctgcggcagcatggggtccccactggagccacaatctctgttcagctctatagagaagaagagacaggtgtcccagcctggctgagcccaggggccactatgaccaccgagtggccgctgtcctggagtggcctctgggcgcatggagcctgctagtccctacagggagactgggttgctggtgcagggcagcagcagacactgcccgctggggtgggggt

SEQ ID NO: 90508 - DNA, 1026 bp, Homo sapiens
gcaggggagagcggaggagagagcggaggagagtggttgagggagtggatggttgagcagaagggagagcggatgggagagcggatgggtgagcagatgggtgagcggatgggagagcgcatgggagagcgcatgggagagcggatgggagagcgcatgggagagcgcatggatgagcgcatgggagagcgcatgggtgagcggatgcaagagtggatgagagtggttgagggagtggatggttgagtagatgggagagcagatgggagagtggatgagagtggatgggaaagcggatgagagtggttgagggagtggatgggagagcagatgggtgagtggatggaaaagtggatgggactgtggatgggagagtggatgagattggatgggagagtggatgagagtggatgggtgagacagtggagggatgaatgtacccatggatagactggggcttcgagaccagcggcaaagctcacactgacctctgcctccaggtgacgcggctctgtgacctctcagtggaaggggactcagtgacctccgtgggctggtctgagcgggtgagtgcagagggcttggcccccacctgggagatctgatggggctcttgacagtgttgggggccttgaagacccagagggtctagtgcgtggcctgaggtcgcctgtgtccaagcataggtctgtgtcccccactgtccccggccttagtgtggtcctggtagagggagtaacagggatgagcaggcacccaccaggcccctagaaaggatggcaggtccagtggggaaataacgccccagttccttccatgggacctgcccacctgggactcgctcccctggagttccattttccactcagggtcgagtgggctttagttccattttagattatgatgaaaacatctcagcagcagctttgaagcatatcatggggagggtctgtgcccctcacccagagctgcccagggctgcccctagcactcgtaaccgctcactgtgtccaggcgtgtgcgctc

SEQ ID NO: 90509 - DNA, 1064 bp, Homo sapiens
gggcctgtgtggaacctggagctcagtgtctgcagtttctccttccctctgtgtgaaatgtccatgtgggaaggtccacgtaccgagtcttggctggactctgagaaacccaggcgcagtgtgtgcggggtgtgcccgccaccccagcatgcactgaggggggtttatgcttcttccgaagggacgtgcattcgagagtcgttagggaaaccgtcccagagccctggtgaggagagagcctggcgcgaccaacgccaggacgggcacagtccccgggccagacctgacaccggtgctctgcccatgccttccatcctaggggaacctggtggcggtgggcacacacaagggcttcgtgcagatctgggacgcagccgcagggaagaagctgtccatgttggagggccacacggcacgcgtcggtgaggagcccgggtcccatggctggtgagctccctgaggccccagctccgcgagggcaggagaggctcacccccgcttccacctggcctccaggggcgctggcctggaatgctgagcagctgtcgtccgggagccgcgaccgcatgatcctgcagagggacatccgcaccccgccactgcagtcggagcggcggctgcagggccaccggcaggaggtgtgcgggctcaagtggtccacagaccaccagctcctcgcctcggggggcaacgacaacaaggtacccccgcccagagcctgggcttccccttcaccagaagccgcacccctcacactggcaggaacggaagagcctgggctggggcgggcgcgggcgcggggcccactccacagccatcagcagggcaccaggcttgtccttcctgctcagccagtcctgccctgtggcacagggtgacgagtgtgtgcccccaggggtccttgagggagcagcaggaggagtgtggggtggggtgccagggcaggtcgtcacacctgtgaggaccggcctatgggaccacagggctgggacagccccggcctcacagcccctgtcccccagctgctggtctggaatcactcgagcctgagccccgtgcagcag

SEQ ID NO: 90510 - DNA, 1099 bp, Homo sapiens
gcgtcctgctggccccttacctgccacctgagagcagcctgtggggagatgggtcagagtcgctctgaagggagatgggcgagggaggccgagcggggaggcagggagttgtggggggcaaggcccctgggcctcatcagggcctcacctggggcaagacttggggcctctgggcccccatcgcagccacacctggcggctctgtgaggagccggggagctcctatggctgcctctgcttagaggggaggcccaggatgaagcgggctccactgagcaccctggcctgctccagccactccgggcgtgtcaccaggacagtctcgggggtgacttgcaggtggggcagaggggctgtgggccccgtttgggtccttgttgggctccagcctttggcggtgggtggaggggtccacctgtggcctccacacctcctagacagactcaggtggcagagccacatcccagcatcccctgctcctcctgggctggctggcggctctgagctctcacatgggctcaggcgggtgcatgtgaggcagcaggcatagcacccggcctcgttgcccctcaccgaccgcagcgccccctccgccctccaggtgagcacgcacggctactcacagaaccagatccttgtctggaagtacccctccctgacccaggtggccaagctgaccgggcactcctaccgcgtgctgtacctggtgagttcacgccaggcacttcaaggtgccccgggattctggacaaactgccatggccaccccagagcaccctgtcctgtgttcttagggaggatggtgtgcagatctaaaaccccgtgggacccagcagcaggggccggcagggcatctggtgctggttgtgttgccagcgttggaatgggctctaccgaactccccagccctgcaggtgcaggccctgtcctcctggaggaccttagcttcttcatttgtttattttccccataaagaggggtgaagaggaaagccaaaaccaactcacagctgaccactcagatgaccctgtgaacgtcctacacagtaactgtatgcacgtggctggatgggggccaggaggcgtccttggccccacgt

SEQ ID NO: 90511 - DNA, 1047 bp, Homo sapiens
ccgctacggcgtggacagagagcacagctctggcatggaggatctgcagagcctcggtgttgtgtccagggccagagccagggctccttagggaccatccagctcatgccttgtttgctggggttgggggtaggggtggcggattgaagcgccaggcttgggggcacccagtggtgtgggcctgaccccggggctgtccctgcagatgacctacttctcaggcctcctggtgatcctggcctttgccgcctgggtggcgctggcggagggactgggtgtggccgtgtacgcagcggctgtgctgctgggtgctggctgtgccaccatcctcgtcacctcgctggccatgacggccgacctcatcggtccccacacggtagggctggtagccaggctggggtgggggaggccgggtcctagatctcggggtgcacgctgaccacctcgcctgtgtctccacagaacagcggagcgttcgtgtacggctccatgagcttcttggataaggtggccaatgggctggcagtcatggccatccagagcctgcacccttgcccgtgagtgccgctgttcgttcattcattcttttgttcagtaagaggggattaagcgcctgctgtgtgtccagcagtgttctgggtctgggcatccagctgtggaccaaagacacctgccccaatgggagtcataggcaggggagacctttcctttcttccactgagcacttcgtttattcactcaacaaacgttgggtccatgtgtgcagtgctgaagacaccgtacagaaatatatcgggggtgggcccagctggaagggagccccgagtccgtgtaacccagacccacagaactcagggttcagacatggatggttctagaccacagcatcacagcattcacgcctgtagaggcccagggcctggaaaccacagccggtctgggcctggggcagagccagccgtgttaatagtcacagaggtgaacatgtggttggtaccggcgtgggtggtgtgtaaaggtgaacgctcagagaaacctggacagcca

SEQ ID NO: 90512 - DNA, 1019 bp, Homo sapiens
tgtgtgcaagcaggggcggtgccactgcaccgtgggatcgctgttgattgtactcccaccggggtgtcccaggagaccctcctaggcttggggcacacccagagagcgtggctgcctcctaccaccagtaaattgccaccttgtcccttcgtcttagggtggggactgcgatggcttctccaccttcgatgttcccatcttcactgaagagttcttggaccaaaacaaaggtgagcggtaactgcgctcctgatgcgaactccgtgaaactgggtggtagaggggggcgtgggccaggagggccccaagactgcaggaggcggatcgggaggttccctatgagcgtccaggcgcacgctgtcgctccagaggctgatgtggagcaggaggcagagggcgcagtgagggaaacctgggcaggggcacgtcccgggcaaaagcccggaggtaggggaaaggggaggcgcaggctttgaccccgctccccccggcgcagcgcgtgaggcggagcttcggcgcttgcggaagatgaatgtggccttcgaggagcagaacgcggtactgcagaggcacacgcagagcatgagcagcgcgcgcgagcgtctggagcaggagctggcgctggaggagcggaggacgctggcgctgcagcagcagctccaggccgtgcgccaggcgctcaccgccagcttcgcctcactgccggtgccgggtgcgggccacgcccatctcccagtcccgccccggtcacccggccccgcccgcctccccccccctcctcccttccccccttcccctgtcgcccggcgccgcccatcgccccgtcccctcttccccagtcacccggccccgcctatcgccccgccctcatcacccccagctccgcctcctccccgacccccgcacccctaccccatagctccgtctggttcttcccagaccacacccgagctccgctccgcgccccgttactcggccggctccctgacctcgcccccaccgaccgcgcctcccggcca

SEQ ID NO: 90513 - DNA, 1020 bp, Homo sapiens
attctattgctgcgatggcctgggtcccaggactagattggactccagagcttagctggattctggaacttggctgggtctcagctgctgtctgtgttttggagctggctgggatttcagaaccagcctgtgctccagaactgagctgagttccagagctgggtgcggtgcttgggctggattgagctctggagcttggccaggccttgaaattggtctgggtcctggaagtaaactgcattctagagctgagctgcattgtgcaaggagagtggggcttggcaccaagctgtgtgctggagctgggtcttgcttccaagatggatggggttccagagctggtctgaatcctggagttgggcctggttgtagcactaggcgaggttctagagctgggctcagtctcagagctggaatcatcactggagctggactgggctgcaggatggggatgggcacttggatgcaactggggttgggatctggactgggcagccgtgtggacctgggtttctgagctggtctgagttcttgaataggatttgatttgggagctgtctctgaatcctgagctgactggggttccagagctgggctgcttcatgaatctcacatgggttccaaaattaactggggttccggagctagaccgagtgtccaggtgtggctgcatcgtggagctgtccagagttccagagtcagcttgagttttccagcagggcttggtctccgagctagcctggattctggaactgggattggtctccaagctggtctgggtcttaaaatgtgtctgggttccagagtttggcttgttgtcagggctcagctggattctagagatgtgcttcgtctcagagctggcctgggcttcagagcagggcttggtctcagatcttatctgggttctagagctgggtttggcctcagaggtggcctgagttctagaacagggcttggtctcaatgctgggattggtttcagagcttatctgggttctagagctgggcttggtctcag

SEQ ID NO: 90514 - DNA, 1040 bp, Homo sapiens
ttcgccgcctccttctgcgtggtgggcctggcctccaacctgctggccctgagcgtgctggcgggcgcgcggcaggggggttcgcacacgcgctcctccttcctcaccttcctctgcggcctcgtcctcaccgacttcctggggctgctggtgaccggtaccatcgtggtgtcccagcacgccgcgctcttcgagtggcacgccgtggaccctggctgccgtctctgtcgcttcatgggcgtcgtcatgatcttcttcggcctgtccccgctgctgctgggggccgccatggcctcagagcgctacctgggtatcacccggcccttctcgcgcccggcggtcgcctcgcagcgccgcgcctgggccaccgtggggctggtgtgggcggccgcgctggcgctgggcctgctgcccctgctgggcgtgggtcgctacaccgtgcaatacccggggtcctggtgcttcctgacgctgggcgccgagtccggggacgtggccttcgggctgctcttctccatgctgggcggcctctcggtcgggctgtccttcctgctgaacacggtcagcgtggccaccctgtgccacgtctaccacgggcaggaggcggcccagcagcgtccccgggactccgaggtggagatgatggctcagctcctggggatcatggtggtggccagcgtgtgttggctgccccttctggtgagtaggggctctgcggggtcctgctaccctcctgactggacctctggtcacccagggtggatttagatcctgatggtgggaccgggcgcggtggctcacgccggtaatcccagaactctgggaggctgaggcgggaggatcgcttgaggccaggagtccgagaccagcctggccaacatggtgaaaccctgtctctactaaaaatacaaaaattaaggccaggcgtggtggctcacgcctgtaatcccagcactttgggaggccgaggcgggcggatcatgaggtcaggagatcgagaccattctggccaacacggtgaaacactgtctctactaaaa

SEQ ID NO: 90515 - DNA, 1309 bp, Homo sapiens
tggtggaagcttttaccggccgctgtccgagcactccctgggcagcctccgtcctaagacagaggagaaaatactggcttcagaaaacccctgggccaggaccccctcgggggtcatgcgtggggctggatcccgcagccaggccctaaccaccaggttctcctgtcgctcggcggggaagcgcgctgcgcttggtccccacccaggaggacgatagacatgaagaccaaggtccggggctcggggcggatggtgtgggtctccgggtcgcccaggccctgtcccctccccatgtgccttagctcgccccagcctgttttccttttgcgggaggcaccagcggccgcccctgccagagaggctaggagggaggccaggacccagggggaggccgaggcccgggtgaacgccgtcccgcccgcaggagacgccagcgagagcgccgaggacatcttcttccggcgggccaaggagggcatgggccaggacgaggcgcagttcagcgtggagatgccactcaccggcaaggcctacctgtgggccgacaagtaccggccacgcaagccgcgcttcttcaaccgcgtgcacacgggcttcgagtggaacaagtacaaccagacgcactacgactttgacaacccaccgcccaagatcgtgcagggatacaagttcaacatcttctaccccgacctcatcgacaagcgctccacgcccgagtacttcctggaggcctgcgccgacaacaaggatttcgccatcctgcgcttccacgcggggccgccctacgaggacatcgctttcaagatcgtcaaccgcgagtgggaatactcgcaccgccacggcttccgctgccagtttgccaacggcatcttccagctgtggtttcacttcaagcgctaccgctatcggcggtgacggccctggggaacggcaggcaggtgtcctcgggggcacagtaaaggggcttcggtgaagctggtggtcactccggggccgctgtctgggctgcagggccgcgggttcacgtcccacctcaggccgcatctttctttcgccaggcctcagtttcctcctatataaaaggggggtcaccattgagcctgccatggtgagctgaggagacactgggacaggctggcctagggtcctgatgcaacggagggggcgctaggggcatctttcgagcacgagggtggccagcagccgccagctgacctcaccgtccaggcggacactctccaccgcccctcagccaggctgggtggggcccacagggcctgccccaagtggcggccacacagggtgttgt

SEQ ID NO: 90516 - DNA, 1084 bp, Homo sapiens
gagccctggcaccagagacgccaagagcctgtggggtgactcggagcagcaggtgtggccccgggcgggcggcaccgcgtccagggcagcctccctccgctgagtgacacgggacaccagtgcccggccgacgcgcctttgcaggagaaatgtgcaaacctctgtggataccatttcatttccattcttgtgttgtctccaaggcccttttggagatatacttggtgttggttgtgttttttggttccttttcagagaactgtaaaccgaggctgacgtgctccactgactgtgccgaggggcgggggcaggaggacggcaagacctatttataatatttagcgaactcggtctccctcagatcccccgcgagggaggctgctggacccaccccgctgtcccccatgatagaagtctgtaaataccttggtgaccaatgcccacttcccctcctgggtcacctctgatggctgctgtccactgagaacgtgggcagtgtccaaattcctgtactgtaaagactaaaaggcgtttgctctgagactgacaaggcggaaacttccatgtgtctcctgccaggctctgtccccctacgccatcccgacacgtccccgttcccccgaaacctggctcagtgcaatactcccattgccatggggtccttcaccatggtactgtctccacagccctcagtccccaccccaggagaggcgcctgccacctcctcctcatctccggtggttcaatcgctccgcctgtccccaacccagtcccatttttatggccaaactgattctgaaacaaaatgaaactgcaaacctcgtgtgtcttaactccccccagggatgccactccattcctccgccccgtggtctggtgcgtgacaatccaaagcgccgagacgagggtgctgtgtccctcaaacccagagtggtgggcgcctctgaaaccatacagccactcctggccccaaacactggtttgcatcccaggttcctcgcccacctacccccgccacaccccgtctttttagagatctctctaataaatcgggtaataagcatccgcctgtttgcctttctgt

SEQ ID NO: 90517 - DNA, 1055 bp, Homo sapiens
gagtatagaaggctccaccaggtggggtggtgacagctcccgccttctctcacggccactgtcatctgaggtgcaccaggatgccatcgaaggcatgcagcccccaggctagggaatgaaggaagggacatagccatgcaagggccctggggcaggaccacacctgctgagggaacagcaaggagcccgtgtggccaagcagcgcggaggggaagggagggggggtggggaggggaagagagcagtggaggggaagacagcggggagggagagtggagaggggacggggccaggctgcacagggccctctgggctgtctggattctattttgagagcggtcagaagcctttgtgtgagggggaacgtcgtccttccctgccgtgtggggaggtgggagtgtctgggaggcgggcgggcactgggctgtgggttcccagggtgagccaagcctcagggagaatcgactgtgtgtttgggggctcggaggctccgcaaggtgcccacagtcctctcccctcaggccggcccgacctcctgccctgcacgccaccttctttcgaagaagccactacagcctccattgccacgactctgtcatccacatccctctccattcctgagcggtccccctcggagacgtcggagcagccgcggtacaggtgggcgaggcatccgcagtgcatgtgggcggggcatccgctgtgcgtgggggcggggcattcactgcatgtgggcggggcatccgctgtgcatgtgggtggagcatcgtatgtacggtggatgtacatacactgcatgtgggtgcgcgggggcggagcatccaatgtgtgggagggaggagcatatgtacaggtgggcagggctgccagggggcaggtaggcaggcgggtaggcaaggcaggtagactgagcaggcgggccactctctttctgggtgtcacgtgtttgctgtatctctgcaggcggcgcacacagtcgtctggacaggatggcaggtgagacccaacccccttccttccctgggtctcaccagctcctcctgcacagctcccag

SEQ ID NO: 90518 - DNA, 1079 bp, Homo sapiens
cagctccgcgcttcaggtgctgtgtggccgtcacttccccgggcttcagcgtcccgtctgtgaagtggggtgatgaccgtgtgtgctaggggctgagcctgggatgagttggcgctcgtgcttggtgattgtcgtgccggttggccacccctttccggcctctccaccatcggtgcctccaggcccctgctgaggcccatgcccgtggtttctggagtcaccgctcactgttagaagcgatggcgacaccttccagaaagctcagctacagcgggagccttgtccgacaggggccgagggaggctgcccgtttcccacggcactgccagctcccagtgtcatcgtccttggcgatttcggctgatccgatgggaggcaaagcaatgtctcgttggtgtttagaatttggttcctctaattgcctgggctcctggctcccgaggcgtggcctgaatggcgtctccatgggccgtggccgtggggcacgtgggggcggtctcgggaaggccggggcttgggatgcggctgtgcccactgtgtgggccgatggcctgtggtggagtttggtctgagctgtggcctgggcgtgtctgagcctctcccaggctgtcctgtctctgtgatgccccagaacggtcagctccatccctgcccctgccccactcccacggctgatctgtctctgtgatgccctggaaaggtcagctgcatccctgcccctgccccacttccacggctgatctggcagcaaatgatggcagcttcaccttcagaactggcccagaacccactgactccttccctgtcctctgcctctcccgggtccagcttggtcctcccgggtccagcttggtcctccctggtccagctcggtcctccccggtccagctcggtcctcctcggtccagctcggtcctcctccgtacagctcggtcctcctccgtctggctgagtactccccggtccagctcagtcctcctccgtctggctcagtcctcctctgtctggctcggtcctccccggtccagctcggtcctcctccgtccggcccagtcctcctccatccggctcggtcctct

SEQ ID NO: 90519 - DNA, 1013 bp, Homo sapiens
aggcctgagccaccgcgcccagcctggaggagctgttttgagaatggagtcagtggggcacgggagctcacgcccatggtcccagctactcaggaggctgaggcaggagaatcacttgaacccgggaggcagaggttgcagtgagcagagattgcgccacagcactccagcctggcaacagagactccttctcataaaaaagagagagagaatggagtcttctcttggggctggagtcaaggtttggggctcagcttggatttgggggctgagcctctcaggtgaagggtcaatggatacaacccatcctggagtcaacagagaagcctccactgaggctccaggctccaggctcctcgccttgatttgggaccagagtttgaaggtggggggatgtcgtgggtggcagctggggtcctggccagggccagccgcagcatccacacccaccccacagctggatggctccttggaggacaacctagacctccctcaccacggcctggccgacagctccgctgacctcagctgcgacagccgcgttaacagcgactacgagacggacggcgagggcggcgcgtacacggatggcgagggctacacagacggcgagggggggccctacacggatgtggatgatgagcccccggctccagccctggcccggtcctcggagcccgtgcaggcagatgagtcccagagcccgagggatcgtgggagaatctcggctcatcagggggcccaggtgcgtcggacatggggggcaggcctgggaagggtctccggaggggatgccagcacagagcagacacacactgggagcctgttttctaccaggacgtcaacaaacacggcttccctggtcagactggtttctgggactcagacctggggtagctgagacccacgtggcactgagtaacttgcagcattttttttttttttttttttttgagacgcagtcttgctctgtcgcctaggctggagtgcaatggcgcaatcttggctcactg

SEQ ID NO: 90520 - DNA, 1051 bp, Homo sapiens
gccaccgcgtccagcctcctataagactccaagactctcggccgactccccgaaaccttgcccgctcctgggctgtccctgccacccatgaggccccaggccccctggctgggtctttgatagcttttcccacagcccatgcgcagggagctgcctccctcatcgtccccccagcccagggctgcccctccccttccttctccccgtagattccccaagatgcggctgtctctccacctcccccaaagccccagggcagaaggctgtgtcctgggactctcaccccaggtggggacaggagggctcagctctgaggaccctggggactttggggacctggaggaggtgggtgggacaccccagggacgcgccactcctccccgcaggcccagctcatcgcccaggccattggccaggccttcgccgccgcctacagccagttcctacgggaaagcggtattgaccccagccaggtgggcgtgcacccgagcccaggcgcctgccacctccataatggggacctggaccacttctccaacagtgacaactgccgggaggtgagtgaggtgctgggcagcccccacctggtgccccccacacccgtgcacctgcaccgggccctgctgagcagcctccgcgccccctgtgtgtcccaggtgcacctcgagaagcggcgaggggagggcctgggcgtggccctggtggagtcgggctggggctccctgctgcccacagccgtcatcgccaacctgctgcacggggggcctgctgagcgctcgggggccctcagcatcggggaccgcctgaccgccatcaacgggaccagcctggtggggctgcccctggctgcgtgccaggccgctgtccgcgtgagtttcctggtgtggcagggcccccacactcccaggaaggggagctgagtcccagagaggtctcctccctggccaggtctctccagcccagccaggagggacaaagtcgaacttttaagtcctgcccactggtgtgcccttggggaaactgaggcctggagaagggaggccacttgtcc

SEQ ID NO: 90521 - DNA, 1044 bp, Homo sapiens
gcctgtccctgtcccctagggacccaagaagcctgcgggcagcccagcccccatggcagtcacagccacgctcagcccccacagcaggcgcccatagtggagtccggacagccagcgagcaccttgtcctcgggatacacctaccccacggcgacaggcgtccagcccgagtcgtcagcttccatcgtgacctcctaccccccgccctcctacaaccccacctgcaccgcctacacgggtaagaccagcgttccttgcccaggtggtctgcccgtcggtccccacttcaactcagtggaatcagcatctccccccgactcattgttttctctgctgctcagcaccaagctacccgaactatgacgcgtcggtgtactccgctgccagccctttctatcctccagcgcagcccccgcctcccccgggacccccgcagcagctgcccccgccgcccgcgcctgcaggctcaggaagcagccccagggccgactcgaagccaccgcttcccagcaagctgccgagacccaaggcggggcccaggcagctccagcttcactactgcgacatctgcaagatcagctgcgctggcccccaggtcagtcgccctcctgccatgggcaggccccagggacctctctgtccccaacgtctgaacccgaatgtgggcgccggtggggtggtcagggtcgctgcctgctgaaagaaggtctggtgttaacttgcatgttgtatgcatggcctgtgtgtgcaagcgcttgtgtgtgtgtgcaagtgtgagtgtgtatgtgtgcgtgtgtttatgcatgtgtatatgtgtgcatatgtgtgtgcaaacgtgagtgtgcatgtatgtgtgcttgcacgtatgtgtgcgcatgtgtgcctgcatgtgcctgtgtgtgcaagcgtgtgtgtatgtgtgtgcatgtgtgtgcgtgtgtgtatgtgtgcgcatgtatgcctgcatgtgtatgtgtgtgcatgcgcccgtgtgtgtgtgtgcatgcgtgcttgtgcttggcagtgcttgtttgggacatacgt

SEQ ID NO: 90522 - DNA, 1042 bp, Homo sapiens
gtgtcaccctcccagcgtcaggctgggaggcagacgctgttggggcctctcactgccgggctgttgaccttgatcctttggctaaggtgttggctcgggctccccactgcagttaccctcccctcggcgttactgagcactgggggctttcgggctctgcgtctgcacagatacttcgagtctccaaggagacttctgcctgttcatttctgctgctgtcagtggcggggtgggggggtggattttgaatgcctcttgggtggtgtctgggatcgttgcaggaaggttctaagggctcaggagtgtgagtggcccaggcacctgccgtcagcctgtcttctgtgctccgcctgtcgtgggcagccggagaggcggcgcggccgtggtgggagcccaggaccccactgagcccccacgcctgtctcgcagcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagtacgaggggccggcagggggcacggggtgggacatgggacacaggcccactccacccacggaggctccagaggactctcctcccagcgccacctccctgcggctggggatcagacattgcttaccccttgggctggagagagtaaactgataaactggtggcccaagctggccattgccatggtttttttttttttttttttttgagacggagtctttttttttgagacggagtcttgctctgtctcccaggctggagtgcagtgcagtggcgtgatctcggctcactgcagcctctgcctcccgggttcaggctattctcctgcgttagcctcccaagtagctgggattatagacgcccgccaccacgcctggctaatttttgtatttttagtagagacagggcttcaccatgttgcccaggcttgtcttgaactcctgacctccttggtttgtgatt

SEQ ID NO: 90523 - DNA, 1365 bp, Homo sapiens
gggagctctttgacttcctggcggagaaggagtcgctgacggaggacgaggccacccagttcctcaagcagatcctggacggcgttcactacctgcactctaagcgcatcgcacactttgacctgaaggtgagccctgtagggccctgtggggccggcctggccagtgtgggggtggggatggggcggggaagagcctggaaggcacctcctgcgcgtgggggtgaggtgtggggagcgtgggggtgaggtttggggagcgtgggggtgaggttgggggagcgtgggggtgaggttgcggggagcgtgagggtgaggtttggggagcgtgggggtgagggtgggggaggcccgtgctttccctgctgagcctcctcccaccccagccggaaaacatcatgctgctggacaagaacgtgcccaacccacgaatcaagctcatcgacttcggcatcgcgcacaagatcgaggcggggaacgagttcaagaacatcttcggcaccccggagtttgtgggtgaggccctgcccagtgggcagccccggcctggggagggtggtctggggctgcctgctgtgcgtggggtgggtcatgcccggtgctgggtgccgcgtcctcggccctgaagccacccctcttgggcccggctttgcgggaggtctgggcctccatttggtgcagccccgctgtcctacccgtcaggccctgagggccagctctgccgcattcatgcccccaagggctgcgacatgtgagaaccttgaccccatgcctgtgtcttgagcctcttccttggccagcatgtccccagtgcctgacccacatctccctgttctgcagccccagagattgtgaactatgagccgctgggcctggaggcggacatgtggtgagtgtaccacctgctcccaccgggcctccctgcattcctggagcgcaggccagtgctgcagctggggatgaagcggggccttgctgctgttggggtatggggggaccgttgccctagaacaggggcgctggacgccacggtcctgggagggtgggcggccccacgctgcgctgacccttgcctcttgtctgtccccaggagcatcggtgtcatcacctatatcctgtgagtacctggcgggggccccctcggctgtgcaacacagctggcatgggtccccggctccgtgtgtctcatgtggacgccaggggtccccagcctggctgtgacccatcgcgggtactcaggggataccgggtgaacggatgagtgattctctgtggctgctgtcacagaggcttctggagagttctgaaggcaggacactcacagagcggctgagcaggctccgggttgggggtcgtgtgtgctcct

SEQ ID NO: 90524 - DNA, 10317 bp, Homo sapiens
tcagtgattccgatgcctgcttcttataaagtttttatttagaaataattacaggtaaggagttgcaaaaacagtatagtggtcgcgagtgtcctttttccctcggcttctcccaggggtatcgtcttacgtaacaatgtccaaacagggaaattgacttgggtataatccacagactctattcaccttgtaaattggttttaatagaagtactggacaacttgtaagctaatatcgttgctatggttctcgttctcagctaaaacggcgctctttactttgtgcacctgaacactgcacaccgagggcgaccaccgcccccgagatgcccagcttctattctagagcgccgcgccggcgccgaatgggttaacgggcggggggacacgcctccgtgcgcttgcgcggcgtcccttcgccccgccttcgcagcgcagtcacatgacccgcccaaccggcgtccgcctataaaaagctgagtgttgacgtcagcgttctcttccgccgtcgtcgccgccatcctcggcgcgactcgcttctttcggttctacctgggagaatccaccgccatccgccaccatggtgagtaaccctgcctcgctggtgccccggagcggcggcggggcctccgcggggcctacgctgcctagcctgggacgctggggccccccgtgccaggaggagacgtagcggcggcggggccggaggacccggggctggggaagcggccgccgccatgtctgtgcgccgcgctgttcaccgagccctttctccgtttccgagggcgccataaccttgcccagacctggttggagctgggttgttagcggggatgggggtggggaatgatgatgtggcaggcgtagtaatggcgggcaccgcggtggaagcggggagacagggaggcgccttatgtaacccgcgggccgcgagtttgagatcgattttctgccgggggactaggggcggcagggaatggcagaacgagcaaagcgacacctgaaaggctccccttttccttccaaataccttctcctgatgctgttaatcgtcgaccttaggcacttgtccttcctatgactcccagatgtacaaagactcttattgagacacgaggtgtaggcttgtggcagttagggccgttccggctccccgttatttcctggggtgggtggccttgtctgatcccgtttgccaaggggtgaccttgcattttatgatgaagcttcttgctcggggaagtttgggtggcccggtgacaacgtggagggggctttaggagaggattcatcccttacgtgtttggccccaaatgagactttagtatttgtacctggtatcaaggaaatctgttgacactcagttttattcctgagcacttttatttctgggttgtcaatcatgaatgacacctattaacggtggttccttggagattgcggggtggctcttaaggggtgttaggctggcaagattcggtgggcttggggcaccccagcaccaaccccctcctggccttgggcatgctggttcgtttggactgaacgctccgtgccatgctgtgttcctggaaatcacgagctggtctgagcctccttgtcttgcccaggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaacgtgagctccctgtgccctctgtacccaggcagggaggtgctggcctggcagctggaggccactgggccagggtgcgcggggagagacttggcaacgtctctttcccctggtttcttaattcatgggagaatgagtgaggttcagtccagcgagacaggatggagaggcacagggattcggggtactgcgagctggaaggttttcttgaggagggggcttaactccgtggttctccctccctgggggacttgcccccactcctacaatatctggagaggtttggctgtcacacctgggaggggagggtgttctagtgcttgggacgctgggaagctcctgtgttgcactggatgatgttcattccatgtcagtttctggccccgatatgagtagggggagcgcagagtacggtgaccccaactgctttttgtcctgggttggtacattggtgagggactctggctaaggctcttcatttcccctggagcaggggcagaagtgaggaggggagggtcggagtctctggaggcttttgccgtcctgctgggtcttttagttgctactttgagtcaggtgtgatgaatcttgggaccaagtcggtggggcaggatgtctggtcaggagggctctgaggatctggctatggggctggtaccaggagttccctgtcatgggggtggcatgtctcggacagaggcaaaggacaagggtgggttggctcttgtgggagcctctccagggatgagtcatggagggaggagcagcctggcttctgacagcatcccagactccctgggccaggtgtgtggctcctgtccccctgacgagtccctccctccatcagtgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggtaagcagtgggtccccctgaggcacggcctggaaccgggggccatccttgcttgaggatgacagcgccgccctgtcccccgtgtccccaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatggtacggccctccctagctgggtggtgggcttgccgcagcgggatctgcaggagccggtggggagtggagttgagctgagggggactggaagtgtgtttttgccaggaatgttgggtgacagagaagggggctggaatgttttcatccgacttgacccagcccttgatctttgggcagctggaagagacgagctcagggaacgctgccctgggtggtggaggggctggcccccctattcgtgatgactgatcatttcttcactttgaccagatgtctactgaagaaagcctgcgtctgaggcccatgcccaaggcgcccagcccgtagcttcaggctctgcgcaggggccctcacggctgcttctcgtttctcacacttccagatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtgagccccgcgggatatggtgggggattcctgacacctgggggtagtggcagcgacgtaggggcgtggtgtgctattcacagcgtggctcaagcccaccaggtcttgcccaagcatgtccccttggcgaccaccctccccaagtcatcccctggagaccctaacttgatttggcttggcctctccttgccaggtactttgacccagccaacggcaagttcagcaagtcagccaccagccccgaagggaagaagctgccacgcaccttctgccagctgatcctggaccccatcttcaaggtgagtgagggctgcgccaggcaccccgccgatgcgactattggccctcggccctgtgggctccggccggtagcctgtcggctgactgggcccgtctccttgtggggcagatgcgagatgggaggaggcacagctcctaactgaggtggagtcagggctcctctcttaagatctggactgcatagccagagccttgggacctctcctgcattgagggggttgaataacttgtggctttggcggttcagtgcttgtaagtcagaacttgggtccttgtctgagtcagagtgggctttttcctctgctccaccacgaggtttcctccagctcccgatccgctcagctggctgggcccgtggtaggcaggccaggcctgctcctgctcccgtgctgcgtccccctgcgctgacctgagtcttccaagcaggaagcagtgccaggcttcctcctgctgttcccaaatgggctttcttgtttcttggtggggaatgtaggtgtttgatgcgatcatgaatttcaagaaagaggagacagcaaaactgatagagaaactggacatcaaactggacagcgaggacaaggacaaagaaggcaaacccctgctgaaggtgcggcctgggcccagccctcggggtggagggaacacaggctgctgtttccggatgctctgacagcccaggcctgggggctgaagtcctcagctgggcagggacagctgctgcccctttcgctttagactctgggtgctgctggagacacatcccagcagccagccccatccgggacaggtgtgggtgagggccttggcaggagtgtgcatggcctttgccgccttccagaagggactgtgctttggagaacgttagtcctgactttggcttccttggcttcaagagaggaagcgtgtacggggtggggccatcctgggctccccaggtgtctcatgcaccgctctctgcccccgcaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggtacgtggtcccggtggccgggccctgagatgcagccggatgacttcctgttgcccaaggttgtgggttgcagggttccagaaggctgagctgcactggaataaagcttgcgggttttctctgtccctcaggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagaggtgagcagctgggtgatgtgcaggccccttggcactgttgcgggccctgccctgctccaagtcttgggctcctcagtcgggagctagaagtaaggagcatagaaggaatatagggtgatacttgtgccagccacaacttttgttcttagcccagtgagggcatttctggagaagctccaagccccagggcacagcacacccctgctcatctgtgtccctgggcacaggtgggtggcggccgtcgacccatacccagggaggagggcagtgattctgaagaggatgtttcctgacagccccgacgcagcagtcagggccttgtggaagccaccagtctgccctgggacctggcaggagggccaccaactccgggagggacctgccctggccctccagggtccagcacaaccatccctgcggcctgctgccgccttctgcttcttccagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcaggtgggcacggagtgcacctgctgggagcagacaccctgaggggggacggcttgtgtcctgagttgtggctgtgtgggttgctgtggttggtggattggggtgactggtcatgaaaggaggggttcttggctgtggctgtaaatggagactcctgcccaggcagccaccaccctctcctaggctgctctgcgcgtgttcactgtagcttgtgggacttaacatttcttcaggagtttgtgctggtcccagtttcccagcaccttccctgaaatcttgttctggcggggtccctagctaaagggaagctgggagcctggtcccgcctgttccgagccgcctacccctttggtgctgacccgcatccctttcagtgcatcatcgaggagtcgggagagcatatcatcgcgggcgccggcgagctgcacctggagatctgcctgaaggacctggaggaggaccacgcctgcatccccatcaaggtgaggcgccagtgaccagccttccccacgccccaccccggacacctgccctctgctttaaagctgagctgagctaggctctgcagacgcctagacttgatctcggtcttggtctcagcttcttaagttcctcaagtttcttctttgcagtcttccacaggcatgtggggctgtttttgttgttgttgttgttttttttgagatagtctcgctgtgtcatccaggctggagtgcagtggcgtgatcttggctcgctagaacctccacctcccgggttcaagcgattctcttgcctcactcagcttcctgagtaactgggactacaggcgcgtgctaccacgcccggctaatttttttttgtatttttagtagaggcggggtttcactgtgttagtaagtcaagatggtctcgatctcctgacctcgtgatccccctgcctcggcctcccaaagtgctgggattacaggtgtgagccaccatgcctggcccagggctattttttttttttttttttttttttttttgagacaagagtcttgctctgttgcttaggctggagtgcaatggcgtgatcttggctcactgcaagctctgcttcccaggttcacgccattctcctgcctcagcctcctgtagctgggacttcaggcgcctgccatcatgcccggctaattttttgcatttttagtagagacggggtttcaccgtgttagccaggatggtctggatctcctgacctcgtgatccacccgcctcggcctcccaaagtgctgggattacaggcgtgagccaccacgcccggcctccggggcagtttttgagttacatcctgctgtcttctgtccacaaacaacacaaatgctctggaggggttgggacaggcctgctccagacctcgtttcttccctgttaatgcttaaaattccacaagcccgtggtttctgcgccggagagctcagtggagcccctgctccttgtccttgtctggagtgagatgcgcttggcactgcaacactgactccgcttcgttctgattgacgtggctctaccaggctgtatgaggtccgccttgctaggaaaagcttttaaggatgcgtctgtgtgtaaggtcacctctttctccaggcaagagtgggacttaacctctttttgcagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggaggtgaggcacggctcagcatgtgcagaccacacccgtttccaggctctagagggacctcatggtcctgcctcccgagacagagaccctaatggggccaaggcgggcaaggccccaggtccccctggtggagacctgcaggacttggcaggtggagggcaagcagccgaggtgtgtccggcccttgacggtggctctccccctcccccagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccaggtgaggtctacccgcccaccgctgaccctgccaccgtcctgcccagcggccactgacaggttttctttcccttctggcagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggtgagtgcctgcccggtgtggcctgcagagcctggcaggctggtttgggggacagaagcccagttaagcttagcaaggtgttaaaggaggcgtcctgatgggagcaggtgatggatggagcaggtggtccagtttctgacagcttgtggaccccctaaatcactgaattcccaggggaggggctctcctatccccagtgtgagaagggctctgggcctggagctctgaaggcctacgccctgggccggtagagcagccgagctgtagcacagggttgtcccaaacgagcagcggcatgaggcccatgagtggcctgctaggcccttcgtgaagtgctgggcaccaggccgagtgtctggtctgcagggtgactcaggctgaggaactagcctgagctcctgacaggactttccttctgccctgccaccttctcgatggcccagtgagcctctcgcttccctctgcaggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgactctgttctgcatttttcacggtgtcttcgcaggggagcggggctgcccagtactgggctccctggagcctagaaggggacccgggccctagttaggtgcagcctggggctgcctcagtgttaggtggaacgttctggaatggtgggaatgccctacccctgtgtcattcagagaagcagctgccagctgcgcgggtctgctgagcatttgaagtaggatcagtgcggcaaggaattacgagatgtcactttgaacgcatttggatggccctgtggagcgaggggctctggattgaacttcgcaggtttcagcaactttccgaattgctgacgagctcacaagttctatctgccatcaggattttctgtggtcaccccagtcctgactagtttattagaaacccatttttttt

SEQ ID NO: 90525 - DNA, 1033 bp, Homo sapiens
gggggagcgacccccggcgcgaagacctgggtgaggcaggagggccccgcccccggcctccccgccccccgccctcaccctgagaccgggggtcggggtctgggggccgggacggcgagccgcgggccggccgcgctgtggggccccggacagaaggcgcagacctcgacctgcggcccggcccccgccctctcgcccacttgccccggccggcgccgccaccgctcactcactttggcctccaccagctccgccgccatcttggtcaccagcgtcccccgcgccgggagcccccagccgtcgcgtcacgtgaccgctcaccactcgcgggcggggccgccgcccgggccaattagcacccgcgcgcgctcctcccgccgccggtgcgcgctgctgcctcctgcgcaggcgcgcgcggccaccgcccgggcctccggccaatcaggtccgtcctacaccagcgcccccccccccgctcgcggcgaccacgcctaccccggcggcgcctgactccttaaagtggtactagccctgcgcaggtggggacgggtgctcggtttcctctagggagggaaggcgagagggggcggtggcagcgacaacaatgcagctaggtgccgtggcttcctgcgcgcggcggccgccaggtgcgtctccagactcccggcggcgtcgggcaggggatggttgctccgccgcaacggccgccagtgcgtacagtgaggcgccttgcagcgcagcgcggtgcaggctccacgggcccagacaccccgcgcgctgcacatccgggtcctggtgtgcagatggggcgtgggctcggcaaccagctggctgggggcgcccggcggagaaaagcgggacccctgctcccaaattccttggagatcgtacagccctcacctctttgcaggcgccccccccatcctgcctccccacccatgggaaaccttggatctgcaccagttgggacctcttctccaaagcgctccttggctttggagctaagtggcttcgtgcccgtagaagtggattt

SEQ ID NO: 90526 - DNA, 1342 bp, Homo sapiens
gcactaaaccctcgttcctagctccgcactcagcttcgcctgtcctgcccgcccactttgccttaactacccgcccgtcctgggggccacagcctctgcatgggcccagagccgggacccccccagcccagccccgccctccccagactccgcgcaatcacatactgtatatagacgtgaatcgattttatttttattctttaaattaaggtcgtgataaagtgttgccaaagatacctgctgaattctcgcgtttcaggaaacaaacaaacaaaaaaaaatgatatttgaggagggtcgtgttgactccatatgaaaggacacagctcaaagcttttttgtttggttgtttggggttttttgtgttttctttttttggggtgttttttttttaactgcctggtacaaaaaaaaaaagagaaaaaaaaaaaagaaaaacaatgcgaaattgttatttccattctcatggtgaagttgcgtggacgcgtgtgtgcgtgtgtgcaagagagcgggagtgaggtccaggctggggttggggggcttcaggcgggggcgcccgggggccggggaggtggccgggccggagcccccgtctgcagtgccccccagcctgccgggcccaggagagagagagaagcatctttgctactagctgttgctgctacctgcctctgccccccgacgccccccgccttttgagattaaggaaaaaaaaaaaaagtcaaaaaagtttttaaaaatgaaaaaaaaaaattataaaccagtgaatgtaaaatgccggagcaggcccggcctggcatgggtgtggacctgcagccaggcaggctcgagcgggcgataccaaagtctgcccccccaccattgtggccatgcagtcctgtcactgtctttttgcttccttccgaggggggtcccccagcctcttccagggtcttcccctggaagtgggcggctgcagggaaggtgggggacaggggtctttgcacgattcagaccccggggccgtggcaggagcggtcacctcacaggtggtgacactgaggcaggggcctcggggtgccccctcccgcccggcaaccagaatggttggaggcaagacagagagaatgaaaggaaaaacagaagaaaaaaaaatattaaaaaccaacaaaaaaagcaaaaatcctattttttgagaaagaaagatatttatatttgcagttttattttaaaaagttatttaagttgaagcagccttcctggaggtgggggggggggggtggtgggtggctggcgcaggacgggtcaggggcctggaggctgggggtgccccaggagctacaacctcagagttaagactagc

SEQ ID NO: 90527 - DNA, 1038 bp, Homo sapiens
ataattacccaggctggggctcggggtgatgaaactagggatacctccgcccccaccccgcctctgcgtggccctctggcctgctgtgcagctccaggcaagtcccttcctctctctgggcctcccaggctcatctggggagtctctgcacggttctagaaaaacctagtggctgccatcccctctgtgaccccggccctgtgccagatctgggcaaggcagcccggagaccttgccgtgggctttgcagaaggtgatcagtaaaccagaggcctggaggctggtaacagacctggttaggccagggttctgttagcaagttaccacgttctgttggcttcagtggggcagcaaggctagagataaggtaggggtctggttgccaagggccaggccttgaccctcagggcaacagagccaaggaggggttaaagttagggacaccagctctgtagctggtgccagagggagggacttagggctggaggaacccagaggggagccaggtctttgggaattaggaaaggtagaggggcattcaaggtagggctttgagggatgagtaggagtttgccagtccccacactaaagaagtcttcagtctattgagtgtgagaaggaagaaacccgaggtggctcagatgtggggcacaacaggcagcagcaaggagtaggtcaggttctagccagggctcttgagacccagggctccctcctgccctccggatcccaggaaggagtacactttattactatagattggcatcactcaatgggaataggcaagacacctacttttttttttttttttttttttttttttgagacgagtcttgctctgtcgcccaggctggagtgcagtggcacgatctcagctcactgcaacctccacctcccaggttcaagcgattctcctgcctcagcttcccaagtagctgggattataggcgcccaccaccatgccggctaatttttgtatttttagtagagacggggtttcaccacgttggccaggctggtctcgaactcctgacctca

SEQ ID NO: 90528 - DNA, 1862 bp, Homo sapiens
accgcgccaggccgaggccaggggtttgagaccagcctggccaacatggtgatagcctgtctctgtattaaagacacacaaaaaagaaaagaggctggaggcagggcatgtatcgctttggtgcacagctggggaagctggggctggaaaggcgcgacatctgaccgccttcacgtgcaggtgggaatgtgaggctgggggagcagggtggaacgctgcttctcaagggcctcgggcccttgtcagtgggcacaggaacccccgcacccccactcacgagcgccctctccttccccactgctgcaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggtgagctgcccgccgcgggggaggcgccgtcctgctctctgccccagcatccgccgctcacgacccctcccgcctctctccctgcaccgcacgcacacatgcacgcagacgcacacatacacgcacgtgcacacagacacgtacacgcacagacacatgcacgtcacctacacatccacacacacgcagacacacatacacgcacttgcacatatatacgcacatgcacacacatgcacagacgcgtatgccacgtacacatgcacacacacagacgca

SEQ ID NO: 90529 - DNA, 1126 bp, Homo sapiens
ccaacctggaactgggatcttcacactggcggggacctgcaggaggtcgctgagccacctggattattttgggcccatcctccaggccccaggaaagacacctcccagccactccagagcggggaccctggtcacccgaggggaggaacggcccagcaggccagggatagccatcttggggcgttggtggcctgggtcagaggtctccccccatgctggggtgggtaggagggcccgggcccgtctgatccggagctccatctgctcacacgctccccgcggcccagggccagacggcagatggtggcagggggtggacaccaccaaaggggactcctcggaggcttcccagggccgagccttgggtggggtcgctcccctcctaccctccctgctcccagcagccacatctgagcccaccgccccaccacaggccttagagtagacgggggtgctgagcagctgggccctgggccgaggctggaaggagggaaggaaggcgggtggaggggcctggggagcgtggtggcactgagcaagctcacaaaggcctctgtgtcgcctggcagctcaggccccgcgctgagggccctgggctttgggtccggctggaccgacaccatgcctcccttgtggggcctggctcaagcccgtcggcgtcagagcctgcctgagctgctgggctgggggacaggagggtctggtggcccggaggaggccatgaaaggcccagctcaggccctctccccaggggccttgcccaggggctctggcccgagagccaccggccggcctggaggaatgtgagctgtgctgggtgactcggggccgccaggggctcccaggagagggcggaggggtggggacaggggccagagggttgcacaagctccgagtgggtggatgagtcacagccgaggggaaggcggaaaaaagggagggggagaaaggggtgggacagacacagtccccccagggcccggcgctgcccgaaacctctgcccatttgacagatagggagactgaggcccagagagggccaaggccttggctggggctgaacagctcagctggggtggctgagagttggggaggggctgccaggcagtcctgtgggcaggcagga

SEQ ID NO: 90530 - DNA, 1031 bp, Homo sapiens
acccatgggtggcgggctcggtgggcccccccacctccctgccagctgcctccggagagggcgtggggattccgtgtcagtgccccccgccccaacctcagaactggaccagggcgtaaccctgagcgtgccgctcccacactgggggtgcctccccaccaccggccgatcacttcctattggcaaactggtctgggagaggtcccggggaggccaggctggggcaggggcccaggccaggccaggcctaagcccagccctgctgctgccagggcctgagggcttcaggccgggggcgtttgtccgcgagggccacccgccatggggccccgagagcacctatcggcggggccggggcctctgtttaccaccagccatcgctgtggagacagagcttgggggagaagggggggcaggagccggccgctggaaaagcgaagtctaaggaaggaaagaagagccaaccgggacactgaaattttaattcgtgggtcagtccggggggtatttattattcagttccgattggctgcgtggcggccagtcagcacctgggcccgggcgggcagccacgcatcggcagaggcccgcgggcggccgcaggcagtggatgggtcctttgctctgtgcgggagactgaggcgcggccgaggcagagcccagcctggggcctggtcggaaaggttcctggggcgatcacaaatccctgctgggtgtttgtttgtttgtttgttttttccttttctttccttgagtccctctgacctatagctgggtccacctggtggcagatccccgttgccatatgaggaggaaaccaaggccgggaggggaggtcaaatgtgagcctggaaactccggaggttagagcaagcctcggagcaggtgccggtactaggcaggggagactgaagcgtagggggaagcagagagcggcccaaggtcactcaggtggggtcagagctgccccctgtgctccatccttccagctcggggcctgtccaaagtcccctcccactgtgtggtggccc

SEQ ID NO: 90531 - DNA, 1265 bp, Homo sapiens
ctttggctgtactgtacagttactgtaggggcagtgacgccgccgccgccgcgcgagggagcgaccagggcagcgcgacgcgggcagagcgagcgccgcggaccccggaggcgagcggccgagggagcccagtcccaacttcgggccccggccccgcgcgccccggcccggccccgcgaggtaagtcagcgcccggcgcggcccccggcacggggtgcagggcggggacgggcgggggtcgctgcggccaccgctgccccctcgggaaggggagatccggggagccggggacgttcccccaagtttcagaggaaggggtggttggcagctgcccggaggctggaggcgccctggatcccgagcgcggggagggggcgccgcccgggaaggggggattgggggctaagtgcatgagcttgtgcgccagccccccccaacccgggtgcatggcttttcggggctcccaggcgcgcggggagcgggggaggggaagcagggctgcattgagggtggggggagccggcgtggggagataggggggcgcgtcgcctgctaagtttccagctgaagacgaggggcgctctcgccccccgggggcctattcggtgctgcgtgcatacgttggagttggccaggattgagctccatgggggatgggggggagggggctgaaaaaacagggaggggggcttcggaaaggagggggaaggggtggggtgtccgggtgggcgggcagggccgcagggacctctgggcttcgtagtccctccgccgtttgcagccggcaggtggcaagcggcttggactacaagtcccagggtgccccgcgccgacagcccgccgcggcctgcgggtaggggcggtgcggaggaggggcggtgagcggcgggccggagagccaatgggcgcgggccgatcgcgcggcgcggcgcgggggcggggccagcccgccagggggcggggcctggagccgggctcccctcgccgggggccggtggcggtcccggcttccggctgcgcggcccgcgggccggccccctccccgccccggggcccctccccgcctggttgtgtaaccgtccccagcccccctcccctcggccccccgcccgtggggggggggtcaccctccccgcgctccccggggagggcggcggcccgggcggccgcgcggtgcaggcgagcccggggatgcgcggcctagcgcaggccgggcccgggcgtgggggaggcgggcgggcggacccagatccggggtaatttgc

SEQ ID NO: 90532 - DNA, 1004 bp, Homo sapiens
gcaggagaatctcttgaacccgggaggccaaggttgcagggagccgagatcgcgccactgcattccagcctgagcaacagagggagactccgtctcaaaaaaaaaagaaaaagaaaagaaaaagacggaggcttcctgggtcctttgagctgcagcttatccttgaggtcctgaggtctgctagacttgttgagacaggatcaaggcagcgtcctcagttcccggggagccgccctggattctggtcattggtgtgtctatgggggtacacagcatggatcctttccttctacaccatgaacccctcaagtgcaggaatccagtctgtgtcctcctgggggccgatgcaccacggccacatagcaaacggccagatggagtctccctaggtagctaacccctaccctggggggtctctgcagggcaaacctggtggacctgcagaagaagctggaggagctggaacttgacgagcagcagaagaagcggctggaagcctttctcacccagaaagccaaggtcggcgaactcaaagacgatgacttcgaaaggatctcagagctgggcgcgggcaacggcggggtggtcaccaaagtccagcacagaccctcgggcctcatcatggccaggaaggtgagcactgcggggtcggggaggtcggggagtggtggggaaggtccccctggaaacaggaggcaggttgggaaggcagccgggtctctgcattctgattagctccaggctctgtccctcatccccaccagggactctaggtcctgagaaagggcccagcttctgggcagatgggagccgtgccagccacaccagccacacacagctgtgccctccagtgactactttctgccctggagggcacttgaaatccatattcccagaaagctagcacgtgggggtttcagaaatgcgagtgtgttatggttctccagagaaacaagcgatgaagacgaagcgtgtgtgtgtttgcgcctatgtgtacagccacc

SEQ ID NO: 90533 - DNA, 1034 bp, Homo sapiens
tgggtgctagttctggtcacctgtccaccccccacctccctgggagaacgtcaccctagaaacagtgcgagagtcacccatgggagctcacctggtcccatcctcccccttcctccctgacacaggcagtacgtccgagacacagtcgtgggcaccatgggcctgaaggccacgggccggctctgcaccgtggctaaggcaagggggctgcgagcctgcaggtgagccacccccacccatgccctgggctccaggggaggctgcgaggcccctgaggactctcctcagcttcctcattgcaggggagagctgagggacaccatcctagactgggaggactccctgcccgaccgggacctggcactcgccgatgaggccagcaggtctgaccccccacccccagggagcccatggtggggcggggcgggacgacagcagaaacacagccagctccagcatgggacagtggctgaggctcacaggcagtgaggggaggcttcctggagcaggtgggccaggccaggggctgcacacacgcactcacacacactcgtcacctcatggctctgggtgggtgctacacaaggaaaccaaggcttccgccaggtgtctcctctatccagtgctgcccagccgggaggtgaccgagccagggtcccaccctaggtgtccaagctcttaccacactgtgatactccccggaagtgtctaagggcccgcccagatcaatgaccccgccaacggaccgcagaggagggcagggcgggatcccaaaggctgactcgggagtggggctggccttgaccgccccggtgagcacagatggcctaggtgtgaaccggcccccagggctggctcgggatgttggcaggagcagggcatcaggctcagcccacgctccccggccccaggaacgccgacctgtccatcacgctgggtacatcgctgcagatccggcccagcgggaacctgccgctggctaccaagcgccggggaggccgcctggtcatcgtcaacctgcagcccaccaagca

SEQ ID NO: 90534 - DNA, 1060 bp, Homo sapiens
tctcatgcctcagcctccagagtagctgggattacaggcatgcaccaccttgccctgcctaattttttgtatttttagtagagacagggtttctccatgttggccaggctggtcttgaatacctgacctccagtgatccacctgcctcattggagagtttgtttgcagtcatgttaagggtagggagtggaggatgcagggaggcagtgggcagatgagaagagtcttaaagtccatgccagggagttgggcatttttgcccatggagatgggaggagcactaggaagaaatctcaccagtcaaagcaataagacaagaaaaagagaaggtagtagaaccagtaaaaatcagagagaaggggccctgatctgctggtggtactttagaagattctagtgcctggggatgtaggagctgatgtctgtctatcctccctgcagacagaccctgaaaacacagactacaccatggagcatggagccacgcggaatttccaggctgagaagctcctggaggaggaggagaagagggtgcagaaggagcgggaggacgaggagctgaacaaccccatgaaggtgagtcgggggccatgtaggtgttcatgggcgctgtgtgtgtgggtgtgtgtgtgtgccaatggttgtgcccttcctgcctcaggtccccaaggaaggaagatggggtggggggcgtggttggtaaaactttaagatgtccccaggaggccaggcatagtggctcatgcctgtaatctcagcactttgggaggctgaggcgggaggatcacttgaggtcaggagtcctagaccagcctggccaatgtggcgaaaccctgttcctactaaaaattttaaaacttaacactgggcgcagtggctcacacctgtaatcccagcacttttggaggccgaagtgggtgggtcacgaggtcaggagtttgagaccagcctgaccaacatggtgaaaccccgtctctactaaaaatacaaaaattagccaggcatggtggcacgcttctggaattacagctactcaggaggctgaggcaggagaatcgct

SEQ ID NO: 90535 - DNA, 1103 bp, Homo sapiens
aaaatgcctccagaggctgggcacagtggctcacgcctgtgatcccaacactctgggaggctgaggcgggcggatcacgaggtcaggagttcgaaaccagcctggccaatatggtgaaaccccgtctctactgaaaatacaaaaattagctgggagtggtagcgtgtgcctgtagtcccagctacttgggaggctgaggcaggagaatcgcttgaacccaggaggcggaggttgcaatgagccgagattgtgccacagcactccagcctgggcgacagagcgagactccatctcaaaacaaaaagaaaagaaaattcctccagacgtgggagggagacttttaggcaacaacccttggccttcgcgcttctggctccatgttctgtcccctctaccctttgccatcttgtctctcctgttgtccttctgcttgtccatctctatatctgtctctctccgaggcttcgtcagtctcttatctctgtcttggactcttatctccttggctctttgattctctgtccctgtcttggtctgtcttggtcactctctgtctctctgtctctctctgtgtctctccgggtttccccatctctgtgactcccacgtctgcccggccccagcgttcatgttccgcctggatgcgtccacatcccaccagaacctgcgggtggatgatctctccgtggagtgggacgctatgggcgggaaggtgcaggatatcaaggctcgcgagaaagatggcaaggggcggacggcgtctcccatcaactccccagccaggtagcctgccccctcccctccctaagtctctggtggaggagatcagtctggacatggacacagagcccagtgtggtcagagttggggtggagaggggacctggggctggtggaacccagagagggaatgaagggagaggaggttttgagtggagttttgatggttaaataggagtttcccagatgacggagggcacaggcatgttctgacataaacatgaggtgctcgatatatagatagagccaaatactgccagagattgacccaacatccacggtggctggggtggactagggtagccttaccgtgggagagagaag

SEQ ID NO: 90536 - DNA, 1147 bp, Homo sapiens
tgggcaaggcgatgtagaaggtagagtcggtgcctgggggtggagccattacagggggcggggcctacctggggcggggtctttagggcctggttctccctaggcgcggtgccagaattaggggcggacctttcctagggtgttgtcagtctggcctggtccctcgctggaggtggtgccaagactagaggtggggtcttctgtgggggtgggtcggtcgggcctggtccccgctgggagcagtgctgggatcgggcagtcagtgctccgggaggtcaacggggcttaggtcctttatggggtggaaccagtcagtggcggggccttctgtgggggcggagccagtatggacctgtttctattggaggcggagcctggagttggggcggggccttccctgaggggcggtgtgggagcctgggctgagccactcactcgctttctcctggtgcaggacgcacgtggtccggcattacaaggtgaagcgggagggccccaagtacgtgatcgatgtggaacagccggtgagcgttgggccagagtccctagaagtgactttgtggggtccgcgtcccttctccagcagcctgaccgctcccccatctgcccccagttctcttgcacctccctggacgccgtggtcaactatttcgtgtcgcataccaaaaaggcgctggtgccattcctgttagacgaggactacgagaaggtgctaggtgggtgccccttcggggagttcgggggcccagtgctcacctctcccgcccccgctcggacggaccgggccgcccctggccgccgcgcttcctccaggccgccctctctgttccaggctacgtggaagccgataaggagaatggcgagaatgtgtgggtggcgccctccgctccgggcccaggtgacgcccccttcccgcgggccgaggtgggagggatcgaggaccccgcattcagccacgccccctcagtcagtttggtggctgcacctcctgcatctgatgttcccaaagttgcagggacagaaatgactcagaccctgccgtcagggtgtgtgtgtgggggagggggcgggggtcccagcttgggacagagctaaacacagacactctcatcctgtagggttgaatttggggtggaggaaaaacctg

SEQ ID NO: 90537 - DNA, 1048 bp, Homo sapiens
agccctgtattattactattactgttgtcattattgtttgatttgtgaatggtagcacattattccccttctgaatgggagtttctgaatggagcaactgctgagtgttgcatcctggagacacagcagtgatcaagacagacagaccctatccccgatcttaggggtttcttggtcatggtgggcggggtgcagatatctgccaggcagcttggtgcaggctgatcaggtttgtgggtgtggactcccaggcactgaggaggccctgcagccggcctgagaggtgttcctggaagccctgtaaagacatgcctgagggagcgtaggtctggggaggaccccccgggagagagggcatggtgggtgttggtcctgggcccagccagctgactgtcactgcaggggaagaagttcctgggcgacctgcagccagacggaaggatcatgtggcaggagaccgggcagaccttcaactcacccagcgcctgggccacccactgcaagaagctggtgaaccctgccaagaagtcgggctgtggctgggcctctgtcaagtacaaaggccagaaactggacaagtacaaggccacctggctccggctgcaccagctgcacacgcctgccacggctgctgatgaggtacgtgctgcagcctcctccaggaagccgcccaggtcactgtggaatgaggggtgcccagcctggcacagctctctccggaggaggtattagtaatatatacaaacacggatggagcccttaccacgtgacatgcctcctccatccctccagggctggggcggagagaggggacatgggagcttgggctttgagggatgagcaggagtttgtcagagcaagttgaagggaagagctttctagaaggatggaatggcatacgcaaagtcatgtagacaagaagaaagacctgctggtgtcatgggtggctgagggggctggaaatgatggcagggaccagaggggcactgggggaacttcaaatgctatgataatagatgttccctgagtgttcaccagccgggtgaac

SEQ ID NO: 90538 - DNA, 1048 bp, Homo sapiens
gcagggccctgcctcccaagccccgccctcagaaagccaagtaccttttcagctttttaactgcccccatcccaacccagggaggcctgtgtcactctggcacaagctgccaccaccagccacccacacccaccccagcacacctcacacgggaccacagccgcgctgccgagggccaagcacaaaggttccagtgagcgcatgtcccagcccctggtggccaggctccccttgctgagccgctgccacttcaccctgtgggaagtggccccagccatctcctctagaccaaggcaggcagccccgacatctgcttcctctatcgcccaatgcaaaatcgatgaaatggggagttctctgggccaggccacattcacattcccctccccctgtggtccagtgaagcctccggaccccaggctctgctctgccctgccctgcacccccctcgtcagaagtacatgaggggcgcagagatgagcacacagctttgggcacggtccagggcaaactgaaatgtacgcctgaattttgtaaacagaagtattaaatgtctctttctacagccccttgcctcgtcttggtgcaggggtgggcctgccacccaccgccttcctgaggggccggctccaaagccacacacaccccaggaggtccctccagcaccccaggtgctcctgagcccaaggtgggtgggactggccctgaggcttttgtgccagttcccaggtgcaggggctgaggggtatcctggaagttaatgccctgccctggaagtgaggaagctggggtgatggtaccagcctgggcacccagccaccctcaccccagccttggggagaccagcgtggctggctgctgcttccgtttctttattacctgagcccatccggaccctcaagacaactggagcccaccctgccctggaaggctcagctcccctgcttgaggacgccgcacacctgttccaggacgtgacacaggctctggtccttgggcgtcctgctggccaaggagatctgaaacgagggggctgggcctcaggctg

SEQ ID NO: 90539 - DNA, 1024 bp, Homo sapiens
gatccccagtggtgcagggacagtgggtcaaagccatgcgtggggcggccctctggccgctactggtgtgacccatgtcccccacgtctccagcaccacctgaagaaactggagggccgccgcctggactttgactacaagaagaagcggcagggcaagatccccgatgaggagctacgccaggcgctggagaagttcgaggagtccaaggaggtggcagaaaccagcatgcacaacctcctggagactgacgtgagtagctcggggtgtcacatcctgagaagacctatgcccttgggaggccggggtggtgcctcaagggagctggaggacagatcggcacctacctggccgctgcagcaggggaggtggagggtatgggccccagtcccctgtcccctctcagcccccttgcctcctgtggcttcacctcgggagtcagggaaggcacaggacagtggcactggcaggagcccctgagccctactgtccccacagatcgagcaggtgagtcagctctcggccctggtggatgcacagctggactaccaccggcaggccgtgcagatcctggacgagctggcggagaagctcaagcgcaggtgagcccagggccttggtctctccagagtctgggctgccatgcgccctctgccagcgcaagtgggcagcacacctcgctgtggggtgagcacatggcagagcagcatcctggattcttcctggggactgagtggaaaggcctggggggccgcgaggtcagaggagctggggctctgagaactctgagtcaacacccagccctgccccgatgcaggccccggggactccctccctggctgcacgttgctgctgccacaggaacacccaggctcccctccctgaatgcagaggccagacctgcttcaggggccttggcgtatgtggggcgccgtccgtggtggggaattgggggaggaggcaggggatgcgactgggggtgttgtaggtagatgctgtggcaggccccagctgcttggcaatc

SEQ ID NO: 90540 - DNA, 1034 bp, Homo sapiens
ccctgggctcacagcgtttcccctcttctgtcctctagctggtcagtgagaaggtcggaggggccgaggggaccaagctggatgatgacttcaaagagatggagaaggtgaggaagaaactgcgtgctctgtgtggtggtggcactgctggggcctgacctctgccgggcatagtggaggcggccaaccttgatgggcctgggtctggagtgatggggcccggcaggtgtggagagatggggtggtgtgggggcctcgtcagctggacttgacgggcaccagctctctcccctgccgtgggcaggcagctgtggggacatggctgagctgaagacatggagagggggttggggggtcctggtatgggctcttagggcaggaggcggtgcagcagcgggggtcttgtgtgccttgggcccccactggctgtggagtcttatatgctgcttctcttcacagaaggtggatgtcaccagcaaggcggtgacagaagtgctggccaggaccatcgagtacctgcagcccaacccaggtgggtgctccagccactgccagggcctgccccaggccctctggcctctgtgtcagagggaaggcaggggatgacagaaccgccaggctcatgggttgtgggcttcaggcacagctggatcccggagtgcagaggccatccttggtgctgcatgctgcctttccacctcaaccagcagctcagcccctctgttggcttcactctcatgccgactggttcctcagggccgtcccagccttcaacccctcttccagccagcagtcctggcagggagcctctcccccagcttacttgtgggatccatttgtattggccgcccctccccagtgcccctggcctggacttcacctcttgggcttgggactgggtctccctggctgagagacgggcttttccccaaggaaaacccaaatgctggctccataggaggccacggacagggggcagacgcacacccagcagtgtccactcaggccctgccaggagcagacccaagcgggca

SEQ ID NO: 90541 - DNA, 1046 bp, Homo sapiens
ccccgggctgcccggatgagggagccaggcccgacctggcccgggagggggccggggggaccgaggtggggacgttggcgcgtgtcccctgccaggtgggaagaccaagggacggacgggggcgacgaggtggcccaggccctgcccgccatgcgggctccagaagcggggacagagcccctgggaggaggggagaggcaccctgggctgcccagggacgcggacctctcccctccttctctccgctgcaaaggcggggtgcggggagagaaggggaagagaggagtcccgaggctgtcgacacaggactcttgccagataacccagagccagggaaaagttgcgtctagagcagttacgttcaaaatcctctggatgggcaaggtacaaagttgaaaaggtagaggaagaagtcagtttcccctctctgctcctcgggcagccagcccttctccccagagacaagcgactgtcatcgactccgtatgtccctttcctaagatacgtgtgtgcctttcctttaaaaacacgtaccctgtgatagcatatgccacagaatcctgtgtgctgtgtttttcattgcttggagatcacactggagcgggatttctccccctccgtcggcactgttgacatctggggctggattgttctccgtggtggggccgtcctgggcactgcggggtgctgagcagcgcccctggcctccacccactccgggccaggagcacccccaagtcgtgacaaccaaaaatatcttgagacatcaccgtgtgtccccttagaatcagtcctccttccctcccttcgttccttccttccttctttccttccttcctccctccctccttgcctctctccctccctcccttctcttctttccttcctcccttcctttcctgtcccccaggactactgctctagaccatactccacacttcttggatttttttttttttttttttttttgagagggagtcatgctctgtcgccccagctggagggcagtggtgcaatctcggctcactgcaagctccgcctcctgt

SEQ ID NO: 90542 - DNA, 2013 bp, Homo sapiens
cggcaggaacttgctttcaagcaagttgtttttggtcctgttttgttttgaaggcctgtcgtttgggaagtggggatttggtgggactgtctcatggttggactggaggcctaggcattccttgtgcatatctgaccaccgaggcctgaactgtcagtcagagagtggtctcaggccctgcatgtgtctgccagatgcctgggccatgtgggtagacacccaaccctgttaaacggctccacgatcacacattcaccagaaaattcagaggggtgttaaaagaggcctcatgggtgagttcagaaatatctgtgacgctcccaaaggagaccaggtgtgaattattccatctggaagaggggcagccagcgcatggtgtgctctgccctggccctgacactgtgggaagttttgtgcccctgtcctttcctcttgctccccagctggctggggactggttcctcaaaagagtgcccgggcataggggagcaagaaccccaaataaacttctgctttctaaaccacaaggagtgtgccgaccctgagaaccataaggtccgccagaaactgaaggccaaggagtgggacgagttcctggctaaggggaagcgctttcgcgtcctgcaacctgtgaagatcggctgcgtgtgggcggctgacagagactgcgcaggcgatgacctgaaggtactgcagcagttcgcagcctgcttcctggagaccctgccggcccaggaggagcagacgcccaaggcctccaagcgggagaggagagacgagcagagtgagtgtgggcggggccaggccacccacctgttcctgggcccagctaattccagggctgagggcaagagtcacaggctagtgggtccgtgatgcaaatgttctttccacaaataacagaggccagcccttttcctgtacatgtccgtacgttcaatgatgtccctagcagcaggacgaggcaggtcccttaattggcttgttttatcaaccaggacacaggcacagagagtgctggagtgggggctgtgctttctcaaaagccagggaggggccgggcacagtgcctcatgcctgtgatgccagcactttgggaggccaaggtgggaggatcgcttgagcctagtgcttcgacaccagcctgggcaacatggcaaaaccccatctctgcagaaaatgcaaaattacctgggtgtggtatcacgcacctgtgatcccagctactcaagaggctgaggtgggaggattgcttgagcctaggagtttcagaccacagtgagccatgatcctgccactgcactccagcctgggtgacagagcaagaccctgtctaaaaaaaaaaaaaaactcaaaaaactggggagggaccatggcacacaaggagagcagggcagtcatttgggtaggaacagcaggcatttgaagtcagccctggcaacacacgtgcccggccaaggctcacttctgggcaggtgcgtaggtgctaccctgtcttacacccgccctcatgaggccacctatccccgaagctggccatgccccaagcctcggtggcaatgagcttgtgtatgtgttttgttttttggcctgtggtgatgggtggctccccaagcctcatgcccacccatgttccctcctgccagtcctggcccagctgctgccgctcctgcacggcaatgtgaacgggagcaaggtcatcatccgggagttccaggagcactgccgccggggactgctcagcaaccacaccggcagcccgcggagcccctccaccacctacctgcacacccccacccccagcgaggatgccgccatcccctctaagtcccggctcaagcggctcatttccgagaactcagtgtatgagaagcggcctgacttcaggatgtgctggtacgtgcacccgcaggtgctacagagcttccagcaggagcacctgcccgtgccgtgccagtggagctatgtgacatcggtgccctcggcccccaaagaggacagtggcagcgtccc

SEQ ID NO: 90543 - DNA, 1032 bp, Homo sapiens
aggagaatggcgtgaatccgggaggcggagcttgcagtgagtcgagatcgcgccactgcactccagcctgggcaacagagcgagactccgtctcaaaaaaaaataaaaataaataaatacagttgtaatctgatggggccactatcaggtatgcggcctgtcactgactggaaattattctgcagttggcaatgatggctgtttttggagatctgaatccagttcatttgagggaacccccaaggttctctggttgtggcctcttgaataaacctctcacatttggacagtttgttaccaaattgggttctggatgttggtttccttccgtgttgggggtgggaggaaggtgtcacacctgtggagttccccccgctaccgcactggcaccagggtggctgctgcctgcagtgctgatggccgtgtaccctgtctgtccagattggtgctgaagacatggacggcttccaggcagacacggaggaggaggaagaggaggagggcgactgtatgatcgtggatgtcccggatgctgcgggtgagaagggctgtagatagcagaacgcactggtgaggtgggcgctggaggtaaacctcaacagagaagggatggggctgcctaagactagctccactgtgagcagccaggagggcttgcagctggaagtggctcctgccctgccacatcctcgggcgggctgggccgtgggtgctgaccatgccaggcatcgttctggccgcagagccacaagggcctatgctgggagtctcaggtggttgtgacgttagatgggggtcagggaaggctgcactgaggcagcaagggagggccaggtggatttctggagcactcgccaaagaggaagtacagaggccctgcagcaggctgcgtgggaggagtgtgcccgggtggtggggggcaggcagggtcaacctgagagcaggtgagcaggtcacctctagaagaggcacaacgccccagcctctgcctgtccccactgtcaggtggagggtcccgccctggggttgttg

SEQ ID NO: 90544 - DNA, 1091 bp, Homo sapiens
cggccttgatgtcctccagcacagccatgtcccacgagaaggtcaggagggcagagggcacctgcggtaggggtaggccgtcactctgagaccgagagtcggcccttgccgcggcagggaactcagcgggcaacctgggcgcggggatgccccggcctggaagccatctcagctggtggaggctgtggctcgcacccaggcctcctgccctctccctccgggactccaggacctaagcctaaacctactgcactagctaacgcacgtcaccgctcccatttgatggggaaactgaggcgtggagtagttatgaacttgctcgaggccctgctgccagtaagtgggaaagcaggattcaaacccagggacctgcccaggccccctgctctgagaacaaggaggctccctcctgggggtgtctgtgccggtcccaggagaacctgcagaggcatcgggtcagcggtgctcctgcgggccgacactcaccagcccgcactcgttcaaggccaggttctcgtcctcggacagcttctgccctcccgaggccagcagctcaaaaggcagccagtcgctctgcagggcctcccggacgaacccgtacaccgcccccagccgctcccgagcgtagaaagtgcctggggagtgggggagtcagagcgggtggggcccagggccccctaccaacccgagccgccctccacgggcatcgttggtgcccaccctgcaggaggcagccatcggggaggcgcacgcgcagcagcgtgtagttgtacttgcgcagcccccgctgctcctccttctcccgcatggccttggtccgcagcacgctcagccgctccaccgcctcggacctgcacacgcgggccaggtcacgagggctggccggggttcttccaccccgccccgccccactctgctccgcggacgtcaggcccacctgagcctctgctcccgcttgatctcctctgctgtgaggttgaagaagtccccaggcagttcgaactgcgaggccaggggcgagggctggaagacgcggcgctgcctgtccagcttggcgcgcacgggctccgcagccagcagctgttccttgt

SEQ ID NO: 90545 - DNA, 1031 bp, Homo sapiens
aaggtgttgaaggaatcaggggtttcccaccctggcttccttggggaacatgtggaggaggcagggtcccaccccactccccgggtctcaggatcgggggcaggcctggaggtccacgctgcccgccaacgccgagggagcaccccgcaggagccccctgctggcactgcggcccttcagctctggctctccactcttccggcactgtggcttccccaccgctgtggttaattgtgcccttccagggctggtgggacggtgaggggttccgtggggctcctgctggcaccaggggtgggctccatggggtgtccgaggtgtgccttccacccggagatggtctgctgccctcgcgtcactgggccgcttcttccctctgactagaggccaagtgtggctgagctgctgttacctggagcaggaggcacagaggggccgggtgggcagcctgggctgtgccccactcaccttctccacctaccccaggtacctggacaacatccacctgcaccccgaggaggagaagtaccggaagatcaagctgcagaacaaggtgtttcaggtgggcgtgccttctggcccccggggcccaggctgggggtgggggcagctggcctgcaggagccggtggtggcccacaccaggcggtgggctccctggaggagctagcgagagttgagccacaagcagtgaagggttcggccagtagaaggtagcaggacaagatggagagcaagacttttatgcaccggtcaccccaaatcaacaaattctgcctctcctcacctgcatccttttcctcctcttcagctgggcttgtttgggaacatgtcgactctggggaggtttctcatgcaaaccagatgtctggttcttctgggggaaagggcagggactggggtcctgggcggtgttagcctcgcatcaggccccagcagtgtctggctcctcagcctcactcttcgtgcctggttgtgactctttcctctgtgcagagctgttggagactccacagcccccaccgtagaaaa

SEQ ID NO: 90546 - DNA, 1030 bp, Homo sapiens
ggatctggctttgctcaggtggagcacctgccctggggccagctccgtccctggggtagggggagagctctctgggtggggcacagctttgcagtgaagggtacacagaagaatgcagcttcccatcgggaaggggctgctgcttcctgggttgaaggctcccctcctcccagcgtgatttgccccaagtaacttggctgatttctcggtgatttcctgggtcagtgggtaaagccaccccctcactggcctctcactgcagatcgacgacatcgcggatggcgccgtgaagcccccacccaacaagtaccccatctttttctttggcacacacgaaacgtaagtgtccccttctggggcttggttttctcctctggtgcctcccggggtggcctcactcacctgggactggcccccgtttcccttctccagagccttcctgggacccaaggacctgttcccctacgacaaatgtaaagacaagtacgggaagcccaacaagaggaaaggcttcaatgaagggctgtgggagatccagaacaacccccacgccagctacagcgcccctccggtgagtacccggggtggagagccagtgtgaagcgcgctactgatgcaagaaggggcctccagttagggtctctcccctgggcactgtggacacatggggctcgatcgttccctgtggtggggcattctgggccctgcaggtgctgagcagtgtccctggcctccacctactcagtgccaaggccacccccaccccattcatggtgatgacagatgtccccagtcattgcccagtgtcccctgggtggaggggaacgggatagaatcagccctggcgagaacccctgctgtagaatcagtccaagtttcttttttttttttttttgagacagagtctcgctctgttgtccaggatggagtgcagtggcgcgatctcggctcactgcaagctccgcctcctgtattcccgccattctcctgcctcagcctcctgagtagctgggactacaggtgcccgcca

SEQ ID NO: 90547 - DNA, 1099 bp, Homo sapiens
gaaaacttggccattaaggaagaaaagcacatccgaggtggtctgagtggagcaaggcaggaggggcccagcctttggcttttgcgagtggaggatgcagtctctttgtggttcctggtcctgtttgagaacctggggtcttgaggtggcctgtctgtgcctctcctttgtttcggcctgggctgggtggtgcttgtgagcatttgctccaggatccgcagacgtttcggtggtgacacctgccacgcacacgtgccgcactggggaccaggaacagggatgagtcaggcacagtccttgccttctgggagctcatggtccagaattgaggattcactcaacggatgtcccttgagcgccgaggatctggcagccccttctcagggggccggggcccaccgatgttgcatgctgagggtattttactttaacacccatggtgtgtctaggagactgaggtttccctggtttcatacttgctatctttcctcacgctgtgcctgtccccagcctggaaggataggtcagaaatccttcaaggtagctgtttcaggagatctttttctggccccaggtcaagttctctttggttccgtcctgagctcattacctcctggtgaatcatcacaccatttaatatttattggacacctacagcttgctaagcattatatagaggcctgtctttgaggaaaggaaattaaacaagccctgtacagatcccccaagatgagaagtagctttagttgaggccactgctgctcttagcttctctggcccatctatgcttctagatggaacgtgtgtttaagatgcagattcctggctgggcactgtggctcacacctgtaatcccagcactttgggaggctgtggctggtggatcacgaagtcaggagttcaagaccagcttggccaagatggtgaaacccagtatctactaaaaatacaaaaattagctgggcgtggtggcaggcgcctataatcccagctactcgggaggctgaggcaggagaattgcttcaacgcgggagggagaagttgcagtgagccaggattgtgccactgtactccagcctgggcaacagaacgagactct

SEQ ID NO: 90548 - DNA, 1076 bp, Homo sapiens
cctcaggtgatctgcctgctgcagcctcccaaagtgctgggattataggcgtgagcctccgcgcccggccagggcagccatttctggacctcttgacatggtctcggcactgtcttaggtgctccacctcccacttccatgctttcctggtcacaggcctctgaggtcaaaactgagccatccccattgcccagaagtggtcactgaagcacagagggttgaagtcatttgccccaggtttaaccctgaagcccgcggcccgaccctagtgcccaccatacacgaatccatctcactctcctgccttcgttcttcggctcttctgggcctcggtttccccatttgtaaagccaggagacaacacgcctgacattcaggatcccgcatgtggttgccgtcctctgggtcatagtcctgatggggaaatccacccacgactggtggtgacgcgcgttctctgccccgactcccacagccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaaggtaggggaggaccaaggtgggctggcccttcatccccttgccctgatgtctcgcctggcagcttgctctcctgccctttttttttttttttttttgagacaaggtcttactctgtcgcccaggctggagtgcagtggcgtgatctcgactcgctgcaacctccgcctcccaggttcaagcaattcttctgcctcagcctccctagtagctgggattacaggcacctgccaccgcacttggctaatttttgtatttttgttagagacggggattcaccaggtccccaagttggtcttgaactcctgacctcaggtgatctgcctgcctcggtctctcaaagtgctgggattacagtcttgagccactgcgcctggccacctttctttttttttttttgaga

SEQ ID NO: 90549 - DNA, 1023 bp, Homo sapiens
gtgttgtctgtgtgtggtgtgtgtgtggtgtgtgtgtggtgtctgtgtgtggcgtgtgtgtttggcagggtactcgggtggaggcggtagagcacggcagcttgtctgatgtggcctccgcacaagattttgcataaagaaaaagatgtccccactgggaaacccgggcttctgatgtacccggttcactgaggaagatgaggggaagggccagcagctgcccggcgtgcccagggccgcctgggatcccggttttcacttggggtggaggtgggttttgtgggtgggaggggattcggagccgggccctgagccgaggcccgcagagcctggcggctgcaggggtgcgggagcctcctctggcctggtgcgccccgcttctcacggtggggctcctgatgctcacgcctgtccctgcttctccccagaaggcgccatcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccaggtagggccctcgtgctcgcacatctcttggcctggcccctgccggggcgctcccaggcagtcccctggtcaccttggagccctggaagggaaggtcaccccctcctcctcttcctgtagcggagaagcctctcccgaagccgcgagggcggaaaccgaagcctgaacggcctccgtccagctccagcagtgacaggtgggtgctggggctggggtcccctctggcggctcctccatcggctgaggggcagggcgggctcctgagggaggaacggaggtccccaaccgccccctccgcctccagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggagga

SEQ ID NO: 90550 - DNA, 1001 bp, Homo sapiens
ttccggcggcccctacagagaggcagctccagggctttgagctgcctgcccctggcctcctgggaaggtggcttcttgccgagcctccagggtggcccaggtaggtaggccccgagcacgggcacccggctatctgacggtgcctgtgcccatcactgtgggctgctgtctggtacaaggctcagtggagtcactcacttacccagcagctgccttgtgctatgcctggctggcgccagcgtggggaccctggagatggttgtggtctctagtggcagaagacaggcagataggagggcggcactcgagcctcaggtgccacaacgggggtacactcctcggtgcccatcccacccaaccgccctacaggcagggcaggggcgggagggcatcctcacaccgcctttgctgttcccaccagcagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatgaaaaaagaaatcacttttattggcttggttttctagcattgctggtgcagtgggggcctgagctggggcgcaggcggcagtgtcactgggcccgtttgggactgggttgagccatcaggccaccgtgagaagcgactaaaaggcactctgggcccagcccaaccctgaaaggccagtggcaggagagctgggcgggagcaagctcttcccaggagacaagagggacaaaccagggcatctaagctgtgctgcctgcgccctgccccgcacccacgaggctggggggttt

SEQ ID NO: 90551 - DNA, 1059 bp, Homo sapiens
atgccggtctggacagtccctttggccaacttcacagcccctgtgagcccagtggacacagcatctttagtgccagtcaggacagactttgtagtgtccaggcccccttggatggcccctttggccacattcgcagcaccggtcaccccactgcagacggtgtccttggtaccagttaggacagtcttggtggtgtccacactggtctggacagtccctttggcgacattcactgcccccatgagcccagtagtgactgtgtccttggtgccggtcagcacggtcttggccgtgtctacacctgtctgggcagcccctttggccacattcacagcactggtcaccccactgccaaaggtgttctttgtacctgtcgcgatattttgggtcgttttcagcccagtttgcacagcccccttggccacgttcacggcactggtgaccccactgtagatggtgtccttggtaccggttaggacagttttggtggtgtccatgcctgtctggacggtccctttggcgacattcactgcccccacgagcccagtagtcactgtgtccttggtgccggtcagcacggtcttggctgtgtctacacctgtctggacagcccccttggccacattcgctgcccccgtgagcccagtggacatcgtgtcttttgtacctatgaccacagacttggtggtgtccaggcccccctggacggcccctttggccacgttcacagcactggtcaccccactgcagacggtgtccttggtgccggttaggacagtcttggtggtgtctacgccggtctggacggtccctttggccacgttcacagcccctgtgagcccagtggacacagcatctttagtgccagtcaggacagactttgtagtgtccaggccgccctggacggcccctttggccacattcgcagcaccggtgaccccactgcagacagtgtccttggtaccagttagaacgatcttggtggtgtccacgcctgtctggatggttcctctggccaaattcatggcaccagtcaccccactgcagacggtgtccttt

SEQ ID NO: 90552 - DNA, 1049 bp, Homo sapiens
gacactcgctgtgtggccttaggcaagccacatgccctctctgagctaatatcctcatctggaaaatgctgattaaaacagatcctcttgccaggcgcagtggctaatgcctgtaatcccagcactttgggaggctgaggtgggtggatcacttgaggtcaggagttggagaccagcctggtgaaaccaacatggtgaaaccccgtatctactaaaaatacaaaaattagctgggcatggcggtgagcacttgtagtcccagctactcaggaggttgaggcaggagaatcgcttgaacctgggaggcagaggttgcagtgaactgagattgtgccactgcactccagcctgggtgaaacagcaaaactgcatctcaaaaaataaaagtagaagaaataaagtgcttacgctgctgtcgctttggtctcatcttgccaggcacagccctgtgtagactggaaccttacgtgattagagtggggtagcactgcacccatttcacagatgtggaaatagaggctcagaggggaagctccgcctgggatccccaggctgtctgccttccctcaggcccacagcagccccccagatagcaggaactgaaatgtcccaggagggagcagccccccagatagcaggaactgaaatgtcgcaggagggggcacccccagggctcctgccacatcagaccctgccctgcacatcctctcaccttttccgaaggttgcagctccttctccgtccatggggccgtctgctctgggtgggcagccactgtggggacaggggccggtcagggagagtgagggatgcagttagaaccatctacccggctgcccattgcacaatagccaggcacagcctaaaaggtcaggaatgtttcagctaccccgccagggacagcaggaggtgacatccacggctaccagccagacctggtcaccccccaaccccgctgggggctccccccaagcccagggccgctgttccctgaagtagggctctgtggaacttcctctgctgggtggacacccaccctgagtcccggg

SEQ ID NO: 90553 - DNA, 1031 bp, Homo sapiens
gttcaaatgctaccattaattgcggtgttatttttattatttttttaaagacagaatctctctcgcccaggctggagagcagtggcgccatcccagctcactgcaatttccgcctcccaggttcaagtgattctcctgcttcagcctcccagttagctgggattacccacgtgccaccatgctcggctaatttttgtatttttagtagaaaccgggtttcgccatgttgcccaggctggtctcaaactcctgggctcaagtgatctgcccacctcggcctcccaaagtgctgggattacaggcatgagacactgcacctggccagctgtgtgatttttggcaagcaccttcacctctctgggctgcttcctgttttgtaagatgtgggaggtccctgctacccctgcggcccctgcctgggcccagaactgcccaagcaccctagacggctggaggtggtagctgctgggtcccagtccactcacagctcatttgacagacagggcaactgaggtacgcagcaggtccatgctggtcccaaggtcacgcagccagctagagttacagggggggagctcgacctcgggcctcagacctgccgcctgcgatccctccggttgccaccccgcgtcctctgaggcctggtcctcgcccaactgggtcctgagctggggccaaccgggccaagggtcccagccacctgctctggccggtcatacccgtcccacgccgccggaccttcgcccaaccaccctatctggagctcctctcctaagcccgggggggcgctcccggacgccgccctcagggcactcacctgggcgcgagcggcttcagacaccagctgtctccgccgaccccaggctcgagtctccacacccccgccggtcccgcccgcccttcttatagctgctcgcgcagtgggggcctccggaactgaccaatggggagaggccgtgcgggggcgtgcccagggggcgtggctccaggcttccctcgccctctccttgagctggcccagtgccctacgg

SEQ ID NO: 90554 - DNA, 1050 bp, Homo sapiens
ccctggctggcagggaagagggtctaggggggttggtgagtctggcagccattggagcctctcccctcatctatttttttctttaattagagacagggttgctctgttgcccagactagagtgcagtggtgtggtcatagctcactgcagccttgacctcctgggcctaagtgatcctcccacctcagcctccagagtagctaggaccacaagcctgcaccaccatgcctggctaatttatttatttatttttagaggtggggtcttactatgttgtccaggctggtctctgaaattcctgggctcaagcaagtctcctgccccagcctcccaaactactgggattactggtgtgagccaccatgcccggccacccacaccttctgacgcatcttctatctgctttccggacaggttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaaggtgagcagagcctgacgaatgctgtcgactcatcgcgttagtcacgtgtggttcaatatgctgtttgttcattggtcggcccccccactcagccagcacaccctgcgggagaaggaacagggatcggcaggaagccagccttccccagtgactgcatgatctggcagggcttagagcacccaactgttggcttattcaggcagcagatttactgagcacctcccctgtgccaggcccttagcacaaccaggggttggccacctacggcccacaggtcaaatccggcccaccacctgtgttcataaataaagttttattggcactgagccacagccacttgtttacagagactgtctgtggtcgcttttgtgctgcagcagcagaactgggtagtcccagcagaaactgttgtgcaaggccaagatttactgtctagccctttgtagaaacatttgccagctcctgctgtaggt

SEQ ID NO: 90555 - DNA, 1050 bp, Homo sapiens
tattctgtcgccattggcctccggagggcgcaggtctggctgtcacacgggctccctggttttgcatgggacacaccccacttgtcacgttgtcagttttactgtgatgcctcgggcttcaccgtctgctctggagctctcccaaggcagggatggcatcttcctggtatctgcggcccctacaagccccagctctcagcacagggtgtggcccgtgtttttaaatgagaaagccagatgccacatcactgttgggaatgcgatccaggcccaaagtcagaaggtccccacctgagggtgtcatgcctgttccagcaggacgatgtgcctacagacagaccgtgggacacctggcttctcctgcctcccccactccaattgtacacctctctgtggacgtcaccccacagcccaggccccccgtgccggctctcggcacacacgggtgatgcctgcctggtgttcacctcacttcggtttttgcaggcagcaagaatcccaagattgccttgaaactggctgagttccagactgacagccagggcaaggtaagggggcctgctgcataccagataatctactagatgatgcggggaagggccgggtaggcagctgggtggatgggcaggtcactcacctccctctcgggggcactccccaggccccagccctgccgcccggtccgcctagccacaggccttccctgtgtgtctctggacctgtgcctagaatgcggcgtggcgagctggcctccctgcctcacagagtgggtcctgagactggaggccacgccgcggtaaggaacaagcaccgggcaggggccctgcgaggacaggcgcggcaggtgctcccaggccacctcgggagtgggtgacgtgtggatccagagctgccctctctccaagtttccagaacagagaactccgtggggcagatggctgggggaccccaacttcggacgggctgtttcctccagcgtttcaggcagatcctcaggtccgttcaccggacccgtcagctactgtggggaggagagtgttctggatcccc

SEQ ID NO: 90556 - DNA, 1074 bp, Homo sapiens
cgccagccaggggctcccacctttctttctgccttatcaccttgtggtcggcctgaactcagaactgcagtcagcactgaatctacagttccttctaggcgtccaaatacttcccccatctccaactactcccccgcccccgctcgccaccaaagcaccagctcagacacagacatcacagagctttggagctgggcacggtggcttgcacccctctcatcccagctatttgctagaccgaggtggcaggatcgctggagcccaggagtttgagaccagcctgggcaatatagcaagaccccatctcttaaaaaaaatgaaaaatttaaaaaggagatcacagatctgccacccagccttgacagagaccatgctaggaggtctggagctgtttgctggtggtgtcacaggccgcagaggcacccagctgattggccgaaggaaggagtaggtagacttgagtaagtggcctggaatccatctctgcagctgtgtaaactcttgactcccctgagccacagcatagggtggtgctaggtggagaaagcccatcacaggctagccctcgctccctcactcttgcgccagcctctctgcaatccgggctgtgcccccgggtagaagagaggtcagcggagggccaggctccagcaccaagcctcggcctgtctggaagctcaagctaaagagtctagccacatccagaagattcctggaagtttctcgcgatgtttcatttcatttctcatctccgggatcgaatttttgcttcttgggctatcagtggtgatcagaggcaagataatttttattgttctttgcaatgaaaacaagccacgcgggtctataagtgcttccgggcaggctctcagcttatgggtggcccctttgggagctccgaaggtcacattttttctttgctgccgtgagccaggcttgaattggggcagcacagcttagaggggtgcttaggccgctcagaggagctccccgggctcagttttctgggcttgctgccagcagtgcttggggcagtgggggttcttgagtgctcaggcggtcctggtcccagcc

SEQ ID NO: 90557 - DNA, 1038 bp, Homo sapiens
gtagagacggggtttcaccatgttggttaggctggtctcgaactcctgaactcaggtgatccacccacctcaacctcccaaagtgctgggattacaggtgtgagccaccatgcccagcctacaagcactttttaagcctttgctggttccatctgctcatgtcccattggccaaagccagccacgtgtccaggctcccttgcaagcgcaggagaaattgacacaatgggaagagctacaggggatgtgcagcccttctttgcaccaaccacacagagcctgagtatgtcaatgattaaaccaaaggccccagagctcaccgtagccaggaaacccttcctccctccctccctttctcttttctagactgtcatgtaagtcagatgctggaaggattccttgggttccttctggaatcccgtctctcccaggggagcctccttccctcacttctctctcccctgccccagatggaaactgtcaagcaaggcgttgatcagaagctggtggaaggccaggagaagctgcaccagatgtggctcagctggaaccagaagcagctccagggccccgagaaggagccgcccaagccagaggtacccatgaggggactggggggtggcctagggtacttggagtcccgatgccactctctacacctctgcttcatgggcctacctgcttcgaatgatttccctagcctcacctgcttttggaagctaatgacacctccttcaggaagcctgccttgatttctcctcttgggcatgcataggtatggcttctgttttttgttttgagatggagtgttgctctgtcacccaggctggagtacaatggcatgatcttggctcactgcaacctccacctcctgggttcgagtgattctcctgcctcagcctccctagtagctgggattacaggcgctcaccaccacgcctggctaatttttttgtatttttagtagagacagggtttcaccatgttggccaggctggtcttgaactcctgacctcaagtgatccgccctgcccagcct

SEQ ID NO: 90558 - DNA, 1048 bp, Homo sapiens
tcactgcactccagcctgggcaagagagcaagaccctgtctccaaaaaaaaaaaagaaagaaagaaatgaggtacagggaggtagagtgactttcctgaagccacacagctgagaagtagctagctaggaacggagcctaggtagtctggctgcagagtatgaggtcatgcccacaactccagactcagggtcacctgggggatggcgctccctgcctcagtctccctggaagttggggtgcaggggaggggtgcccacatacagagggaagacggagatgctggggtcacccgggggatggcgctccccgcctcggtctccctggaagttggggtgcaggggaggggtgcccagatatggagggaaggcagagatgctgatgctgttgcatctcctaggtcctggcggacaccaaggagcttgtgtcgtctaaggtgtcgggggcccaagagatggtgtctagcgccaaggacacggtggccacccaattgtcggaggcggtggacgcgacccgcggtgctgtgcagagcggcgtggacaagacaaagtccgtagtgaccggcggcgtccaatcggtcatgggctcccgcttgggccagatggtgttgagtggggtcgacacggtgctggggaagtcggaggagtgggcggacaaccacctgccccttacggatgccgaactgggtaagtgtggccagcgggctgctctgggacccctccccaggccccctgaccggaagccgctgtcggcctcctggggtctgtgccgacactcactgccgcctcgtccctgccacttctcccgggcatcttggaatctcatcactaacgcagtcccctctgtcctgctcaccagctcccgccctcatccaccacagtctcctccccacagcagccaccagagggcgcctgtgaccacctgagtcagaacccgtccctctgcccacagccctccatggaccccacctcccctggggtcaaagcccaagtcctcgtcacagcccacaaggtcctgcacaacctcccctgtcctctccccgccctcct

SEQ ID NO: 90559 - DNA, 1540 bp, Homo sapiens
aggggtcccggggtccgcggatctcgggtggggtttttccctctcagtggcacttggttgagttcccccgggacttctgaagttccggcccgcgctggacttctgggattccctcttccgtaaataggaatccgaggaatgaatgaatcaatgaatgaatgaataaacgaaccaactcggccacttggcccgggcctcctttctcctctggtcgtggggaaggagggatgggttggaccttctgcttttctttcaattccctcttttcattctccttcctcctcaatcttcaacacttggctagtcgttaatgccttaagtgcttaatttgttgtgtctggtcctggccagggtctggctgtacaggaggactggaagggcatcctgggagtttcctggtgtccacaggccggacaaaagcaaccccgactccttagagcatggcatggctcagaggtgctggtaaaactgatgggggtttttgctgtccctcccctcagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacaggtacacccgccgccagcacctttgttctatgcctggtccaggcctcgcgcctctgcagccaccagccgatactttctccctcccacctccccccccaacaacctcgtccggtcccacttcatctctcccggaaggagaagtccacagaaacctcaaatgcctgcgagaggaaggaacaaagggaggactcacagattgacacgctgggctggcggctggccctcgaatctatagggtctgggcttttaaacttcttttttcaaagctccgcctcaaaataatggctagagaaagaagttttggaggtggccgatggaaggctgaggaattttcgagaaagggcccaggaccatctggtagctaggacggaggggaccaggttttcttttttaaacatccaccaccaattgctctcagcctgtaccggttaagcatcagaccctgcgagtgtttgtttctaaaaatttggattagcttattcagagtctggagatggcgcttgctaatcaggaatttccgccaccctgagcctgctgtgctgcggctgctgctgacctggggcgtgtggtccccgaggggtccaccgaccctcgtctctttctctgttctgtctccagcccctcgttgcatttaaaatgtccccctttgatttcatagctgccacgtttggggcgctccctccattggcacctgggggtggaggtgctactttggttggtgtttttgtgggggactgtgggacctactgggagtggggtttcccggcaggatgagacagtgtgatcgaaggtgtaggtcccatctgctggagttggttggaccgtggggacgggcgtagactactggaactggattaaaagtcgtcagttgagctgcg

SEQ ID NO: 90560 - DNA, 1054 bp, Homo sapiens
aagacccccatgtgtgcgtggtgccccgtgatgatgttttgtgcttctgggtgcttcctgcatgcagtgccaaaagccctcgctagaggggcctgagaccctgagggaagggactggggtgccgcttgtgagcgggacagccccctggcatggcccaggtatcatggctctttactctgatgcagattgccccccccccacaagggctgggacacagtgtttggttcatcactggtgcccacagatgcccacttggcatttggtggctaaacagcgtctgcctctggtgtccctgcagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtgagcctcccctccgcagctgctctggggttggacgttctccctgccattctggtctttgcatacccagggctcacaggaggggcttcccacgcgcctctctagctctggctgggcagaaatggccaaggggtggtttcctgcacgttccttgaggggaacatggtaccctgggattcctttgtggacctctagagcagagtcctgttcggggcctgcaggtgtcttctccgtgaagcttgcagtggctgtgacgtttctgaacttgctgctaccatgtaagatcaggaaatgtcacagaaagatctgggtttccagcttttttatttttttattttttttttggcagggtctcactttgttgcccagcctggggtgcagccgtgtgatcacagctcactgtagcctcgaactcctgggctcaagtgatcctcccacctcagcctcctgagtagctgatgttataggcatgtgccaccacgcccagctaattttatttta

SEQ ID NO: 90561 - DNA, 1043 bp, Homo sapiens
aaaattagctgggcgtggtggcacatgcctataacatcagctactcaggaggctgaggtgggaggatcacttgagcccaggagttcgaggctacagtgagctgtgatcacacggctgcaccccaggctgggcaacaaagtgagaccctgccaaaaaaaaaataaaaaaataaaaaagctggaaacccagatctttctgtgacatttcctgatcttacatggtagcagcaagttcagaaacgtcacagccactgcaagcttcacggagaagacacctgcaggccccgaacaggactctgctctagaggtccacaaaggaatcccagggtaccatgttcccctcaaggaacgtgcaggaaaccaccccttggccatttctgcccagccagagctagagaggcgcgtgggaagcccctcctgtgagccctgggtatgcaaagaccagaatggcagggagaacgtccaaccccagagcagctgcggaggggaggctcaccttgtacagccccaattccgtctcatcccacatgtcctcatcggctggcctgctgtcagtctcggcggccgcctcaccgtgggtggaggacttgtctgactcactctggcccaggcagcagccggagtcggtgtcggagagctcggagtcccgctccttggtgctgtgggggagcacgaggctctggcggaccaggagctggatggtgtcattcaggcggacctcgtagtcgaagagggtatggccgtcctccatctgcagggacaccagaggcagacgctgtttagccaccaaatgccaagtgggcatctgtgggcaccagtgatgaaccaaacactgtgtcccagcccttgtggggggggggcaatctgcatcagagtaaagagccatgatacctgggccatgccagggggctgtcccgctcacaagcggcaccccagtcccttccctcagggtctcaggcccctctagcgagggcttttggcactgcatgcaggaagcacccagaagcacaaaacatcatcacggggcaccacgcacacatgggg

SEQ ID NO: 90562 - DNA, 1020 bp, Homo sapiens
cttcccgccgcagcctcccaaagtgctggaattataggtgtgagccactgcacccagtctgttttattttttagtagacacagcgtcttaccatgttgcccaggctagtcttgaattccggggctcaagcgatccacctgcctcggcctcccaaagtgctggtattccaggcgtgagccacgacgccctgcctggatttccagcttctcttgacaaatgggcagctctggtctctcagggcctcccagcagctgtggctgaagcagagccgcaggggcctttgttaagacagtccatgccccctggccccgcatccccgtcacccctgccggggctggtttctcatggtcagcggttcccagccagggaggagaaacctcgctgtgggcattcgagtttgcgccctggttccagagcatcccagtgtccgagaaccaaggtggtctcccgtcagttttcctcaccccgttgggatgccagacttccctcattcctcacaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgagtgagtcatggcaggtgggcgggcctgggtattcaggctctgtgacgcgcatccttggctgcgggtgttcaggccagagcttggcactgtctcgagatggtgatcaggatctggggccccatcctcgaattcctaacagcatacgaggctgcccacttggggactagcctggggacccgaagccggctgccccctcctgtgtctccgcggagggttctgctcgatcagtggctgaaactgccaccccatcagtttttctgttttattccatcttccgggtttgtcatctctccctcatccccacccctaacgtcagtctccagtctttgcacaagtgtttactgggcacttcctacctg

SEQ ID NO: 90563 - DNA, 1039 bp, Homo sapiens
gcagtgaaccgagatcgaaccactgcactccagcctgggcaacagagcgataaaaaaaacaccatgagaaaaaggaagtttgacaactctgcctgtcagggcctgggggtcagagacagttccctgggcagaggcactcaggggcacaaggtggtcggtcttagaaagatgctcagcagtgagcaggaacagaccccagaggggaggcaggaaggccaggccggaggctaagggcctcgcacacacagcgctggctggacggcttcaaagccagtccgggggccccgggaggggaggaaaggagagaggaagggctcgccccaggacgcgaggctcaccccagcaccacgttggcgtagagttcccgcgccgtcctggtctcgcgcttcctggagatctccgcgtcgtaccagaagccccgctccttggggttgtcggggttgtagttgagcatgaccacctggcccacctccaggtcctgccacttgatgatggtgcgggcgcgcgctcggacgtccctggagttcatctggaccacgccgttctccgggtagctgggaggaaagcccgggccttagaccccgtgctaagaccaagcctccttccctcaatgggaaacgagccgaggtgggacggcccctcccgacagtgtgcagaggcccctcccaacaggcttatatgctggtgttgagaacacacaggtatattaaggcacattccaggtacaaaattgttatgggttgcccgtgtcccctgcaaaaagagatgttcaaaggctgatccccagtacccacgaataggattgtttttggaaacagggtctttgtagatagaacctttgcagatgaaatcatattaagatgagatcacactgcagtagggtgggccccaatccaacaggactggtgtctttagaacaagaggagaggccgggcaaggtggcccacgcctgtaatcccagcactttgggaggccgaagcgggaagatcacctgaggtcaggagttcaagaccagcctgaccaacacggtgaaaccctg

SEQ ID NO: 90564 - DNA, 1106 bp, Homo sapiens
acaggcgtgggccaccttgcccggcctctcctcttgttctaaagacaccagtcctgttggattggggcccaccctactgcagtgtgatctcatcttaatatgatttcatctgcaaaggttctatctacaaagaccctgtttccaaaaacaatcctattcgtgggtactggggatcagcctttgaacatctctttttgcaggggacacgggcaacccataacaattttgtacctggaatgtgccttaatatacctgtgtgttctcaacaccagcatataagcctgttgggaggggcctctgcacactgtcgggaggggccgtcccacctcggctcgtttcccattgagggaaggaggcttggtcttagcacggggtctaaggcccgggctttcctcccagctacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctggggtgagcctcgcgtcctggggcgagcccttcctctctcctttcctcccctcccggggcccccggactggctttgaagccgtccagccagcgctgtgtgtgcgaggcccttagcctccggcctggccttcctgcctcccctctggggtctgttcctgctcactgctgagcatctttctaagaccgaccaccttgtgcccctgagtgcctctgcccagggaactgtctctgacccccaggccctgacaggcagagttgtcaaacttcctttttctcatggtgttttttttatcgctctgttgcccaggctggagtgcagtggttcgatctcggttcactgcaagctctgcctcctgggttcatgccattctcctgcctcagcctcccgagtagctgggactacaggcgtctaccaccacacctggctaatttttttgtatttttagtagagacggggtttcaccgttaaccaggatggtctcgatctcctgacc

SEQ ID NO: 90565 - DNA, 1124 bp, Homo sapiens
tgtattttcagtggaggcgggggttcaccatgttggccaggctggtctcgaactcctgacctcggcctcccagtgttggtattacaggcgtgagccactgcgccctgttccgtttcatgttgcttctgtgagtgcagctttgattgctagggggcgtagctgagctgttgccccaggcatcccgagaacccgtggtgttcaagtgctgtgagtagatttaggggcctcggcaggccagaatgttccagcgtcctcgttccttgcagggatgattctctgaacgactgtcggatcatcttcgtggacgaagtcttcaagattgagcggccgggtgaagggagccccatggttgacaaccccatgagacgtgagttctgagccagcctttccccatcttccgcggtgggcacggggcgggggctcttgtcccgtctctggcttggccgggccccgccggagctgaccctgccgccccgtgcccagggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtgagtgcggccctgcccgccgcggggagaccagagcgccccctacaaatccccagaggggcactgaggagatacaggagaggggcaggcgcgggggctcacgcctgcaatcccagtgctttgggaggccgaggcgggaggatcacttgagctcaggagttcaagagcagcctgggcaacacaagaccagcctgggggacgtagagactctgtttctttttttgtttgtttttttgagacggagtcttttttcttttctttttcttttcttttttttttgcggcggagtctcgctgtctcccaggctggagtgcagtggcgcgatctcagctcactgcaagctccgcctctcgggttcacgccattctcctgcctcagcctcccgagtagctgggactacaggcgcccgcctccacgcctggctaattttttgtatttttagtagagatggggt

SEQ ID NO: 90566 - DNA, 1017 bp, Homo sapiens
gtctcaaataaatagtaggctgggtgtggcctattttataaattatacatatataactttgaaatattaaatttttttttttttttgagacagaacctcactctgtcacccaggctggagtgcagtggcataatctcggctcactgcaacctctgcctcccagactcaagcgattctcctgcctcagcctcctgagtagctggaattacaggcacgcgccaccacgcccggctaacttttgcatttttagcagagacggggtttcaccatgttggccaggctggtctcgaactcctgacttcaggcgatctgcctacttcagcctcccaaagtgctgggattacaggcctgagccaccactcccggctcctgtgtttccttttttggggggtacatcctcacctataatgcgtggggtcctgactctccctgcagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggtgagtgccccttgaggaggccgggggctctgtccccgccggggctgcctctgatggagctgacgctgatgcccgctctctgcaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcaggtgtgtctgggatgggggatggcactttgggaggccaaggcggatggatcacttacgttaggagttcaagaccagcctggccaacatggtgaaacctcatctctactaaaaatacaaaaattagctgggtatggtggcgggtgcctgtaatcccagctactgaggtggctgaggcaggagaattgcttgaacccag

SEQ ID NO: 90567 - DNA, 1235 bp, Homo sapiens
cttgagctgagctgtgagtgatgagagccgggggaccgagctgttaagctgcatgacctgccagggacaaaagcctggaggccgggtgagcttggaatctttgagggcccctaggggggccaggctggtgatgggcagcaggtggaaagtgagactgaaggtcagaggggcctctggacctggtgagactgtccccacagtcctgggagaggtggccaggagcaaacctgatggtgtggatggcacttctcacgcgcctgctgtgtcttacaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgt

SEQ ID NO: 90568 - DNA, 1054 bp, Homo sapiens
ccaggggcgggagcgggggccccttcccgggccgggggcgcgcgggggctgggcacagacggccccggcgccccgcacaaaagatgacagcgtgggtggccccggccgggcccttttatcacccgggacaagcctcggcctattattattattatttttgaaagaaagcaagaaaaaggaaaaagaccccagcccctgggtaacccccgcctgcgtttctggccctttgggcgccaggggggctaaggggaagccccccagctggacacccagggatgccccctaaatgcctatcattgctcctgcactgcccccacctccggtcaacctgctatgccttggtagcttccaaacttgcccccctgtacgtacccgaaacccccaccccgccataagcatatgcaatctggattttagaaaaaaatcatcttgctatgcaacggcagcctccacgagtctctccgtccctcccccttccagcctgatcgccatctcgaacgaagcccctgctctagagaaatgaattgaggagttgcttccgccgagaccccttttctgtgtcccccgtggacatccccctgggagctggggacggactcgctctgaaatctgcttgacctggggtctgccagggcccaggtctgcgctcagtggtggccatgacaatcaggcaggacgggggactctgtccacctgggcacggtggaaggttttaaggggcatgttttccgcccctgggggcagtggaggcatggactgcttttgggtgcatcccatctgtttgcttgggggaggatgcttctgttttaataatttaccagcaccctgtgaggaagtgttccccgagttgtgaaactagtgagaaggtggttcagctccgtggagcctagtgatcctgtcatatgtgaagagcgtctttttccatgtgtttctggctggggcgtgtattcagcaagttcctttgggtcccaccgggtgcctgcactgtcttgggatctctggatactggactgaattcaagggatcggtgccctgccccagtcctctgcctcaa

SEQ ID NO: 90569 - DNA, 1723 bp, Homo sapiens
ctatgggcttttatcactgccgttatgggagctaatgactcccctaattctccaataatagcttccttatgagccaccaggagggtttgtcaacacacggggtcagccttctcctgcagcccctgctgaagcagtgggcatcctctctccgctttgcagtttatgttttgaaaccctgaaggtcggagcgtaaagccgtggtagagtcaacttctgtctgagccgaggatttctgggacttgccagcctcgtctccgtgtgtctgattggacacctggcaggtccgggcgctccccctccttgagccggcgacaccaggacgggtcagactgtcctggcctagaggaggtcaccgctggggaggaaaagggggtaacggagattctgccgcacagacgggtgtctgtgtacaggctgttttggtggaagcgtctactgtgtcaggagctgcgggtgcctgcgtgtgcacgtgtgtgtttagttgctgagacctgaaatatatatgtcttagtaacaatccgtttgctcgcattttctaaccctttcctctttggggagggggctgctaacaagatgttaactgctggcgcttaaaggtatagctgatcagccaccgcacagcaccccgcctggcctttgttgtacttttctgtctcgtggaagagacccttcctcagcctcctgccctgtcttcagtccctgtcccgtcctgcaggagccctctggggtggccaggggccgtcctctgtgtccttctctcccacctgaccactctgcctgtactttaattcctaatttctctgtctcctctgctggtttcctgcccgtttgtcctatgccccacccactccctgatgagccggggaggagcctcagctctggggaagccatctgtcctcggttccatctgacacctgtggggacgtgccttggggtcatgcgttcacctggtctggggctgctaggtttccagtgccgagtgccatgccgggacaggttgggaggagtccctggctcctgtgggtttagagtgtagtgggggaaagggtgagctggctgcccagggcctggtcacagctggaatggtggtgtgcagtccgctgccctcgggcccagctcagggagcaggcaggaggaggcgaggctgttgagggcctgaggtgcatttgtaggtggctttgttccctggatcggggagcggaattgggggttcagagctgggtgaccttgacccagtcacttgctcagtgacaaagcagatcgggggcactaaatctttcggagcccactgggcaggaggggacggagagcagatgaacagggtgggggctcggggcggggggagctccgcaggcctgcactggtcaccgccatgacagatcggccgtcctcatccacagcctcaccctaggctcctggctcagctccagggacctgccatgaggcagctcgatggggtcttcagatgccacagccctcccccttcctgccccaggggtctctgttcctggcttaggatgccggacagaagagcaggggcccagcctgggctccgttctcatctggtggtcttgacgacgtctctggatctctgccctctgtcccatgccccacacaggcttcagagttggagagacctggattcagatccctcctctgaggcagtcacttcccctctctgggccttgctttcttctctgtaaaatgggtgtaatgggaacac

SEQ ID NO: 90570 - DNA, 1042 bp, Homo sapiens
cctgttgctctctgaggttcacgtgccttgtggctctggcaccagagcagagcctggtctgtcctgctcacccggccttcccagccccctagtctgtcgtctgagctcagtctttgccacacagggatgacaagagcctcccagggcctctgtcccctgcccactccccctggcgtgtgttctgatgtgggtgccccgggccaggataactgaggaggggtacgtgggtttgggccactgctcgcccgtggaagtgcgctgtcccacccggaagcaggttgcgtggtaccctaggcggggcagcgggcagtcggagcagagcccctcccgcctctttcatgggtgccctgggttccaggtggctgagggtgggctgcgtagcacccaggcctcaccctgagctggttttggggtgtttgttcaccaggtactgtaccccgcggcaccaggactttgatgaccttgaacgcaaatactggaagaacctcacctttgtctccccgatctacggggctgacatcagcggctctttgtatgatgacgtaagtatgaggctccggggaagaacagggaccagcttcctggtgggtggtggtgggagggccctgaacgggactctgccttggcagatgaagcttccaggcaggcaaggttaaccccctcgcccaggctctggatgcgggcctcgccctgtggtgacgaaagaggaagccaggctttctctgatttttgcagggcccctcctgcctcaccctgcagcccccaccctgagctcaccctggccccacctctggcctcagcagccggcccacagcgtgttacaaacacgtgtactttcccagtccctgccgctcgtcttcctggcactgtggagcctcgagtcctcagcccgccaggccacctgctggattcggctccaacccggtcctgacttgggctcagggcccggagacactggggtgaggggatctcccatcccgagcctggtctgctggagcgtcctcttgtccacacagcctgggctctccatgagggcagctgg

SEQ ID NO: 90571 - DNA, 1024 bp, Homo sapiens
ccaagctggcggtgagcccttcagaaaaggtgtctgggctgggtatggcggctcatgcctgcagccccagcgcttggaggggccaaagtgggagggaccattgagcccaggagttcgagaccagcctgggcaacagagtgagacttcatctctacacagaaaaaagtaaaaattagccaggtgtggtttctcacgcctatagcctatagtcccaggtactcaggagactgaggctggaggattacctgagcctgggaggttgaggctgcagtgagctatgattctgccactgcactccagcctgggcaagaatctcacacaggttaagaccagcccctggtctgcagggtatgaccggcccctgggggggccgcagatactggggtggaggaggatgggcagcgacccctgggactctggggagaattagcctgcaccccagggctcgcaggttctgggggtggccgggcggttgccgacgctgctctgccgccccacaggacgtggcccagtggaacatcgggagcctccggaccatcctggacatggtggagcgcgagtgcggcaccatcatcgagggcgtgaacacgccctacctgtacttcggcatgtggaagaccaccttcgcctggcacaccgaggacatggacctgtacagcatcaactacctgcactttggggagcctaagtcctggtgagtgtctgcactggccctgccgccggccggaccgagagcccctcgggagggagtcaatcccgggtacacggctgggcgccgtggcaggggccccaccaggtgaggccgcaaaggtcggcctatgacggctggagatcttccggaccgcctggggtcacccaccagctttggggtgggggatgtgcacccccagagccgaagctcccaggcccctagagcttgcgctttgtaccccggagtgccccccattgagctgtgagcggccccaggtgtccccatggccaggagcgtggtcttgagcctcctgagctgcccaggctgtgctgc

SEQ ID NO: 90572 - DNA, 1048 bp, Homo sapiens
agagctcacagcagggcactatggggcggctcctgcgcatctccttccccccgacctgcaggcactggggccctgagaaccaagggcagatctgggccgtgctctgtgctcccacacgcccgctctccatgggaggaaagagccagcctgcccagagggcagcatcctcgctgaccccggccggctgtggcccaggagactgacgtctgtcttttcggccctaggcttcttccccgggagctcgcagggctgcgacgccttcctgcggcataagatgaccctcatctcgcccatcatcctgaagaagtacgggatccccttcagccgggtgcgtacgggtggggcctgcacgcctgtgggtgaagtgggtaccgggtccaagcccaggtggccgcacataccccaggagataagctgtttaaccctggagaagtttctagaacagtgattagcatgccagaggagggccgcatggctcagcagttagcctccagctcttccacggggaagcgaagatggcagagcttgaatctggcggggtgttaacctcccctcccaaaccaaaccaaaacttcctcctgggtgtggccatcagaggcccctccgcaggggctgcaggggtggaagggcaggggcaggccctgctgacctggcaggaagctgccaaagaaacagagggcagggcccctcgtcccgtgcaaggtgggaacctggttcctaccgccccaggccacaccctaagtctcaggcacccccacggcccatgtcacccggccgtggagagaactgcctgtttagaagtgacatttcgggctctcctgcaccgtgaagactgtgaactcattcagttcactgcttcaggggctgctggtggaggctgtgatggaggagacctgaggccggggggtggggcctccctacacctgatttgatggacagctggggtttggtgtcccaggagcagagcaggctgtgctcagggtccagctcagcaactgcacccactcgaggcagttccttccccatggagaagcctttgtccatggga

SEQ ID NO: 90573 - DNA, 1003 bp, Homo sapiens
cacgagcccacttcctgtgtctgggggtggcctgccctgggggttgcagaacacggggtcacatggtctgcactcacctctgtgtccccagggcacatctctgtcgccacgtggttcctctggctgagcgacaccacgtggggctcttcagtgtctgtcccagcagtcagtgacacgcagggggacgggagaggactccccgggggctgatctgtcccagcagccagtgacatgcaggggggatgggagaggactccccagaggctgagcagcaggaggctgggtcagtgggtctggagggcttggccagggaggctgcgggctctgggctgtggaggggaaccctcactgggcagagcgcagggccactcccgcgatgcctcccttgaaggctgtgccgggaggggccggggactccgttccagggtccctagggaagctcgagccccatgcccctgcctgtgtccccatccccagaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtgagtgcctgcccgcctccttgcccccagcccctggctcccgcccccaccgacacccgcgctgaccgccccccacaccctccgcaccctcccaggtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacggtgagctgtggggtggggcagggggcggggggaggctgggagcacagcgacaacctgtaccctgagagcatcacggtgag

SEQ ID NO: 90574 - DNA, 1749 bp, Homo sapiens
ccatggttccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattcctcctttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcagcctggggacactgggctgggaccagaatccagctttcttttaaaactctcagtgtaactgtatcccgtgacatttcattttttttaaatagtgtatttttttttccatttttttttttaagagaaacaaacaaaagactcgccagtcaatgactttcaaagagaactaactttggcttattcatattctgttcaaagacagtctattttttcactgtagaaagcgtccttgtgtgatagttacgttcgcaaacgcgcacgccaggcccatggctgtaccttggcttttttttttttttttttttttttaatttttcctaccatcagaaagtgtgctttgctcacagaagaatgggatgtccttttttctttcttggctttttttttccccctttttgtttcatttttataaattaaattttcagacatatcaaatacagttctgagggtaaggtcatgggggagctcggacccagtggcgttgggtgcggttgagggggacgctgctgtaagaggagagagatgacagtggtcctcctctgagagcctgagctgtctccccgtctcccgcccccaaggagacagagaggatcctacttcttcggggacagtggctgtatggctgtgctgccccacatcagggaccctttccccctgggactgtggggcagtttgggagcaaaaccagaaggacaggcccccctctacccgcctaccctgagcaagcgagttgttcctctttgtacaagggcaggtctgcggttactttcaacactgtttattccagcggaagcagccgggtggttttcccacccccgtgtatgtagatatatcgactttgtattaaaggaagatcgtctgaccccggcccattgtggagtctttgttgcgcccctgcctgtccagtttcatccctggggtggaggtcggtggggtcctggagagctgatctcgtttccttgtgtgaacagtcagaggaggagttggcccagagaggtggtggtgcttgtccaagaccacacaccgctgaggcgggtggatcacaaggtcaggagtttgagaccagcctggccaacatggtgaaacccagcctggccaacatggtgaaactcaactctactaaaaatacaaaaattagccaggcgcagtggcgggcgcctgtaatcccagttactcaggaggctgaggcaggagaatcgcttgaacccaggagttagaggttgcagtgagctgagatcatgccattgcactccaacctgggtgacagagtaagactgtctcaaaaaaaaaaaaaaaaaaaaaactcaaaacaccgatgaagtggccaggccaagatttgaacccaag

SEQ ID NO: 90575 - DNA, 1568 bp, Homo sapiens
tttgtatttttagttgagacgaggtttctccatgttggtcaggctggtctcgaactcctgacctcaggtgatccgcccacctcggcctcccaaagtgctgggataacaggcatgagccaccacacccggccacttgggcatcttcagcacatgggtggcaggttgagccggagtgacaggtgacatccttgtggtccccagaatggctccagtgagaaacgcgaggtccgccagttccagtttacggcgtggccggaccatggcgtgcccgaatacccaacgcccttcctggctttcctgcggagagtcaagacctgcaacccgccagatgccggccccatcgtggttcactgcaggtacgtccaccccactctgccccatccgcttccccccggtccccgcagcccagcagcccctgaacgccacgtggctgtccctgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaaggtgccagcggggtggaggctgctgtgggcggggtggggaggaggcccaaagagccgaaaatcaggcccgcctcgagcaatggggactagaaggtggtggcagggtgcccctacctacctatccaccattggtgctccagctgaaagcatagccttcctcatcctgatggtggcctctggcttcctcctccccacagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggtaggtgccatgcctttcccacctcagggccccagaaggagcccatctctactctcaagaggcctccagtcttgtgggagacagagctggggagatactggtagccctgagctgtttaaatacacatctttagatgtatatttaactgatggctgctgtccgtgaatctttgggtgtgtgtttaactgatggctgctgtccataatgtgattccatctgttctatcagtggttctcaattggggtaattctgacaccctgaggatatttcttattttcatgagtactactggtactgcctgggtggggaccaggcatgctgctcagcatcctacagtacacagaacagcttgtctcagagaacaatccagcgccaaatgtcaatagcactgagattgagaaatcctggcaaaggaggggagggtgttcctggcagagggtgccacatgtgcaaaggcccggggct

SEQ ID NO: 90576 - DNA, 1006 bp, Homo sapiens
gttttgctgcccaggggacatctggcaatgtccagggacatctttggttgtcacaacttgaagggaagaaatgttgctggcgtggagtgggcggaggccagggatgctgctcagcaccctgcagtgcccagaatggccccgccacagagggcgatctggccccaaatggtgatggcgctgagggggagaaactgtgaagtacacgtcccatggtcaccttggggacaatctgggagcggtcagagtgaacttccaggaagtggttggccacacagagccaaactagcaagacagcccccacagatccctggcctctcgccctggctgcaggcatcatgggcagtgattacatcaatgccaactacgtggacggctaccggtgtcagaacgcgtacattgccacgcaggggccgctgcctgagacctttggggacttctggcgtatggtgtgggagcagcggtcggcgaccatcgtcatgatgacgcggctggaggagaagtcacgggtgagccttggaccccacggccctcaagcccctgccagtcagcctgtccctgctgacacctgttctcttgcccgatacagatcaagtgtgatcagtattggcccaacagaggcacggagacctacggcttcatccaggtcacgttgctagataccatcgagctggccacattctgcgtcaggacattctctctgcacaaggtggggcccaggctggggctgggggctgagggtggaggaatgtgttggaagggaggcagagggccccagcttctacccagggagctccccatgggacagagagaaagcggagcgtgtctacccaggctgactacattctcatggaacccacttccgtggagggggaaactgaggctcagagaggacactgcttgtttccacccacggcaggagaacaaagccggcagagcccaactcagcaatgagcctgatttcttcttgcctttactcatgccccaggtcctctttgcccacttgtcc

SEQ ID NO: 90577 - DNA, 2394 bp, Homo sapiens
tgatggtgccactgcgcaagtctcgtggaggccaattcctgaccccgctgggtagcccagaggacatggatctggaagaggtgagggcctggggcccaacccgcagggcccagatgcattccagttttcacgtgctctgttgctcccagctgagctctgagccacccatgactctgttcccgcagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctgtaagtcctgaatggtgtccgcccacatccagacacacctctgaatgaggcagaccccattccccagggccctgacctctgtggtcagtcacaggcagctccctgtggtcagagctgggcagaggggaagacttgggagcggagggatcctgaaacgaaggtttcttagaggaagagaccttggagctggggcgttgaggggtgagtaggagttcaacaaagaaaaagcatcccaggatttgcatgtgcaaaggtctggaggtacagaaaggagagtggctggagcagagaagggaatggggagagcaaagattggcagggaccaggtcacataggccaccagggtcaaggttctaggaatataggaggatctagagcgggggagaaacgtaggttcatgtttgagaaagacccatctggccactacaaggagggtggacactgatggagacccccctcctttccctgcagacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaagtaagccccatgtcctccccgacttgacttgacagcagggagggcttcctggaaaaggagggaggagttgtctcagagaatcatcactaaaggtctctgttgtacacatggggaaaccgaagttcagagaggttaagccacttgatcaaggtcacacagcatgggaatggcagagctagggctcaaagcaggccagtggcttggcttctcctcttaacccctatcttcaactcagcaagatttggggtagaggctgcctgtgtccagttcaatgaggatagcaattgtagtggccccatggggcacatcccagggctgagataagcctccttgtggtgtcgataggcagggggacaaacaggaaatatgagcaccattttccagaggagaccaaagctcacagaggttaaggaaggcactgagagtcacagaacaagcccttgatggccggcacaccctcacctttcttctttttttcccccttctcacctgtgtctgctttcgggaacagcaaacccgacaggtaagaaccagccctcccccgtggaggcttcaggcaagaggaagaggacagggaatgggctgatagtgtgcccacaggagaggggatgcccggctgcccccacagcttgtacacgtagctgtacttggtcctggaaaccctagtcatacgggtccatggtccttttcttaccatgcattcctggggcctgaattgtgttcacacatgaacatgtgccactactaactggactgttccgcttgcttctcctaaagtaaacgcaaggactcagaaccccgcaccaaatgcctcctgaacaatgccgacctcgcccctcaccaccccaaggaccctgtggaaatgagacgcattaacttccagactccaggtatgtacttatccctggtaccagggatgccaccaacaggggagatagctggggagaagcagtagctgccaccctgggggcccctcattggccccctctgaactatgcttggtgcagccacattctggattcccaaatacctccaaccctacatggatctgggcttggaactcataggttggttctgcttacaaccaagtgaggcttttttttttttaaagttaacatttaaccaatggctgctgtcctcttcaggagcctaaagacgatgtttaaaaaatggagaaaacacaaataaacccctcatttctttgggcagaaagagctattcttctgtttatgtctctggttttaatgttcctcggtggtgggagttgaggtttgccctcagccattttccacactcccttgggatatatccctagcaaggtacagaaattatacctgcccaatgccctgtacctcttcccacca

SEQ ID NO: 90578 - DNA, 2137 bp, Homo sapiens
accaaggtaggcgcgcggcgacccctgcaccagagccggaccgggccttgcgcccacccccaccccagccccctccctctcccctgcccaggtaagtgctcacttttctgcttcctcgtggtcactcaaggcaagtccggaccccgaggctccggcgttggcaaaggtgggacgtgcctcggtggcaccaccgccccccaccactgccccctccccttgctcccctcccccctcttcctcctcctccaccttctttctgcagcctctgcacccgtgccgtctcccgaagcagggacttgggacaggacagggcagggccgggccagggccaggcaggaaggccgtgggcatgggcacagcggacgacagggagcgcctgggccgccccaccccaccccgcttcacgccacccagtgccaggcactcatggggcctctcttctgctctctccctgctcggccgcctccccggcagtctcgcccaagaacttcaaggtgaaaatgatcatgaagacatcagttctgctcagctgggagttccctgacaactacaactcacccacaccctacaaggtgcgactgcccagccagcaggcaggcaggcaggcagggtcaggggttgtagttcagcagggcttaaggctcagtttggagttggtgtgaagtgagggatcagggctcagtcagagatgggtctcagctaggattgaggcttagtcaatactgggaatcagacttggggcccagcctaggattggagatcagctggaactgaggttcagtcaatattggggatcaatgttgggctcagccttggattgtggcttagctgggattgaggttcagtctgggattaagatttagtccatattggaaatcagagttggggctcagccttagatcatggcttagctgggactgaggcataatcaggattgggactcagagttggtacttagcctgaggtcagagtttagtctggagttggtgccaagtctgggatcgggggtcagcctgggattgaggttcagtctgagatcaggaatcagtctaggatcaggtctcagaggtgggtttccacctagggtcagcgctcagctggaattcaggatcagtctgggttcagggttcagtgggattggggctcagtcgggactgggaattcagcatgggatcagggctcagtcaaagtgggcttctacctaggatcaggactcagctggaatttaggcacagtctggggtcagggttcagtgaggttggggctcagtcagagttggggactcagcctgggatcagggatcagtcagtgttagatttctgcctagggcaggattcagtgggatcagggctcagtcagggtgggggactcatcctggagctggggctcagtccatgggcatgagcccaccaggccctgctgagctagccctggtccgcagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagtatgctcacccccatgctccgggttccttgtcacccccatcagcctactatatggctggggcaagccacgtgccctctctgtgcctcaatttccttgcctatgaaacacagaccctatcagccctagttcatggggtcatccaagattcaatgcttctcatgggtcattgtcactaaatgtgtcctgtgtctgctcttctagcatttcctgataccccatatgcctgaccctccactgggtattactagggcccctgaaaggatttggttctgggcttcccaactagtggggaggcaaagctgagagtccccagtggggagaggagcactctgcctcagaggcagagaagatttaagggctacaaggttatgtgggcattgaagctggagctttgaaggatgtataggagtttaacaatgagcattacatgaagtaagcct

SEQ ID NO: 90579 - DNA, 1032 bp, Homo sapiens
cctccagcacaccagtgggtgtagacaggggggaaggccagtgccaaagggcctgaggcaggctgtgcctggtgcattggaggaacagcaaggagagccctttgtgagccacagggaagacttgggctttgaccccaagagaggtgggagccatggagggctgtggggagagcggggacggaccctgactccagtgctcacaggcgccctctggctgctgtggggaggacagactgtcgggggtgatggcaaggagtgaggggagcggagcagagaggaccgagttggtcctggcaagcgacaatgggctcgtccggctgggttgttgcatgtaccctctgagcatggccatgccacgtgtcgtggtctctgcatgagctcatgtgcacgtctccacccctgatccgggccctgcatcctccttgcttgttctcagcacggggagtgggggtgggtggggctgctcccagccccagccgtcgtgctgacccccagccgtgcctgcaggagatggtcatcacaaacttgcagcctgagaccgcgtactccatcacggtagccgcctacaccatgaagggcgatggcgctcgcagcaaacccaaggtggttgtgaccaagggagcaggtatgcaacccgccctcctcccacccaccaacagcccctttgcccccactggcaccagagcgtgactccagagtccttgagctcacaagggcaggcagagggtgcaccaggcagctggaacagtgagacaaaggtgtgagggctgctcaggtgggtgtccagggcccagcttggccccccccgcccctgcctcctcctttgtcactcacttcctgtccccccggctcccaccagacagaaacagttaacagccacctctgacccctttgccctctcaacctttacttgggctgttccctctgccaggataccccttcccctgctggctggctcctcttctgcctttaggtctcagctcaaggtacacctggccctggaaagccttccctgattgcctcatcccataa

SEQ ID NO: 90580 - DNA, 2688 bp, Homo sapiens
acctggcacatggtaggtagctaataattggggcttctattgctgttgcctggcacatagtgtgtgacatatagatttttttttttttttttttttttttttttttggagatggagtcttgccctgttgcccaggctggagtacagtggcacgatcttggctcactgcaacttccgcctcccaggttcaagtgattctcctgcctcagcctcccgagtagctgggattacaggctcccgccaccatgcccggctagttttttgtatcttgtagtagagacggagtttcaccatgttggctaggctggtctctctaactcctgacctcgtgatccacccacctcggcctcccaaagtgctgggattacaggagtgagccactgcgcccggccgagattcttatgctattattctatgaagcccttggcacaatgcttgacacacagtaggtacctgataagtggagcttctattgctgttccccttagcatgatgcgtggcacatactagatattcagtaaatagatgctctattattttgtgaagcccttggtgctggcacatagtaggtgcctaatggagcttctgttgccattccccttggcacagtgcctggcacatagtaggtagttaataaatggagcttctgttgctgttccctttggcatggtacctggcacgtagtaggtgcttaatggagcttctattgccattccccttggcatggtacctggcacatagtaggtgttcaataaatagatgcttttactattatttcgtgaagtgcttggcgctggcacatagtaggtgtctaatagagctctgttgctgttccccttgccacggtgcctggcacataggtgttcgacatagattattttgttaccattctatgaagccttagcacaatgcttgacacgtagtaggtgcctgataattggagcttctgttgccattccccttggcatggttcctggcacatactaggtacccaataattggagcttttgttgctgcttcccttggcgtggtgcctggcatatagtaggtgcttaataaatggagcttctgttgccgctccccttggcatggcgccaggcacatactaggtgttcaataaatggatgcttttactgttattttgtgaagcccttggcgctggcacatcgtaggtgcttaatagagctctgttgctgttccccttgccacggtgcctggcacatagtaagtgtttgacatatagattattttgctatcattctatggagtcctcagcacaatgccttaccacaattattagtaggtgcctaataattggagcttctatggctattccccttggcatggtgcctggcacacagtaggtgcctaatggggcttctgttgccattccccttggcatgatgcctggcacatagtaggtgcttaatgaatggagcttctgttgccattccccttggtatggtggcacatagtaggtgcctaataaatggagcttctgttgctgttccccttggcacggtacctggcgcataataagtgcttaataaatggagcttctattgctgttccccttggcatggtgcctggtacatagtaggtgttgagtaaatagatgctttactatttgtgaagcccttgttgctggcacataggaggtgcctaataaacagagcttctgctgccattccccttggtatggtgcctggcacataataggtgcctaataaatggagcttctgttgctgtttcccttggcacagtacctggcacataataagcctttaataaatggagcttctattgctgttccccttggcatggtgcctggcacatagtaggtgttcagtaaatagatattttactattattttgtgaagcccttggtgctggcacatagtaggtacctaataagtggagcttctgttgccgttccctttggcatggtgcctggcacatagtagatgttcaacaaatagatgcttttactattttgtgaagcccttggtgctggcacatagtaggtgcctaataaatggagctcctgttgctattccccttggcacgatgccaagcacatagtaggtgcctagtaagaagggcttcccttgctattcccccacccagtttctggcatggggaccatagctgtccaatgcctaagacctactgtgcaccacgtaggtgcagcctggtgagcacagggttcttggccagccctcccagccccatcccacctgcccgcccatccacccgcccatcccacctttggttgacacccacttcttttgggttcgacttctctttggtttggttctgttttgtttgttatcatcttcttttttattttctctttcccatcttttgtttccccgcccccctccccacccatcccacctcccttccccacccccccacgttctccccccctccaatagaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacaca

SEQ ID NO: 90581 - DNA, 2701 bp, Homo sapiens
tcctctttccatcctggagtgggggctgattgaagggccacgttgtgcccatttcccaggcattttgagggtaccgtgaggctgtggtcacggctcgcaccccatcattctcagagcaaaggacacagagacgaacccaccttccccgtcggtcttcctcccccgggcagggagccttggctctcaagaccccaggacgaggtcccagttcccgagggtggggagggggtggaatcggagccgaggccaggtttcgtgggggcatgcaggtccccactcggggctcaaatctctggagttctctgctgtgccggcccggcctccctgtttggagcgagtcacccttcacctggcagttggctgtgggtcaccgccaccctctctccctgacttctctaaactcggagctggacaggccccttctgccgtctccccacctcacctgcctccctggctccgctcagcccagcgtggccttccctggtgtggcctccaccggcgtggtctctctgtcgtggcctccccctgcttccccctcttccctcccttcacccagtcagtcacggcgtagccaccccaggctttcttccagaatcagtcatgatggtcaaaccttcaaggcccgccctgggtgtgtgtacacaggggcatctcggatcagtcgaagggttaacatcaactccagccggggcatctgagccgctgggatcgggggggtggggcgcctcggagacacaacccccctgcccccgccggcccccttccctccttcctgctccccacaaaccaagccgagctgagcacctggcggctccaaggcgtctgggcgcgtctgtgtgaggtggagtcagtgagggtggcctgtggcttgggcagccacctgagagactggctgaggtgtcctgaaggtgagtacacgctggtctcaagcaggttcacaaaaacggcccaccccgcgtgcccccccgcctgccccagccactctgggctgaacggacagtccacggcccgaattcggccccagaaactctcccaaaccacgtgccaccaccatgccacgctgcccacgcacgcacatccacgtctttgcacacatcccttcccgagatgtcatgcaggttgggccggattgtgaaggacgtgacctacacggtcacctagaaagcggcttcggcccagccacgcgaacctccggggcggcccaggacagggagttggggagaagggactccccgcttcttgccccgagacgggtggggcccaggagaaccgacagcaaagactcagggccaggcgtatccatccccccggggactgcgggctccttaggctgaacacagggtaggtgcaggtcagaccactcagccgtgggtctccccagacaccgtgccaccttcctgcctccagcctggaacctcagcgtgcgcacgctgggggctggagcagggctgcggggccactggcatcctgagacccaccaagagttcggtctggccttgtagctcagcgctcggccgttccctctctcgtaagaaagtcttttaagttagcagttgaagagtggaaggtaggtaaccagactgggcgttttctggaaggagtctttctttcttttattaagtttttctcatcatcatcaccatcactgttgtttcttattttattatggtttcggttttattttttctccccctttctcagcaaatccattccttccgacacattccttgattgttgttttttttttttttttccccctgctccctgcctgattccccgcaccccccgggcacctttggttggtgtggctggtcaagaaatggggaagggttccctttgtctagttttggaggaggggcctctaatgttttgctttaagtgaggccggagggtctctctagttgaagtaagctgttggggtggcctctgcagtctctggtagcccagtgtctctgaggacaggattcgtctctgggtttcagatgctagcaggatagtgtccatagtaagtactcagtaaacatgtgctcagccaccaagcaagctgctctgatggtgagggtttctaatgctcttgccacgagcaaggccagtaatctctctgggcctccctccaggggacgtagattctaaaatcgtgggcacttgggagagtggcttccgccatacccaaccagcacaaggctgagatctgagctgccaacctcaaaccaagccagcctgtgaatcacggccaagtctgggttccaatcctggctctgccacctcatcactgcatgcccctggacaggtagcttgctgtttctgagcctcagtttcctcacctgtaaaatgggctcacctgtaaaatgggctgcacttctggtttttcggcaagattgagaggtgttatacaaaataatgaaaagcttccagggtggggtctggccacagtcggtacacaaccagtgactgtagaaagcccagcaggcagactttggaatctggtttccccaccgttgacgcggggtggcgggtggggagtgacagttctgaccacctgaggggttgtgagaattaaatgagataatgcatgcattaaatgagatgatacatgcgttaaatgagataatacatgaaacatgggctgagggtgctgcacctgcagtaggcgtgcagaaaatgaagtttattatcactaatgccctcagcacagcgtctg

SEQ ID NO: 90582 - DNA, 1343 bp, Homo sapiens
tgcggtggctcacacctgtaatcccagcacttcgggaggccgaggcgggcggatcacgaggtcaggagatcgagaccatcctggctaacacagtgaaacccgtctcaactgaaaatacaaaaaattagctgagtgtggtggcaggcgcctgtcgtcccagctactcgggaggctgaggcaggagaattgtgtgaacccgggagacggagcttgcagtgagccgagatcgtgccactgtgggtgacagagtgagactccatctcaaagaaaaattaaaaaaagaaaatgggtactgggtggaccctgggccatagtttgttaccccttgctgtagacgatgacaggagtcatgaggcccatgattactgctgggcaaatcaaggctcagagaaggcgactgaatggtgaaaagtcacacagccttcagggtcctcaaccaatgtgcccaatgcgtgacacagctgcctcctgcccacagctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggaggtgaggcgtggggtcggcaggactcggggccccggccgtgcggcttggttctttgcatgctccctggaagccgcagagcggtttgtgggttatgcacggtgctttaagatattttcatgctagcatttaggccgggtgtggtggtttacgcctgtaatctcagtactttgggaggccaaggcgggcgggtcaccggaggtcaggagttcgagaccagcatggccaacatggtgaaaccccatctctactaaaaattagccgggcgtggtggcctgtgcttgta

SEQ ID NO: 90583 - DNA, 4008 bp, Homo sapiens
tgtttgtttatttatttatttatttggagatggagtctcgctctgtcacccaggctggagtgcggtggcacgatctcagttcactgcaacctctgcctcccgggttccggcagttctcctgcctcagcctccagagtaactgggattacaggcgcccgccgccacgcctggctaatttttgtatttttagtagagatgggattttgccatgttggccaggctggtctccaactcttgatctcaggtgatccacctgccacagcctcccaaagtgctgggatcacaggcatgagccactgcgcctgcctccatttcctttttataattcatccctgaactcccttaaggtagagaagctgtttgatcgtcccagcccctgggaggctgaaaggtaacttcaccagctccatgcctgagtttagcacctgctgtgccaggcactgcccgagtcaggttaatgcctttctcggcaggatacccaattccctccattttacagatgaggaaactgaggctccaggaggatgggggaccttcccaaggccactgggctcattcagccacatcagctcctccacgtctgcctggagaggtttactatgggattcagagaccttgaggagttcaccttgctttgtgatttcagctttgggacctccaacttgctcagccctaagagaggcagggtgtcgagaagtggactgagaggggctttagagagagagacttgagtcgggctgggttggtttgttccgaaggatttttgtccacgaggctcccacccctgtggccgccccaaacccgtggccaagactcttgggtgctggatggggaggccggatcctgtgttctgccagggggagggcgtctccctggggaagccacagtcctcctcctttcagaccccgattttcagccccacacccattccatgatttttttttttttcttcttgcttttgggtgttgtgttttgttttggagggagttttttcgtttgtttgttttttagattctctctttctttttttaaattgcttttgctttgttatttcatttgttcttcctggttttgttttggacgtcgataccgtttttctgtccttgaataattagctccccccacgctcatttccccattgtgttctgtttccatgacaactcagccttggcatcttacctgtgcctcgctgtgggtgccggcggctggcctggaccgcgtccgctggctggccggaccccattctccccccacacccccaccctccacccagccctaccagaaagccacccgccccccccatctcacggcacctcgcccctcacctccactctgtgtgcatggcccttctgtctccccatgccccgactcctcccctggagcagtaccctccactccctccatcctgtctccagtgcgacttctggacttttcgtggggcttctttttccgaagggctgccagcttccggaccccactcccacgcctgccgacgtccccccttctctttgcctcccgcccggattcaggaaggcaggggttgggatttccagctaggaaccgaggctggaagggagggagttggggccacctccctttatccccttgaacctcctcctcagcatcgtagaccagaccccctgagaccaccccctgaggctgcacctcccaatcccgtatgaaaatcagaggcaggtgttgatggggatcctaactgagcctccagtccgtcatctgtgcagttgaaacaagactccttcacccatccaaagctggggacgcacccatgtgtcttctttaggacctgagactgtcacccagggacaaccccttttcctgctagaaggatttattaggttcacccgagtccttcccacagcagttaaacagcccccgtgggccagcagtgctctttgcaagttcaggtgcccactggcctcctccccttccccctgtcctggaacccatctgacttccgaaaacggagcccccgaaatgcatcctgctgccttcatggtctttgagagaaggttgcatccacttccccgctaagaaacgcacagaacatgtccctgttctctcaacgttcaagttcattcccttgtttattattattaattattattattattattattattaatatactatttattattctgccagggctgtgatgtgacaatgtggcatgtcacattggatcacatctgctagaattaatatgcagcattgaagtgggcccccccttctttctttctttctctgcccctcccgctctctgtccctattttctattcttctctctttctccccattcattcgtctcctctctctggtgtcacgtaagtgtgcactagagatccccaaaatccagatcttccccctgcagttcctccctcctttctctctctgtctctcgctcgctctctctttctctctctctctctctctcaatctattttgcatgatgtttgtgactcagagctgcatctattgatggaaacttgtcagatctgacagaagcttttagaagggtttctatacccaaaaaccacaaaaatttcattagagtttctcatcttttcctggagggcccggtcggagggggcgggtaagtgggcagggccccaggtcactggggagtgggggactgacatctcaggctccctctgtctcctggcctcaacaagtgtcctatgaccgccacatccccagagaaccagggagggttggaagttgccccctctcctaacccactcacatcccgaaacttggcagccagaatcttccagcgctccccgaaggggatgcccccattcgggagtgatcggaggccacctgctccctgaagccactgctgtctgcaaagatgagaaaccgctgataaatttttgtgttcgtatctgtgctgtgaccagccaccctggtctatgaaaccctgttgctatgagataatgcttcatgtctattatatattgatatatctctctatatattgtttgtgaagtaccttcctttgaagttttggtttctttgtgttggaatttggttttttaatttggttcttttgttttcttttcatttgggggaaaaaaatcaacagagggaaaagaaccagccctgtttatatttaaatggttttcctttttttttctttttttctttctttccttctttctttcttccttcctgcttttctttttctcctccgcatcctgtcttcccctcccaacctcaccccacctcacccctcgcatctccctcccgccgccactgccgccccctccccagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatgtgagcagggcccatggggctcgtaggtggaggggcaggctggagtcgatccccgacttcaggcacaggtgggaggcagcgtgggagcacctccgagttaccctcttggcttcagtcattcatggctaggaaggggacggttgttctttgaacaggtattatttattggttataaatgatcctggctgggcgcagtgattcacgcctgtaatcccagcactttgggaggccaaggcaggaggtttgcttgagcccaggactttgagaccagcctgggcaacatagccaggccccttctctaccacaaaaaaatgaaacatttagccaagtgcagtggtgcatgcctttagtcccagctactcaggaggctgaggcaggaggactgcttgagcccaggagttcaaggctgcagtgagctatgatcgcactactgcagtccagcctggg

SEQ ID NO: 90584 - DNA, 1312 bp, Homo sapiens
cctgccggttgagcaatgttctaccttgaagggtctgaggatatcttcaaggttttggaagaggccgatgggactggcataatttaacgcagagtcttgagtgctaagctaagaaaccagtacctgctgcgtgacaccagcaaggcctagattgcccgattcccaggtcttctttttcagtatttgtgacctgtccccaggccttttcagatcaatccatctatgcaaatttatggggaaaaattgttttttaaattaaatttccaatacccaagccctaaaattgatggatgtgaccccaggtgttccccttacctcttggccccccaaaacagggacagacatagatggtgggctggaacacccctcacctcctgtattcccagaaagcctcgcgttgaggtgtgttggccagctccctagtttgtgcttactatacctggccacgcctccctacctaaggccgctggcttaaccctaggggcaggcagtgttagatcagacccagaccttctcatcccaccctcatcacatcggggagaggggactccaggggcgggaaggcaggcgtccctccatttggccagggtgggcggcgaggagggggtcactctgcaggaacactgagctctgaacacctctcgcctgctgcctgcctcacaccctctgcattcgctgtttcctctgttgggggagggggtttgtgaggggaatattagattacaccttgtcatttggaaagccccgtgtctccggcggccacagcgaggttgggggggtggtgagggaagtccatggattggccagaactgggggaaaaacaaaaagaaatgagagaaagagagagcgggtaccaaaaaaaaaaaaaaaagtatctagagcgcatccaaaggtccagctcaaaataccaatgacttgccaaggccgctggtcagcccgtgggccagggagccagccaggtccctccgggccttgcacgctacctcagtggcggagggagctggcggtgggggggagaggcgggagggagggaaggaggcacagcaaaatgatggagaagggtagcagaaaatacgcaggtgggctgaggggcggtgcccaccctccttgggctacaggctggagttcaaaggagaggacaagaagtgggctatggaattaggaatgtttccaacccctcccttcccccccgacaggtgtaatctaagcttaaataaaccccccggaggctgcacaatttcttggcatctctcccctgccctctccatccgcatattcattttggagtttggagaagtatctagaatcttct

SEQ ID NO: 90585 - DNA, 1724 bp, Homo sapiens
gtagtaactcagctccctgcctccaggcagccatgttggaaggaagcttaagcaggcatgttcccatccttctacctcagaatgagactgcctcctgcgctcccaaataagcccaaacccaggcatttgaagtactgctgaatgtgcactagcattttgagttcttattcattttagtgacatatccaaacatggattatggtcagttttaaatgaggggagaggacaataacagcaccattttcacaggaccatgcatactcggtgtgtaattggcactcaaaatggcagctgctgtgatgactgtatgcattctggctgggtaccaatccagaagtgcccattaggaaatgtagcctgacagactttggaagaaagacttggccaattatctgacctggaacactatgcctctgcctcccaggcagcactggctgcttcccccatcccctctcagactctgagcccggtcacaggcgtcttttgtccagcaacacagcatggtcactttctgagtacctgagcatcagagctgtggaattctggaaaaagcccaggggaaccttggacacagcctctcccctgctctctctgcctccccaactctccctctgcttctctttctctttttcaactctctttctctctgtgtgtctctcactcttgcaaatcttcagagatgcacacccccatcttctgctcccctccccaagaaaaggcacgcccttgagagtcttactccaacccccaataaaaaacaccccccaataaaatatccgtgtagatttttaaccaccaaccccagctgactaccccgtttagacgatgttgaggacagaagccagactttggaatcaccttttccccctcttgtccctcactcaccttctccaaacttaccaattattaaatcctggaccaagttggcaagaggactttagatgcagtaagatttgcttattaacccagcatgcgagctgccaggctgaccctcagagcagtgccaaaagatggcagaaaggggtctcccagcccctccaccaaagctaggtgctggtgcattggaactgagtgaacagagggtctctgaagaccacttggactttctgggcagtacagcccagaaagtgatgagagcataggctctggactctggcagacctggattccagttttgtctgtgcccctccctggctacgtgaccttgaactagtcatttgaccacttggagtccccacttcctcatctgaacagtagagatcataaatgaaccttgatcacagggtaggtgaaaggatttcattgaactaagtgctctgtgtaacaagcattcccagtaggattgttgtaaataaaggattcaagcaaatgatctgggcaagtcacttcccttctttgtgggtcttagtttccctgttatgtacttcacatgtccactgtttgaataagatggcatatgggaaacttttaaaaataattgtagggcagaagctaattcatttgctcagacctcatttttcgctagtgctttcctgagctcatctcatgatctcattttctcctggctccagccccatccccatgagatcagcggactacccagagccatagctctcattttccccactgtcatttcctaggaagttctgtggccacagaaagggacaacaaaggcccatattaagtacaaggctacccttgcagataagtaccagcccaccaga

SEQ ID NO: 90586 - DNA, 2020 bp, Homo sapiens
gaggaaaccgaccagggcaaatatgagtgtgtggccaccaacagcgccggcgtgcgctactcctcacctgccaacctctacgtgcgaggtagggaacgccgcgtccaggtcaaaggcagggacccgccccgtcccatccccctccctcctcgggctcaccgcctccgggctcccccgtcccctgcacacccaagcaggaaggcccctccccggtcgcggtgggaccttggccgaggcggcgtccctctctgggccttagtttccttgcctgtagaatgggggcagcttaaattcccttcctcgtgccttgcgagagatgccccgtgggcagcaggctctggggaggcagtgatggtggggtaggaaggcgtggggcagggtgagggggtcagtcttgggcctacagggccaggggagcctgcaggcctctgccccgccccaccccacctgcctgcccacccgagttggcttctgtggtgtgtcgtgccttcccgtgctgtgtgctggctttgcttctcccaactttgtggcctcgtagctccccgcttcactgccccccctaatccagggccctcaatctagaagttgaggaggggtcttcgaggctgcccctcccaccccccaccagctggtccggagcccggcgccttctgcctcttcctaatgactctccgagaagggcagtccaggccgatgggaggctggagccacagcgggcacaggcacccggggggctcggtagttgcaccgagctggggcaggcacggcacccagcgaagcttgttactctcagtttccaattcccactcagtcatgcccagcagcgtgggggcctcgccccagcacctccccgctcccctgccccaaggaagcttacttccttgtgggtcccttggtgctgcctcaaaggtgccagggggctcccttgcccccagatgcctccgttggcctcctcttatctcgtgtgttggctcttgggtcttttcagaagttgtagtcttcctcctcctcctccctttcacctcctagtcgctgtttctgatcagatttgtggtagaaacagcttctgccaggatgccagggcgcccttcaatccctagggctgccccagttagcgctgtgtaattgactcaatcacatccttctctgggcctcagtttcccccatgcgaagtaccaagccctagttgttctccatccaggaggccgtgtggctcatcccttacccacagaccctcactcaccaccttcgtccctaccatccacagcacccgctggccctgaagtgattccttggtcctggacctggggttttgcattttgtctctgaggaggaggtcgcatggagggggaggggatggggatgtgggtgtatggacgggtggtgggtaggggcacgtctgatccactgtcacggcacctctggtgagttgtaatgcgttcgtgactccaactgactggtcttcacctaacctgcttatttctctgccaacacctgggatgggggtttgtaaatccagcagggctcaaaagagtgtggacagcgggtgtggggcagggagccgggtggggcctttagtgagggtgcaagaagggaggggggcttctgtgtcctcatcccccagaggtggggtccccagcatgagcctccatcctcttggggacagttgagggggtgaggttctgtttccccatctttgcctgggtcttagatgctccagaatcaagcttagaaaagaatggagaaaggcaaatgtagtagatcttgtatgttgagggcagagtggagagaagacaaaaaggtcattgctgttctttttattttttaattttaatttttttttttggtttaaagaaaaaaaaaacaacaaactattgcagcttttagccttgggaagtcctctttttactctctgtatctcccctattttttctcttcttcccatgtcattgtgttctgcatcaaaccccctttacatccctcagagcttcgagaaggttggtgtgtttttttctttttt

SEQ ID NO: 90587 - DNA, 2291 bp, Homo sapiens
ccaaccaggtgcagtggctcatgcctgcaatcccagtgctttgggaggcagaagtgggaggattgcttggggccaggagtttgagacccgcctggacaacacagcgagaccccctctctacaaaaattttaaaaattagccaggcgtggtggcgcatgcttgtagtcccggctactcaggaggctgaggcaggaggatcacttgagcccaggttgttgagactgcggtgagctatgatcgagccactgtactccagcctgggcaacagagcaagaccctgtctcaaaaaaagagagagaactggctgtaaaggatggcacccatggctgaggtcacgcagccagggaggagctggacccgtggccaggcagtccctgagccccaggctcaggagtggctgtgcagtgctcagaaccatgcccatttctctcacgtctctgccctcagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggtgagtgagggtggctgacaggacgtgggagccttggagggcagcagggggtggggagcatctccagggcccaagttctggggactactggaggacagacagagacagtgtgtggccgtggcaggcgttggctctgggggagtgggggcaaatgtcttcaaagccgcacactgaggatattagggggcacagatgggcatgagtactggagagctatagagggtggtagaagaatagtgcttcaacacctggccaatgaagatataatggatgcagacatgcacaaggatggggagttatatagggccatgggcggggagagtgtctcccatgctcaggcagtgagatcacagctgtcacccacagacagttgtgggtgataggaagccactgagggggctgggcgcagtggcttatgcctgtaatccgagctctttgggaggccaaggcagaaggcttgcttgaggccaggagtttgagaccagcatgggcaatgtagcaagacgctcatctctgaaaagaaagaaagccgccaaggatggtgggtatcggcagtgcccaagcaatgggagacagacaggcagaagtgtcagtgagccatggagggtgacaaggggagaccagcttcaatgggtatgtaatagggagctatggaaggtggcagagagcatcctctacagaagcattaggcacgtccagtgagaatacagtggggcccagacaggcaggagtagtggaagctgtgtaaggcaatggcaggtgtccagaggtgacaagtaaggtgatggggagccatagaaaactacagggagagagtctctccaaggctgagcagtaagaggtgatggcggggcttcaggtctgtaagggggcacagacgggcagtccagcctgtctgttcaggccctggctgggctagggagaccttgggacagagccttggagacgggtggttccaccattgtgtctccacaaagcacccacatggcccatctgtgggtccatctgtctggggggctgtgtctgcgtgtgtgttgtccccccgcttcacgacatgtccacgtgtgcatgtctgggctccctgtgccggcctggcctgcctcccgcctgtgggcacaggtgtgcaggcctggctgctgtcacacacgggcctcccttcccccgcccggagcaaagtgtccgcctgcatctcggccacacgtgcacccacattgcagtcactcccgtgcctgtgcacacagggcagtgatccgcgcacgcgcctctcagcctgcacctccctagtgctcgtgcgtggggacacacgtggtggggatgtgtctccatacattgggagcacacgtgtggctgcacatgcgtgtttgtctgtgtcacggatttactgttttcagttgtgccgggcttgacgccctgccttcgttcaggtcactgttgagatcaccctgcacctccacacacccctctttttgctttctctctccccttcctccgaggatcccgccacggagccccctttgcagcagtacctccccgaatcatccccagcgcccctcactcactgcccatcgttgccccccaccaaagagcctacctacctgttctccgctttctgctcctcctccttagtgaaaaccaagccccaaaaagatcagacg

SEQ ID NO: 90588 - DNA, 1800 bp, Homo sapiens
agaccaagttattctggcaagtgctttcagggccctccagggtttggctggtcaccatggagggggggttcaggtgctgaatttagggaccccagcatctcacaggtttccccttccatctttcccagtggcactgtgtctgagcaggtgtgcccaggtgaggttgtatccactgtgtctgagcaggtgtgcccaggtgaggttgtatccactgtgtgtgagcaggtgtggctgttgcaggtggaagtggggatatgtgggcacctgggtgcccatgggtgccgtggtggggggcgaggtgggagggtgtttgttgtcatccttgctttcctcctcctctcttcattggccacatggcacttccgtgggcagggcatggaatgcaggttttcgtggctccttggtatcctagccagatgcctggacccatcagcgcccccccttctttccactgtatccccagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgaggtgagttggggtagggggaggcagcctggggtcaatgctcccccaaggcagggccacagcacctcagccacagtggacttcgtggacacgttccccaggtggagcatcatctgtggccaagcaagcatggctgcgcagcctccagccagggccctgcccgccttacttgctctaccagctccatgctgtgtggcctcaagcaaagccctgccctctctgagtcttcttcacagtgcagtgtacacagcaccactgcacacagaaggaactttacaactctcaatacacgcccatgatcacacgtgcacattgacacattccgcatgtcttcacatgcctttgcatgcctgtcacatgggcttgcagacatttgtcaccctcacacatgcacacaacaccctgttcttatatgtacccaaatctggtccctgtctgcggcgcatttatactggacaccgacacacgtgcacattcagcctgcagcaattctcccagtcacccccaggatcatggggctgactgccattcccctacagcccagcctagcccagcctagacaggaaccttcctgggaccccagcctcactctgttcttttttcccctgcccatggcagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgaggtattgggctcctcagggcgggcggaggataaactgggccctgggctttggggacaagcacaaaaggaatacatgaaagttaccccaaaccctcctgctttgtgttttttgggaggaccttgatctcccttatccaaccagtaacagtctcagggcccagcgcctactggtggggatttattgtgcctttgcaagaaagaaaggaattgagagactagaatcatcctaatttataatcttcatcatgtgcttctgatgacaaaaggctgatccaactcagatgggttcaagcgagaaaggtaattgatgtgcagaattaaaattccatggagtggctggcttcaggttcagctggatccaggggctcattgaattttctcagagctcactctctgtctcttggctttgtttccttctgtattgatgatatcctt

SEQ ID NO: 90589 - DNA, 1105 bp, Homo sapiens
tattgacagtgtttgtttttctgtgggtgtccatcccccctgcaactagtctgtgccccccaacaggggcaggagtgctggttccatcatgcttaccactgtgtcctcagcacagcacacagtaggtgctcagcacatgtacagggaaagaatgaatgagaacggccgcatgaaacagtttctctctaggcgagggatggattgtgggtaacttttattttcttctttatgctgattttacctaattttctgctgcacgcgcctattttataattagaagaaaagttattttgaaaaaaattaccccccaacgtcccagctgtgggagctgacgtgatccagccccgtgttcctccccaagggcagccgcctcctgggtgtatacagaggacatatcaatggaacgtttttggaggggtccaggggtcagcccccaagggcacggagtaggcggggcaatcagggagggcttcctggaggtggccacccttaacctttagggtgctcaggccaaaaacccagaagtcatccttgagtcccctcttttctgtacatccccaaatgagccgtttagaaaattctattgggtctgcctagaatgtgcctttctccctcatcctctacccagtccagccccagcctagtcatcccccacagtctgccctccccacagcagctgagcatgtctgtgagtacctgagtcagggccttcctctacccacagccctccatggctcccaccttcctcagggtcaaagcccaattcctcctggaggcctctgaggccgtgcgcatcttgtccccattccttccctcccctccctcccctcccctcctctttgtctccccttcctcactctgctccagcaacactggcctcctcgccattcctccaacacgccaggtgcagtgctgccccggggcctttgcatggactgagctctctgcctggaatcctctttcactttctctcaccttctcctggtctttgttcgcatgtcacctcccctctctcctatcctgtgtttattttattttacatttttttagagatagagtctcgctctgtcgcccaggctggactgcagtggcaccatcctagctc

SEQ ID NO: 90590 - DNA, 1062 bp, Homo sapiens
tcccagcactctgggaggccgaggcgggcggatcacgaggtcaggagatcgagaccatcctggctaacacggtgaaaccctgtctctgctaaaagtacaaaaaattagggccaggcgcggtagctcacgcctgtaatctcagcactctgggaggccaaggcaggcagatcacgaggtcaggagattgagaccatcctggctaacatggtgaaaccccgtctctgctaaaaaaaaatagctgggcgtggtggcgggcgcctgtagtcccagctacttggggggctgaggcaggagaatggcctgaacccgggaggcggagcctgcagcgagccgagatcgcgccactgcactccagcctgggcaacagagtgagactctgtctcaaaaaacaaaacaaaacaaaataaattataaaaaaaaaaaaaaaatgggtgaaattccaccatggcgtaccgtggccagggccagaaagtgcagaaggttatggtgcagcccatcagcctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggaggtaatattactctgctgcaaagtgtctccaactagaaatgatcaatgaagtgagaaattgttgagaaggatacagtttgtttttagatgtcctttgtccaatgtgaagatttattcatattgttttgattaccgttgtgttactacaagatggcaataaatactatgggattgtttgtgttaaaaaaaatgggcttgatattagcatctatctcatagcattgctatgaggtgagttgaggtttataaaaccttgaacactcctggagcatgctaaagactcaatgtgataaattatctcaggctgggtgtgatggctcacgcctggaatcccagcactttgagaggccaaggtgggcagattagttttgagcc

SEQ ID NO: 90591 - DNA, 1018 bp, Homo sapiens
gcatagcaagtggttgtggttctttgaatttttttagcaagagacaggtctaaaccagggcttcccactccttgcccaacagaaatccctcccctctgccctttaagaaattaagtgtggcccatagacttagggaaggggaatcgctgggctcgatttctactgcagctgtaatctataatgttgcattacagtttttaaaacaagaggcccctctttggcctctcaaatgctgcacgctgtggagttaagtgctggaagccactgatggtgtctctcggcttcttccagtcttggaatcatagccacctcgtgccaacgagctgtgaaactactggggtgccccgtgtacccagccacagaaaacgcatatcaggcctcgcggggagctcgtaaaaggcactgaagcttcccctgcgtgtatgctgccggccacagcagaccaaatatttacagactcagctgaaatgaaacccagcagggtggatctcacaggtggtccgggaaaggtccccattgctggggaaacagtgcacagagcaggaaggaaacccacttggccaaggccccctgccaagcaagtcaagatgaaatccaggctcaagagctgggctctgagtcctttgttttcttgcttatttagcttagcaaatgcttcttgggtacttactgcgagcagggctccatggcagagatgcagccatgactgagacaagcctgcaggttcctgttgtctgggggtggaatgagactggcttcttggaggaggggactggacagacctaagccatgaggagtgaaggagccccagaagggctttccagaagaagaaacagggtgtgcagaagcccccaggaaggaaaggacacgcctcccacccttttttttgtttttcggagcgatgggatcttgctctgttgcccaggctggagtacaacggcgcgatcatagctcactgcaaccttgagctcctggaagtaatcctcatgccccagcctcctgagcagctgggactcca

SEQ ID NO: 90592 - DNA, 1017 bp, Homo sapiens
gccatgttttcatttctggcaggtaggaatgggtttgctgggtcatggtaattctgcgcttaactttttgaagaaccaccaaacttttccacagtggccacaccattttacatttccaccagcagtggacaagggttcttccctttcctcgcaccctccacggtgtgtgttattgtgtgattctagcatcccagccagggggaggtagcatctcggtgtggctcggattggcatttctgggtggcgttgagcaccttctcacgtgcttactagcacatctgtctttggggaaatgtcccttcccttgatttgcccacttgacatgcagcccttgttgtgtggcatgacccaccatgcagctgaggtcagggtgggtgcgcctgctgccgacacaaccctggaggctcattagatggctgcatgtctttttcttttggcaaaggggtggccgtgactggggagagcacaaccagcggctagaggagcaccaggcacgcgcctggcagggtgccatggacgcaggcgcggctagccgggagcacgccaggtggcaaggtacggggctggctccagggacgagggtggctgtggcccccacatgtgtccaggggcttccccaggaacggagtgtttgcagacccttcttctcttctaggtggcgagaggggcctgtctgggccctcggggccggggcacatggcaagccgcggtggagtggcggggtaaggtgtgtcgtccgtggaggacggtggttcactcctgctcctcacttcctctcccttttttgcatgtttgatcagctggctgggttggatgttatgaaaacaaagcaaaaagcagctctttgcaatttatgcaaataacgctcttgagttacctggaatacaatgtgcgatgatgatttttctcacctggaaaaaaaacccaagcgctctaaaggctgcgggaccgttactgaacccatgttacgatgaaaacgctgagcacttcaaggggaaaaaaattgtctgactttgt

SEQ ID NO: 90593 - DNA, 1008 bp, Homo sapiens
ggaattgtggccctgccagagcacaggggggctgacccacccgagggccctcctgttatcggaaaggaggcggcgcccaacttctcagggaagacagggtttggtgacgtcttagtggatcttgagcagagctgttgagggcagtaatgccagggtgccctggctcctggggcagctcaggtggggcagtgatgcagctgtaggggtgcgaggaggggagccagggagcagagggtcagtgaagcagggcccagcagggctgagactgcacccttcagtcctctctcagctccgccccacctgccaccctggggcctgcagtggacaggccttccggaaggtgggcctatgtgggtgacatggtcagtgtcaccctgttcctctcctgccttccagcactatggagatgaccgccatggccacggaggacccccagagcgccacggccgggactcccgtgatggctgggggggctacggctccgacaagaggctgagtgaaggccgggggctgccccctccccccaggttagtgggtgagccccagccgggtggggagcatctgtcctaacctgggaaaaggttggtgcctggccaggcacgtccccaaggtttgattcagctaggggagctttaggatgggctaccaggggtcctgccatttgaaacccctgactcagaaagtccaggttctcaagaagaaagcatagaacaggctttcagggatggagctgtccaggtcgcccagaatggcccatccccattcttgagctgggggtcgcctgcagttgtgaatgtctcgatcatgggctgcgtacacactgggagagacagcgctgaagctcttagtcctgccccgtccgtggtagagcagcctcgcccctgcctccacgttgcctcttgacacgtgtcttcctcgggttttttctctgacccccagttggtctggggtggatcttctcaaccctatcctgcctattagaatcacttaggaggaccctccacccag

SEQ ID NO: 90594 - DNA, 1103 bp, Homo sapiens
ccgtgagcctagttttctggtaaaaatcaggaagaagataattggatgccgtccagagctgtgtgtagttcactatcaccccatctaattctctttgcttttgcaagaaactcagagggagattcaggctcccgtggaaggcagggaaagtaaaagtgtggcaactcgaatgctattccagaagaatcaaatatttcttttcagttgctcatgaggggggatcaaggtaataacagcctcacgagacaatgagctcacagcagtgctccttttgggactgttggatgagaacacaagtgtgcctctcggctgttaatggcggttttaatttatcagatcaaagcaatgatgatcgaatgtttagagattagccctgcaggacattttaaacgatactgggtctggggagagagctcccctccccacctccacctcctccttttttcctcctcctctctcattaatggaatttgtattcttttaaaataaaaaccaacagacgagatgatgcctattggccagaaggaaagcgtgtggcaatggaggaccgatatcgtgcagactttccccggccagaccaccgctttcacgacttcgatcatcgagaccggggccagtaccaggaccacgccatcgacaggtcagtggtcttgtcccctcctttagctacagtcattgtgggcaccggggcatccagctgacctcgttctcagcccagtgcaggggttcctgtgtgctctgaagcctcgtttacttctgagatccacagtggatgactctggccttgcacagaacttgagcgagttgctggaatccccagcttacctcagaggaaggcatctcagagctcattccatccaccgactcttttcataggtgggccaggaggggcctgagtgcaggccatctacactgagctctcttgtgaggcagcagtgtttgtcagcacaacctggttgtgcccaagagctaccagagaattgatggaggacgtgcaaaatttctcatgaggcctgttttgtatttcgagggtctgggtgggttttttagccttttaaaatgaggaatacatctagtttattaaaaaggcagcccttggtttt

SEQ ID NO: 90595 - DNA, 1046 bp, Homo sapiens
gcccggcgttctcttgtcacttttcctcaaatattgctcagtaaagcaaaagctgtgctcacagcatttggaaaatgttctcgagcaaacctagaaatgttgccagctgtgctgcctttgcttttcttaaggtagctttgttaagtaaggtaaccccctgcacgcgcagctttagggaagcccggtgagcttttggatccattttttttttctgcttccaatacacacccagttttgggcaccgggctttctccttggaggctcacgcagggagttcagggcagcctcacctgtccccgcagggagcgcgagcagcgggagcgggagcaacgcctcgaggccttccatgagcggaaggagaaggcccggctacagcgggaacgcctgcagctcgagtgccagcgccagcggctggagcgggagcgcatggagcgggagcggctggagcgcgagcgcatgcgcgtggagcgtgagcgcaggaaggagcaggagcgcatccaccgcgagcgcgaggagctgcggcgccagcaggagcagctgcgttacgagcaggagcggcggcccgggcggaggccctacgacctggaccggtgagtcccgcccagagcgtgggcaggacggagaccagcgtggcagcggtgttcacccttccagcagaacagcggcttcccttccgtccctgtcggtggggagaatgaaatttgatatggagcatgcgccttggggaccccccgccgatctcactgcgctgctgcaggtttattagttcgctgtcctcaccggaggctgtgtagcatcttcctgaacttgagttattctgggaaacttgatggctgccacttgctgaagggtttgtgatgcttttcctctccacttacccgtggagcatagctgttctctgtcttgcgagacaaccgaacgcccgttaggcccaagttggccaccgctgactctgccggtctcatgtgtccttgtagacagagaggcagagcaggcgctgtggaaaaggaaattgcctctgatttagaaagtaggtttattggtct

SEQ ID NO: 90596 - DNA, 1015 bp, Homo sapiens
tgctggagatgaatggagggaagcccacccgtctggcaaggcactccctcagagtggcagtgtgattcctagcacaggctggatactgcggagcttcacagaatgtcagggaggagtgacagcatagaccagctccggagctgtgtgggtttagagtggagggtcacggagggctctgcaggatggccgtgcttgtgtgcgtgctgcaggtttaagctgtaggttgggaacaggtccctctagttgtgtaaagagctgtgagggtacccccatgatgctgtgcccgtgttaccgtgttgctcacaatagatgagaattagaggctcccaaggctagtgtcagtcacttgactcacgccttgtgtgttcaaaagcccagggtccatcagagtgctgtttactgcgggaagttggggcgtccacaggttttgatagtttgttgtgttttttcctgaaggaagcagaggaatggagcggacggtcgtgatggataaatcgaaaggagagcccgtcattagcgtgaaaaccacaagcaggtccaaagagagagtgagtattgcctctgccatctcagggccagctgtttctcacgatggctccacggcccgtttgatccgcattatgaaaacagcactgttttgcctttaaaattgaagtttgtaggaggcgcgataattgtgtagattgcggatacagacacacacatgaatcctggtgctttctgcagagcagtgcccatccgtgtttgcttcccttactggctcctgaccgggatgtgccgccttcagacagagcattggttcacacggcagctcaccatagggtgggatgggccagacccaggcttttcgagccggaaggcaggtcctactctttggttgacttaatagcaggctactttcttccattggttttttagtctcctattaaattaaccaaaaaggtagagaccaacctaggacagagagctggtcatgttatcagatcaagagctgtacctctcgagttgtgcacac

SEQ ID NO: 90597 - DNA, 1020 bp, Homo sapiens
gtgcctccatcccgttgaggctgtattgggaagaaatgcttttccctataaagcttataaacaatgttccacacatacatgatgaaacattaaactttttagaagtgttcttatgtagttggcgtgtttctcatgtccacctgcacaccactcttgcgtgctagcctgtctgacattttggaaacgcatccccaggaatttcattgtgcatatccctcaattcagcacatactagaagtgggaatacagcctgtatctaaagaggagtattgttattactatgggttccaaataatttttcccacctaattgctgccggggtgatttgttttgtgtggacgtctgagtatgtgtgagtcgaggctctgggtgagccgttcctgttacagagtcttgtgaactcaaatttgataaccatgtctttaaatagaactgtaattaagaaggaagagaagattgagaagaaggaggaaaaaaagcctgaagacattaagaaggaagaaaaagaccaggatgagctgaaacccggacctacaaatcggtctagagtcaccaaatcaggtgaggagagccttttaagagctgtggaaggggaaggcctggcacgggtggggagtgggggttccgagggaaggtgaggacagcaagctctggtgacatggctgtttcgctgttcatatggcagtgttaaagaaacaagagtctgttgatgaaatggcttaaaggagtgtccatacaacatcgggaatccagaagtgcctgggactcagggcttatgtgtattgctgaactcagctgcctgagtttgggctttttcagggcctttggctgattgtagtgtgggatttgcaagagtgagttgtccgagtttcttgtaactaacctgatgctattttgcaggtgtgcagtaaagttttcccacattatgttaaagctggaggtagtaaaaacacagagaaaaatgaaacctccaagcatctgttgaagtggttctgtttggacgatgccacttctgttgtc

SEQ ID NO: 90598 - DNA, 1109 bp, Homo sapiens
ccaggaggcggaggtcgcggtgagccgagatcgcgacactgcactccagcctgggtgacagagcgaaactgtctcaaaaaaaaaaaaagcaattgtatttggataggtcaggattaattagaaccaattcagtaactaaaatggaaaactaccatatggggagaggtgacaaatagtgaaaatgattctgattgccaggtaataactttagcaagttgtgtggtcatttgtatgagagagtaagagtgccctttttcatgaaggttgtcggggccaaagtggtaacgaacgcccgcagcccgggggctcgatgctatggattcgtcaccatgtcgacatctgacgaggcgaccaagtgcatcagccatctccacagaactgagctgcatggacgaatgatctccgtagagaaggtgaggcagttctcgtctatggtaactcgcaaatggagtttgcaagtgagaagctctgggccacacatcatttctgtctattatattttaggccaaaaatgagcctgctgggaaaaagctttccgacagaaaagagtgcgaagtgaagaaggaaaaattatcgagtgtcgacagacatcattctgtggagatcaaaattgaaaagtaaagtgaattttcaaacctcctcttggaatccctgggaggagggcacgggcagccaccatgggccttgaaaaacacgcatctgtccccacctgtacccacgcagccttgccagcttcctgctggagtctcagctgatttttgtgttctgctgccactttaatattcagcttttatttatttattttttggagacagggactcactctgttgcctaggctggagtgcagtggcactgcagcctccaccttccgggttcaagtgattctcctacttcagcctcccaagtaactgggactactgcaggcgtacaccacccagccaggctactttttatagagacgcggtttcgccatgttaccaaggctggtctcaaactcctgagttcacatgatttgcccgccttggcctctcaaagtgctaggattacaggtgtgagccaccacgccctgccagtcttcagctttctgtgtaaagctatttaacgaagta

SEQ ID NO: 90599 - DNA, 1995 bp, Homo sapiens
agcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgaggtttgttttttctcagttttagaccagacgctatctccttttcattggtcatgtaatgacacacataagctgtttttttctgcaattggccagccagactgacgaaattgtagttttgcttctaaagaatgtttcgtttctctttgtgtgtttttaatgggtgattcaattccttttctttttctcaacctaccatggttgtgttcttaaattgttaattgttatcttcagctaaatcgaattgacttttacaaatctgacattgtatttttggggtcagattttccaatataagcttgcagaggtgtctgttaaaattttatttcagactaattttctggtaggtattcagttttagcacataatcatatttttagttttgttctctttcgtttttttcctgtatgagtaacattaacttttgtctctagctcttttaaggaagaaaaagatataaagccaatcattaaagatgaaaaaggtatgatttaatttaacgtggtagggagccaggtatggttcccttattttgggaggaggggcctggagatatacacactttggattcagtaatttgttttgttatgggttaccggaatcaaccacctaatggtttcttgagagactagttttagaagttcgcaagcacctgcattttatgtttctcttgtggttgtcatctatgggatggtgaaaagcacattacaagaaaggaataattctgctcattgaagactgtttcaaggattttagagactgccgtcttggatgagatctgatcatcaaaagacatttcagttcataactgacatgggcatgattattccttgagtaaggaaactcagtttttgctgtccagattttcagccttctgtgtgttggcatgtgtgtgtgcgttaaattcttaagtcagcagttgggattgggcgtcgttagggtttttaaagagggctgcggtcttaagaatggttgtgcttcctgttaggccttggggtgatgcctaagaatctccctctcgtgccaggtcgggtcggcagcggttctggtcggaacctgtgggtcagcgggctgtcctccacaacacgcgctacggatctcaagaaccttttcagcaagtatgggaaggtatgccttcccttgcctcataccatccactgtgattcagagttaaaaaggaagctctgctgggcacggtggttcacgtctataatcccagcagtttgggaggctgaggcaggaggattgcttgagcccaggagttcaagaccagcctgggcaacatagcaagatgttgtgtttactaaaaaatggaacgacagcagcgaagctcgcccagtcttgtgcagtgcaccttgtttcctgactcacagtaactagggtgcggagcagggcaggtggttggtcatatcacaacagtgctcagaacagctgtataaacagcttctctctcaatgttcttggggttctttctaactggtctcaaagagactggtggtcttttgtcttgtgcaaaacttaaagcttacatgatgagatttttcccttaagaataatttgggaggccgaggcgggcgtatcacctaaa

SEQ ID NO: 90600 - DNA, 1026 bp, Homo sapiens
aaaaaaaaaaaaaaagaaaacaaattgagacaaaattacgtgtgacaggagaggggagacttatagtttatcttgtaatgtgttctgttctaagattgaaatctattctgcataaactaattatgaggtagaacttgagtgttatctgattgaacaattattctgtaattaggactgaagatggaggaggaaggcacagaagataatggcctggaagacgattccagagacgggcaggtaagtgatgtcagggtagagatgacaagcagcagctccctgtcctggtccaggtggtcgttaacgattcttcttcctctttacaggaggacatggaagcaagtctggagaacctgcagaatatgggcatgatggacatgagtgtgctagacgaaactgaagtggcgaatagcagtgctccagattttggggaggatggcacggacggccttctcgattccttttgtgatagtaaagaatacgtggctgcacagctgagacagctcccggctcagcccccagagcatgctgtaggtaacttggagacacggcaggatgtgcccatagccccgaggcacctggtgctcgcgtgctgctcgtgtgagggagaacacagctaaaccgccatgaacacacagttctgcttctacaccctggtgttaaaccatgtccatttaaacgctgtgtagctcagggatttactcatagatagcttttctgtagcactggggagtgtttttataattcgaagcatgtggtgagtcataaaatagaaagctctgacataaaagatttttcttttctgagatgaggtctcaactgttacccaggccggtcttgaactcttgggctccagcgatcctcctgactacctgggcttattggcacaggccacagtgcccatttagttttttccttttaaaatacagttttaagaagcaaagatggtttatttatttagagacagggtcttgctctgttgtgcaggctggagtgcagtggggtcatcataattcactgcagcctcag

SEQ ID NO: 90601 - DNA, 1228 bp, Homo sapiens
gtgatccgcccgcctaggcctcccaaagtgctgggattacaggcgtaagccatcgcatccggcccttcttttttctttttaagcattaaaaatgtgcatactcgggcatgcgcagtttctgtgggaaaacatgttccttaactaaaaggcagcacatttgcaacaaataatttttccctcaaacaaggacacttgggataggaagaagggcagagctgaggacaggtctgatcctgttcaactttactaagaacctgttttctgcacttctacttccacagctcagacaagaacagaacctcttctgcttgggggtggggcagggctgtcttgtgcggaatggcctcattcctggattaggaagtgttcctaagtagtgaggtgtctcagatgtttataaagtgaccacttgtgtagtgctcagggcattgttgcttctgtaaagtgcgtatcatttgatctcatgctgtaaatgattctgtcttcagggcgcaaaccagaagaagagggtgtggaagataacgggctggaggaaaactctggggatggacaggtatgtgcagccttgcgagtgagtagcgtggtggatggaccagtggcggtcacatgatggttcggtctggttgtgtcacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctgtaggtaaccggcaatgtctctagaatgtgccctgaatgtatcagttccacaattaaaataggtgatcagtttcatattgggaagtaagttgttctgtaatgccagttcagtagaataagggtcagttggttcagatgattctgaaccaatttgttttgttgaaaggtgatgtcttataacatttcatatgtacttgctatccatttgcggcatacagtatgagacattttgaggacaaccattcagactcttcctgttgccggacttgatctgtggtgttatggcctaggtaccttgaaagcattgaactaggaagaggttagaagttggtgttttcctgttaagaagcaattgttgagctgggtgccttgatgcactcatgtaat

SEQ ID NO: 90602 - DNA, 1008 bp, Homo sapiens
tgtcctcaccctcatgctgggagatgctgttccattgagggaggtacctaccccaggggcagcaggtcccacatcctcagcatccaggctgggcgagcagcggtggctgaaggctccacttcagcaggactctagccattgctcctggaagaacagccctcaccctgtgctcagatccacttagaggctgtgcactcattttcatctcttttctgtttgacttagactttttttctttcttttgcatcttaaaacctacatagctaccatattagtagatttcctagtctatgtgcaggtggacatttacatacaacttttttttcagtttagctgcaattatactataatagtgttttgatttctgccctgggtttaaaattttgttgtgaattattttcatagctgttcacttttcattgtacagatgtaccattatgttacgttattgttggtgtgatgaactgtattttctccatttattttacagatagaggacaaagaaactataaacaatttagatacttcatcatctgacttcactatattacaggtaaactgttgtatgtctcagtacttttagaatgaaaggtcagaccacaatttctggaatccatttcagacaccatatgccagttccagctaataatcaccacaagggttgtttcctttgtcaggatcgttaatgggtgtttgctttctgctttcctccaaatataatgtacgcattgccagggacttaactctaggcttcgacgagtggcctccaagcgctgtggcttaccagcagtcattagagtcatgttttgtggcattcttaatttcattgcttgtggcaggggaaggcagcctgtctcatctaccctgggtggcatcccctgcagaaagatgatttgatgagacagcaagagggcatggctacctgggaaagatgagtagggcccagatggggattgagggttgacagagccctgttggggaaggtggggtctcaggggttctggtctt

SEQ ID NO: 90603 - DNA, 1239 bp, Homo sapiens
cctgagtggacagggcttcctgggaagagtctgaatgacttctagaactggcctggtgggaacactgattggaagaggagatgaaggagggagggtatttacaaagtttttcatgctggcaccaccatgccaagtaagagcaggagtcataccacctgggcccatattccctcagtctttcgaatatcagaaagttgtcgtagcttcattgagtgaaaaagtgactgttaatgtgccatgcattcctctagatgctaacagtagaaaaatgaaaacactgctctccttgaatttgagagttcaatctagagggtcaggcgtgcttatgatgagtgcctcaccatgaagtgagaccagttccaggctcctgcaggggagactgaatggagggtgggctgagtgaagtggatgccagtcttatggagccattcctagaacaagcaggttctccacctcttgagtttgtgagtttccctccctggatttttaaaattccctctttagttattctgggttttcatttaaataaactgtaggtgtcattcatctggcacagtcttatttacgttttttcttgcaggaaattgaagagccatccctggagccaggtactgttaaatgaaaaacttaccagcgggggtttggaaccattctagttttccaccttctctaatttgaattctttgatttttaaaagttaccttactatagtatacattgttctaaaggtttacaatccaaaacctaccaggatcatagagattggaaacccagccatatcaccagatctgtgaaagtggctcacttctcattttacaaaatgtattggtgagatgaaagtatctcatgcctttttgaatatcaacagcattgaatcatacatagagaaagagttccagatgcctctcttgagagctaatacctctgcacccacaaaacagatcttgtgatattgggcagtagcttaattttgttgtttttaattgaggcagctcaggtagtggtagggagatacattttaaaacataaatttgagacataactggattccagaagaggaaagagtgtcttcatgagaattccaaacactgttcactttctggactgcaaatatctcagagcacggatggaagagattctggttttcatgttggactgttctgttaaaagaaattcaaagaaatttggaaattgagctgttcagtgaatggtgatacattcagttaagcaacttggact

SEQ ID NO: 90604 - DNA, 1101 bp, Homo sapiens
tggagtgcagtggcgcgatctcagctcactgcaacctctgactcccgggttctagagattctcctgcctcagcctcctgagtagctgggattataagcgcccgccaccacacccagctgattttttgtatttttagtagacatggggtttcaccatgttggccaggctggtctcgaactcttgacctcgtgattcgcccacctcagcctcccaaagtgctgggattacaggcgtgagccaccacacccggcccgcaattgctaactttcttaggaaacctcacattgtcccaatagccccactcagtattgtgacgggccctgtggtagtgctgctgggcctggtgttgcactggaggctcttggtgaggatagtggtcaggcccacagccccatttggcttttagtgctgccactgcctcaggaaaaatgggaaccatgtctcttttggaaaggttgtctctaagactcaagatcttgtgggtatttgggtttttactagaattttcttttgaaataggtcgcagcagttgtggtagaaatttctgggttagtggactctcttctacaaccagagctacagatttgaagaatcttttcagcaaatatgggaaggtaagtgccagagcttttctggagaagatactttgaaaccagcgttgtgtggcctttacatggaggtcctctcccctcagtgagttctttgagagataccaaggagcttacacttgctaatggctggggagggtctgcccgtccacaggtagaggtgagagtggtgtggaagcttccagagcccacatcaccactgtatttccctcccttctctgcgagcttgcccccttccctgtgatggctcgtggatccatttctgtgtcctcaggacgtcgcactcaggctgggctgccagggttggctggtggggtgctggtcagcatgtctgggagacagcagtgttcttagaacagtgttcgtgatgctggaactcagaactcagaacagggaccctggagtctgatgataggggtcctcaccacgggtgtcttgggtccattgactgaacctcacctcagcagctgggggctctcaaagttgctgcctc

SEQ ID NO: 90605 - DNA, 1303 bp, Homo sapiens
cagtagagatggggtttcaccatattggccaggctggtcttgaactcctgaccttgtgatccgcctgcctcggcctcccaaagtgctcggattacaggcgtgagccaccatgcctggccggggcagggtgttttaaacagaatctcactctgttgcccaggctggtgtgcagtggcaagatctcttttcattgaacctccacctccctggctcaaccaattctcatgcctcagcctcccgatttgcttggattatagccatgcccatttgtggttttagtagagatggggtttcaccatgttggccaggctggtctcgaactcccggtctcatgtgatccgcccgcctcatccccccaaagtgctgggaatacaggcatgagccaccacgcccagccaacatgtctgttttttatagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggtgggcagctcatgagcccaggagattctgtcttgtttctgtgcctagtggagtttgttagtttgctgtgattagctggcaacggaaactggattcatgttgcagagggtttttctcatctgggtattcttggttttccacttacactttccccgtcttttctgtaggaagtcgagggaccgaacggactgtagtaatggataaatccaaaggggtgcctgtgattagtgtaaaaacgtccgggtccaaagagagagtgagtattaattttctaactagggtattttgctcttcttttcagtttgtatttctgtgtgcgtcttagggaattactaagcttcatttgaaaaaagcttttgtcggccgtttcgaaaatgtagaaatctcaaactattttttttgagacaggttctcactctgttgcccagactagagtgcagtggtgcgatcttggctcactccaacctccgcctcccaggctcaagcgattctcctgcctcagcctcccgagtagctgggattacaggcgcacaccattatctttttagtagaaacaaggtttcaccatgttggccaggctggcctcgaactcctcacctcaggtgatccgcccgcctcggcctcccaaaagtgctgggattacaggcatgagccactgcgcccagcctcaaattattttaagaaatgcagaaagctttcctttatccttacttttgctctgataactgttaacttattttctaaag

SEQ ID NO: 90606 - DNA, 1032 bp, Homo sapiens
gtctcgatctcttgacctcatgatccacccacctcagcctcccaaagtgctggcattacagatgtgagccaccgcgcccggcctgttgcttatttttgactggctgtttcctgaaatcacttgtcaagctccaggaaatgttggagaaaggaggcccagttctgatcacacacacacagcctgggcctcactcctgagatcttcctgggctgctcctgtgggcccgagaagccttcttcccgctggagtgtacggttctgcagaccacgtagtggacgcacagccctggagtctgtgcgacccagcgtcttacttaaagtcagccctgggacctggctgggggtgtctaggtccccttctgcagctctactgttgtgcagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggtaagcagatccatgctgcccttagcacgtggcgttcagaatcgtgttagggacctcacagtccagttagcttgagatttttttttttttttttgagacggagtcttgctttgtcgcggaggctggagtgcagtgacccgatcttggctcactgcaagctctgcctcccgggttcacaccattctcctgcctcagcctcccgagtagctgggactacaggcgtttgccacctctcccggctaatttttttgtattttcagtagagacggggtttcactgtgttagccaggatggtctctatctcctgacctcgtgatccacctgcctcggcctcccaaaatgctgggattacagctgtgag

SEQ ID NO: 90607 - DNA, 1731 bp, Homo sapiens
cacgtgagggggccgcagcgctcgaacaatcccgccctctcgttgccgtgacaaccgccttgtaggcacactcttcttaaatccgggcccttggtcccccgcgcgggcgcgggtggatctctcgggctctgacttgttttcgggtcaccttcaggcttcagccaggcacctgacgcctctttcccctcacggtgccagggccgggccgaactacatttcccaggaggctccgcggccaggtgcaaacagcgccgtgctgactacatttcccagacagccttgcggcggcccgggccttaaagcgtccatttcccagcggccctccgctgcgagaccgcagcccttctctggagtctcagagccgcaagacaccacgactcccagaggaccttgcgtcgggcaagaaagactacaccttccagaggcctctgcggcgccgcgacaggaagcggcgggcgagccgagtgtccttgcgcgtggatccgagcgaccatggtggcccgggtgtggtcgctgatgaggtgcgtgggggcgccggaggggacccgagtccccgaaaaagtccatttttgtgggcatccctgtctccagtctggtcccgatctgctcttcgcttcccttagagtcacttccccttcgttccccgcctatgggccagatagggaaactgaggcttcagaggggcggggcttcccgaggtcgccaatcccctccctcctgcttcccagcgagcccttggcgttcagttcgcggtgtcagcctccgcctccgagcctcagttgtcttctctgtgaggtgggaatgccggtgaatcctgccgctggcgtggatgagaagtgaatgcgtgctcggagctgcgagtgacagcgggcaggaggcgcccagggacacttggtttctccagggctggaaggcttctagaaggtcaagatcttacgtcttcactgcccctgctcactgtgggactttgagtgacccactctccccctctgggtttcagttcatcagttcaagtggcgtccagccgccctgccttgcacgttgtaaaacgagtgctgtatataataggggtctgggtcgacggtgctgcactacagagtgtcaccctgtggacggtgagccctcaggagggtctcactctccccgtgggccttggcccctgagggtggctgtcagtgtccgctgagcttctgctcctcccgtccctgcccgcaggttcctcatcaagggaagtgtggctgggggcgccgtctacctggtgtacgaccaggagctgctggggcccagcgacaagagccaggcagccctacagaaggctggggaggtggtcccccccgccatgtaccagttcagccagtacgtgtgtcagcagacaggcctgcagataccccaggtactacgggccgggaacgaggccagggtttggcgggtggtcagctctgggaggtccctccagccctgcacgatgttgtcctccatattgatgctgacctgattctccggcctgtcctcctccctccgcctctggggatgggctgctgagccttttcaccagttctttctgcccatctctttttcccagctcccagcccctccaaagatttactttcccatccgtgactcctggaatgcaggtaaggcacccagtttctttgcttggagggagacaccccagtctagcccctctccccacttcctggccattcctttctgtccatcctccttcctgcc

SEQ ID NO: 90608 - DNA, 1029 bp, Homo sapiens
gactccaggtgcgtcctgccagtgttgcggagactgggacttagggaggatgggagctgctccgggcgcggcgaaaagcgctaggcgttaataccttggttctcacagctacccacagaggggaggaagtagccagggaaatcgcggcagcgcgagagaagctgcttaactagaatgcagggatccccctaccctgacggccgcccctttcccccctagcgtctgaccaaacacaccaagttcgtgcgggacatgattcgggaggtgtgtggctttgccccgtacgagcggcgcgccatggagttactgaaggtctccaaggacaaacgggccctcaaatttatcaagaaaagggtaggtgggcgctgccggccgaggggcggggtgggatgggagtcagggccgggctgacggcggcctcgtccctggcaggtggggacgcacatccgcgccaagaggaagcgggaggagctgagcaacgtactggccgccatgaggaaagctgctgccaagaaagactgagcccctcccctgccctctccctgaaataaagaacagcttgacagaagccctggctctcctgctgtccgtgggtgggtgtgggtgtgtcgggggcccgcagtcccctgtctggtgcccgctctgagccacaccctctccgggtgctgcctggtcgtgaatcaaaagccgtggcccgcccacccttcccggggcagcaggtgaggaagccgccgtactgcaaatgactttaatcattaaatagcttctatgccacactctgattaagccgactgaggtccctgggatctgggtcactggaccgagctgctcgctcggtggctccactgccaggtccgggcgcgctccccacagcgctcagttctggcccagacagggcctgacatccgccgcctgcagtcccggggtggccgtcaccgttccacggccagcgcctctgcctgctcgtccgggaaggcgatgtcgaagatctcccggtagtgttccacgaagtgcacctccaggccctcg

SEQ ID NO: 90609 - DNA, 1022 bp, Homo sapiens
tcacaggaaccctgttcaggccccagacactgcctgacctctggatgtgaggccgtgggtgtgtggctcatccagagccctgagactgctcccaccgcacggccagacttcctagataagggggtggggaggccctggctcctgctctcaggctgttggagccaaggccagtggttttgccttgagcctgtttccccgtgggagacggggaccctggtgggttttgggacttactgcttagaacccggcatcactgtgtatcgccggtccccaggaagccctttcgttcctggaggttagcacacctgctgccctcccacaggcccaggcagggctgaccctgactctgcccccaggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacggcggcttcctcacctgctgccccgggaagggtgggcgggccacggcttttgattcacgaccaggcagcacccggagagggtgtggctcagagcgggcaccagacaggggactgcgggcccccgacacacccacacccacccacggacagcaggagagccagggcttctgtcaagctgttctttatttcagggagagggcaggggaggggctcagtctttcttggcagcagctttcctcatggcggccagtacgttgctcagctcctcccgcttcctcttggcgcggatg

SEQ ID NO: 90610 - DNA, 1035 bp, Homo sapiens
caacgctggcctctacgtttgctgcgttgcgggttcctggctctgtacgccccacagggcagcccccagcagctgccagccacagaggacacgcccagggctacaaggcccagctgccgctgccctgcagacagacacaagcccttctccagcccctcccgcaccatcccctttgccctctcgcctcctttgtgcgtggtggccccaaggcccatctggatgagcttgtccttacctgtaagcctatcaaagtggcacccaaatccataaggcccatggtgtgctgccacccccatgtgtcacagccttcccctccctcagcccagaccccctgggctcccagcacaccaccccccgccagaggccgttcagagccacctgaggcccactgcacaggtgtacaaggtgggacctgcttgttctcgggtagaaatgggaatggctttggggtcttctcccgccaccacgctcacccattgcggtccaggccagccccatgaccacgccgggcggtgtcacgtcatacatgcgctccacggtgaacacgggcttccccacgaagtcctgcaggttctcgggcgtcacctccacggactcggcctcgccgctgacaatcttgtaggccgatttccgtaacacctgggcggtcagggcaacacaatgggcacgggaaggtggggtgacaggtgcggggtggtggggtgacgggcacagaaaggtgtgacgggcgcggggtggtggggtgatgggcgcaggaaagtgggatgatgggcatggaaaggtggggtgatcagcgtgggatggtgaggtgggcggcaggtgccaggagggcgggctggccgctcaccttctccacttgcttctgcaggttgcggacaccgctctcgcggcagtactgcttgatgagcagcgtcagcacgtccgatgacagcttggccttgctctcatccaagccacacagggcgcgagcctggggcaccaggtagcgctgcaagggcaaccgtcagggttgggtctggagggaccttgcccacc

SEQ ID NO: 90611 - DNA, 1050 bp, Homo sapiens
gtgtccaggccctggtttcaccatcagggacctcgttcccaggccagggtctgggggccatgggagaggcattggctcccaggttctagactgagctggtgggcaaggtccctccagacccaaccctgacggttgcccttgcagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgagcggccagcccgccctcctggcacctgccgcccacctcaccatcccacgctgatcaccccacctttccatgcccatcatcccactttcctgcgcccatcaccccaccaccccgcgcccgtcacacctttctgtgcccgtcaccccaccaccccgcacctgtcaccccaccttcccgtgcccattgtgttgccctgaccgcccaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggtgagcgtggtggcgggagaagaccccaaagccattcccatttctacccgagaacaagcaggtcccaccttgtacacctgtgcagtgggcctcaggtggctctgaacggcctctggcggggggtggtgtgctgggagcccagggggtctgggctgagggaggggaaggctgtgacacatgggggtggcagcacaccatgggccttatggatttgggtgccactttgataggcttacaggtaaggacaagctcatccagatgggccttggggccaccacgcacaaaggaggcgagagggcaaaggggatggtgcgggaggggctggagaagggcttgtgtctgtctgcagggcagcggcagctgggccttgtagccctgggcgtgtcctctg

SEQ ID NO: 90612 - DNA, 1317 bp, Homo sapiens
atcttgtggggctccaggtggcctctcccctgtggccctggagggtgcatggtgtcgttgtggccgagccaggctaccaagtgacctctgaccccgctgtgcacccacaggcggacctacgtgggcgccatgcccgggaagatcatccagtgtttgaagaagaccaagacggagaaccccctgatcctcatcgacgaggtgcgtgcggagaggcccggagaccccctaacccggcaatgccgtgtgcaagatgaagccgagccttccgggtcctaggatccccgagccaactcaggggccatcgccgtgatgctggccctgatggcacggacgggtccctcccacccacagccacgcccagcaggctgcccgtccaaggcagggtgtgggtgccgctctcactcggggtctccccagccctgaccctggggtctccccactgggcgggctggccaggggcacggcgaggggcaccacctgctgtctgctgccccaggtggacaagatcggccgaggctaccagggggacccgtcgtcggcactgctggagctgctggacccagagcagaatgccaacttcctggaccactacctggacgtgcccgtggacttgtccaaggtggggggcctgtctggggcctgggcttgctggggagggtaagcggccagtcccccagcaccttgccgccgcccccaggtgctgttcatctgcacggccaacgtcacggacaccatccccgagccgctgcgagaccgtatggagatgatcaacgtgtcgggctacgtggcccaggagaagctggccattgcggaggtaagcccagcccctccccactgctgtccccttcccagagcagggggcgccccccagagcctgcagaggccgtgcctctgggagctcctgggcccgggagagacaggtgggacctgcggccgaggagcagatggggccgtgagagacacaccagacgcttgcgagcagctgcaggtggcgcgagtgggcgcagggtttagggcctgggactgtccaaaacaccgcccaccaccgtcaggccacacactctgtctcccggggcctccaggctgccccatggtggggcccccacctggcccagagtgtagggaaggtttctggcagccggaagcagtggggcctgtggctcccacccagaatgaggcttggaggagaagtggtttcagtgaggagcatgcaggggcccatatttctcatgtgtttttttttctgcaaaggtgctgagtgcatttctcccctaggagccctttgacagccagtggtgggcactggtccctgccctt

SEQ ID NO: 90613 - DNA, 1021 bp, Homo sapiens
gagaccgtggaaaggggagaggcagagggcagaggcagaggcagaagcattttttgtatttttagtagagacagggtttcaccgtgctagccaggatggtctcgatctcctgaccttgtgatccgcctgcctcggcctcccaaaattctgggattacaggcgtgagccactgtgcctggcctgtaaattgttttatagagatggggtcttgctgagttgctcaggctggtcttgaactcctgggctcaagtgatcctcccacctgggcctcccaaagagctgggattacaggcgtgagccaccgcgctcagccccacacatgggtttcaagccccttgcaaccacccagccaagtccagcagagagacaggcagctcgtgagctccactcagcatctctccatctgtcccctggcagtgtcacccgcaactacctagactggctcacgtccatcccttggggcaagtacagcaacgagaacctggacctggcgcgggcacaggcagtgctggaggaagaccactacggcatggaggacgtcaagaaacgcatcctggtgagcccagtgtctggcctgttgtggatttgcatgtgggtgcccgggcccaggactcttgtgtgctgtgggttgagatttcaaaggagccccctggtgaattcgtaggcctgggggtgctggtcggggggatcccggcggaggtagcatcctgccctgcccccgagggctcgaggatttcccaggtggactgaagtcatgcctgacgggccgggcatggtggggctgcttgtagtcccagttactcaggaggctgaggcgggaggatcacttgagcccaggaagttgaggctgtggtgagctgtgatcatgccactgcacatcaggttgggtgacagagtgagacccccatctctacaaaaaattttaaaattgcggctgggcgctgtggctcatgcctgtaatcccagcactttgggaggctgaggcatgcagatcacctgaggtcgggagttgaagaccagc

SEQ ID NO: 90614 - DNA, 1077 bp, Homo sapiens
acaccggctaatttttgtattttagtagagacagggtttcaccatgttggccaggctggtcttgaactcctggcctcaagtgatccgcccgcttcagcctcccaaagtgctaggattacaggcgtgagccaccgcgcctggccccatctctacaaaaaattttaaaattagagccaggtgtggcaggtgcctgtggtcccagttactcaggaggctaaggcaggaggatcgcttgagcccaggaggtggaggctacggtgagctatgatggtgcctttgcactccagcctgggtaacacaggtagaccctgtctcaaaaacaaaagaagatggaaggaaccaaaggcttcgtgctctgggtttcgtttcttttctctctgagtcctgggggagcagagggtcccccttcgtctggggacgcacccacccacccagcttcccggagccagggcctgatggcagcacctcaccccacaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaagtgagtgccaggcccggggcggcccagccctcaggtgacccctcctcagcccccatcttaggcaggccaggggacccagcggggagccccgtggcaccttcttggtgtggcaggtgcgggctgggaggcatccagcgagtatcagccctgttctgggcaggacacatcatcaccatctccattctacaaggaaatcgaggctcggggctgttgagctggtggccagggcctgtgaattggcaggtggtgccacggatttgagcccagggacgcctggctctaagccagggctgcttttttttttttttttttttgaaatggagtctcgctcagttgtccagactggagtgcagtggcacaatcttggctcactgcaact

SEQ ID NO: 90615 - DNA, 1049 bp, Homo sapiens
agccaagattgtgccactgcactccagtctggacaactgagcgagactccatttcaaaaaaaaaaaaaaaaaaaagcagccctggcttagagccaggcgtccctgggctcaaatccgtggcaccacctgccaattcacaggccctggccaccagctcaacagccccgagcctcgatttccttgtagaatggagatggtgatgatgtgtcctgcccagaacagggctgatactcgctggatgcctcccagcccgcacctgccacaccaagaaggtgccacggggctccccgctgggtcccctggcctgcctaagatgggggctgaggaggggtcacctgagggctgggccgccccgggcctggcactcacttgaactccgaggagtggttgtccagcaggcccagcttgctcagctcctcgtccacaacatccatgacgtgcttggggaccacgagctccttcaggcgctcccggaacttctcctcgatggcatccttgtcgtccttctccaggcccagctccttcttgatgatctttagctgctcctgcagcaggtacttacggtgggtctgcttgatcttctcctccacctgtggggtgaggtgctgccatcaggccctggctccgggaagctgggtgggtgggtgcgtccccagacgaagggggaccctctgctcccccaggactcagagagaaaagaaacgaaacccagagcacgaagcctttggttccttccatcttcttttgtttttgagacagggtctacctgtgttacccaggctggagtgcaaaggcaccatcatagctcaccgtagcctccacctcctgggctcaagcgatcctcctgccttagcctcctgagtaactgggaccacaggcacctgccacacctggctctaattttaaaattttttgtagagatggggccaggcgcggtggctcacgcctgtaatcctagcactttgggaggctgaagcgggcggatcacttgaggccaggagttcaagaccagcctggccaacatggtgaaaccctgtctctactaaaat

SEQ ID NO: 90616 - DNA, 1026 bp, Homo sapiens
ctgtgcgggcagctggccaggcgggggcatctctgcagctctttctgcagctgggtgggtagggggcttcctcagcgtcctcctgggaggaaaccttgcctgccccaaggagtggcctgtgtggaggagcccgttgcccactggggcatggggcaggtgggaggcccggggccgactcagcaggcccagtttctttgtccccttctgctgaggccggaagctgttggtggcattggctgggggagtggggagcagactgctgaggtgaggtcactgcacggctcccgtggtggctgcacgtgaggatgctgcatgcctttccagcccaggacgggtgggccctgaactctggagaacaagcagcagagctggctcccagcgagcacccctagaccgtgcccatagctacaggggacagggaccctgaggaccgggtccccgtttgggggctgcactgcagcagagcgtgaggccctggccaccgaggcagctccctttgtcccccagggagtcagtgctgcagatgatgcaggctggccagcgggtggtggacaaccccatctacctgagcgacatgggcgccgcgctcaccggggccgagtcccatgagctgcaggacgtcctggaagagaccaatgtgagtgctcgtcacctccacagccccccacgcctggctgcaccccacctccactatgctccgcccacgcccggctgcccccgttcctcctcagctcccccatgcctggctgcccttgtccctccaccgtgcaccatccacacccagctgtgtgtccctggctctgtttttgagatgatttcccgctgcgtgtcttggtccacatccatccgcctttcggtggcttcatagccttcggttgggagtcaccgttgcgggttcagtgggatcctctgggccgtgtacccggggcgttgccagtcttttgctgttgtgagcagcactcctgagcgcgtccccatgcacgcagctggagggcctgtgaagtatccgtaggatgcgtttccagc

SEQ ID NO: 90617 - DNA, 1049 bp, Homo sapiens
ggacagtctttgcgatggtgtccttgaaatcgagacctgaacaacaggaaggagctgctatgagctgagtccagggcacagagtcttggagaccagcctgtgcccggccaggctgacaccgttttcgacaggaggccctggggcttgtcactgcagcttatccacgatacttaggatggggacagtgatgcattggcgtgggatgcagggaatgcctgaatctggctggagtctaaggggtggaggggacactggttgggaggccccgagaaagcggctcacgtctccagcttgaggaccctgtagccaccctgtggctccagaggtctgggctcagcgggacccttggaccacctgtgccaccagggaggcctcagccgggtccagctcccagcctcagcggctgattcacacctgccttgctcccgtgtcagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagtgagtccgtgcgtcacgcagggcggccacagctgcctcccccacgggctcccttgagccgttcctgcggcctctccgaagagtcatctcccaccctgagccccttaggaagggtctggcctgtctggaactcaattctaatggaacatagagggtgcttttcctcccagaggtcttcggaagactctgggatgggagaggcacaggaaattcgctggagcctgtagctgctcaggaaggagacagggttggaacccaggtccagccccagcccgtgtcccctgtgccaaagcctccagcggttaccaagacaccttccagccctggcttcttcccaccaagcctgggaggttggtaccagtggttgcaggacaggaaacagc

SEQ ID NO: 90618 - DNA, 1050 bp, Homo sapiens
ctgaggcagagaattgcttgatcccgggaggcggaggttgcagtgagctgagatcatgccactgcactccagcctgggtgacagagcgagactccgtctcagaaaaaaaaaaaaaaaagaaaagctaccctgtgctgcgtttggtggctcacgcctataatcccggcattttgggaggctgaggtgggtggatcacctgaggtcaggagttcgagaccaacctggccaatatggtgaaaccccatctctactaaaaataaaaaaattagccaggtgtggtggtgcatgcctgtaatcccagctactcaggaggctgaggcaggagaatcccttgaactcagtgggggtggaggttgcagtgagctgagatcacgccattacattccagccagggcaacagaatgagactctgtctcaaaaaaaaaatctactctgcatttcactttggggtcattgtcatgctaggttaaaaataagaagttggttgagctgctgagaaggaaagttcgtctcgcccagccttatgtcggcgtctttctaaagagagatgacaggtaagtgtgatttttccttcattcccttgttgacggtgccctagagtccagctcaccacaagtcctactctgtactttgcacctttgacccctgaccccgaggaaaccagggaagacctccagaataaaggccagaagccacgcaggctaccttttcagcctgggctgagaactcagcttgtagtactaaacttcatgcattgttaagatacgggggaaattaacttcagggactcttagtgatgaaatgctccatgaggctacctgaaagtcgagctagctgctcggagatgtggctccatgtagaaatgagttccatgggccgggcgtggggtcgcacacctgtaatcccagcactttgggaggctgaggcatgtggatcacctgaggtcaggagttccaaagcagtctggctgacatgatgaaacctcgtctttactaaaaatacaaaacattagccaggcgtggtggcaggtacctgtaatcccagctactc

SEQ ID NO: 90619 - DNA, 1025 bp, Homo sapiens
tgcacaggctgctcatgagttcctaaacgttgcgtttgcaacactaccagtgttttgtacgggcgctggcgcctgctcacagccttccacgtgaccggaaaaggccttcagcgcataaagtgggagaccggaagaggcggagacgatccgatgctcgaactccgccccctcttctccgcgtaggcccagctccctgaagcggctgtttcgagccacgcgcccatcgggtaccgaggcacgcgccgggcgtcacgtgcgtttcgcggcgagcggaaatgacgcgagttgtgtgagccgccagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggtaatgggagtccccgcctcggcctcaggtttcccacctgtgcaagcagcgggctgaaccgtgggatcacttgagcgcccttgtgtttcgcaactttttcagacatgaagtttctcgaagggtgcagttcgaatccttgtctgctcaccactagcttgggaaccttgagccaaagtcctctccctttcggatttcttaggatccgttagatgagaggagttgaacccgatgagcctaggattatccactttagaacgccggtcatagaaatccggggccggga

SEQ ID NO: 90620 - DNA, 1707 bp, Homo sapiens
tgcaagcgcttcggggcggatgtgacatgtggagagatggccgtctgcaccaacctgctgcagggccagatgtccgagtgggccctactcaaacgccaccagtgtgaggacatctttggcgtccaggtcagtgcccaccccgagggagggagagtggaggggccctcggccgtcctgtctcagagccaggttccaggtctgccctggttgcctccctgaccccctggcctcagctgtggagtgggggtgatgccctgatccacctctgggggctgatggccgtggccggggaccggtgcctcgcagacagaccttggctccttccggggaggccccgagagaggaggccactggctcagggccccccagtggggagggaacggccaagtggggacagttcggactctcccctcaccctcctgttctgccactacccacctacagctggagggcgccttccccgacaccatgaccaagtgtgccgagctgctgagccgcaccgtggaggtggactttgtggacatcaacgtcggctgccccatcgacctcgtgtacaagaaggtagcggccctggacgtgtgcctcggtttccccatctgggcagggaggcactgacccagccggcgatgtctcggtggagggtcaggggtttgggctcaagtgtggccctggagtccctgcctttcctgcaggtcggcgtctcctggtgggggcctccgggcagcaggggtgaggggtcttgggtcagcccacgtcctgccctccctccacccgcctgtctcttccagggtgggggctgtgccctcatgaatcgctccaccaagttccagcagatcgtccgtggcatgaaccaggtacggccagccacatcctcgcactggctcccaaacaactcccccgggccctgtctcccaccacctcccaccgtctcccaccacctcccaccatctcccaccacctcccaccaccgtcctgtaggtgctggatgtgccgctgactgtgaagatccgcacaggcgtccaggagcgtgtgaacctggcgcaccgcctgctgcccgagctgcgggactggggcgtggcactcgtcacggtgggtcttgggacgcctcgggcattggggcctcgcggtcgaccccgcgtcccttcctaatggctcctctcctcccatccctccctcttcacctccacacctccctctgtctccgcctgtgtctctctctgtctctctcagcctggctctcttggtctcttcctctctgcgtctcactctctgcctcctaccctgcgtggcggcttctcccccagctccacggccgctctcgggagcagcgctacaccaagctagccgactggcagtacatcgaggagtgcgtgcaggccgccagccccatgcccctgttcggtgggtgttccgggaagccacctccctctcccctaccacccttggtcactcacacctctgggctgttcgccttcccacttgggaccccctcgtaccaccctgatgggagccactgggtcagccaaaactcctgaagggctggtgagcagaactccagggtcccacctgcccatgtctccctgagaccccagcctctgtctcctcaggaaatggggacatcttgtcatttgaggatgccaaccgcgccatgcagactggtgtcaccgggatcatgattgcccggtaagtgcccagggatgttagaga

SEQ ID NO: 90621 - DNA, 1023 bp, Homo sapiens
gtttcctcgcaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcgggtacgtgttgaggacaacgtcagtagcagatctgtccatctggtgtgcgtctattaaataccagctgtgtccacgttcctgttctagctgcctgggagtcagaggctgtgtgccttgagggagctcctggctgagtctccctctctgtgctctgtcctgggcccagccctcaggaggtggggacagaaagagctggacagggccgggggcggtggctcacgcctgtaatcccagcactttgggaggctgaggcaggcagatcatttgaagtcgggagttcaaaaccagcctagccatcatggtgaaaccctatctctactaaaaatacaaaaattagccgggcctggtggcgggcacctgtaattccagccactcaggaggctgaggcaggagaatcacttgaacccaggaggcggatgttgcagtgagccaagattgtgccaccgcactccagcctgggcaacagagcaagactctatctcaaaaaaaaaaaaaaaa

SEQ ID NO: 90622 - DNA, 1112 bp, Homo sapiens
agtgcctgtctgggaaaaggtcactggacctggaagggtccccagggtcccctgactcccgtctccatctgtcacgtggttcaccatcatcaggcaccaggcgcaaactgcttcccgctgttggccatcccttccccagccacaggtgtccctgcccccaggacagtccagggccaggggcttctgtgagaggcagagggggaccctcaccaaatcttggtggaagagcccaggggctggtcccagaacaggcagtctcacaagcacgcagcacactggagtggacgcctgtgcccacccgagcctggagcatggccaagagccagcttgcaccacccacctgggaggccgaggaggaggtcccctgggcacagggcctctttgggacttcagaggaaatctcccagtcccactctcggagggttaagagaaggcctcctgcagctgtgccgtccacacctctaggtcgccagagccctggcccccagcccccagcaagcctgagcccgggaagaaccagaggccctcccgagagacccagtcacacgtctctgctttaagccttagccagctagtgacgagtacaacgagataacgcccatgtgttttggaacatttatgtaagattgtcatatgaaatgtatttgggaactacattaaacttttaactaaaaccctggcctctgcatgccccaggggcctcaggaagcccctgaccaggaacggcctccacctccccgggcgaggacctccagcagcctggggcctcatgctcccacccagcgtgtcaccagtgctggggtccagccacagccctgttctctccaccaccacccgcactttacccccacccctgctgcaaggccccgccggtctgcccccgcccagagctcccagcctcgggccgctcaccagaatgtagatactgggcccgctggacatgttacctgctatttttattccccatttgccatcttctgattgggggttgatgttttacagatttttttttcaaaggctttatttcagtttctgaggttaggatgcccctgtgcccctcgctccacacctgggcaggtctaaacttccttccaggatggcctccacacaca

SEQ ID NO: 90623 - DNA, 2194 bp, Homo sapiens
atgtctcacacacacagaaagcgcatgcaccttgagtgtcagcccctgcctcccgcagcccaccccgtactcctctctaatccccccttctccaagggaactgccatcctggtgcccacctgtgtggaccaaacacaacctcccacaagctgcatgtggcctctggtcactgatctgcagcaccagcctgtgcagccacctgcagttgtggccttcagtggtccaggcttggggaggaggagccccgccccgggagcaggtgtgccagggctggcctcagggagaagtcttgctctgtgggtgggtcctgggaggatcatgggcttttgcgcggtgatgtcgctttccatctggactgtgttggctcttggagctggctgtttgtgagggggccggtgtgggggccagggctgagtggccttgttggttgtagtgatgcggacccaggggagcctgcgactgatcctcaacaccaagctgtgggcccagatgcagatcgacaaggccagcgagaagagcattcgcatcacagccatggacaccgaggaccagggcgtgaaggtcttcctgatctcggtgagccagccacgcgggtgcatctgggacccctcatcctgccagccctgtgggggttcctgggcacacagatcaggcaggacggtggggaggggaggggggaggggcttcagttgcttcctgggacacaagaagcactatgggacccgccagtcccagccttcaggaatagagatcatggtccttgtcctcttctcaacccagagaagccgctggggtttggctgaggggttgtgatgtgttcagggctaacagccctgtggggcggtcacctctctcctatgtcatggtgtcacagtcgagtccaccaaccctgacctctgggatattcccagccacctgggagtggtggcatcctttcggggagaggccggcaggcccagggccaatggcctccccacaaggccttgtggcagtgtcacctctgaaccttgggacttggcacttgtgttctgcagaaggcaggagggggtaggactggggtccgggggtctcataccctcctcccttcccaggccagctccaaggacacaggtcagttgtatgcagccctgcaccaccgcatcctggccctgcgcagccgcgtggagcaggagcaggaggccaagatgcccgcgcctgagcctggggcagccccatccaacgaggaggacgacagcgacgatgacgatgtcctggctccttcaggggccaccgcagctggtgagtcgggtggtccctaccctgggggggatagaaagagctgcccgccatccttgatccagtgctgatctcctggcgggggtggccagacctgggaagtgcgggctccatcctgatgcggggctgctgcttccctgcaggtgctggtgacgaaggggacgggcagacgaccgggagcacatagcggccgggagcccggctgcacaccaggctgctgctttgtccgtctatccacccgcccacccgcccccaccccaccggcagcgtccaggtgcggggccgggaaccacacaccccactgggccggccacagtctggacccgcacgtcctgttcaaaagcagactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccagcctctgggtccagccagagcccctggcttctccgccacccacacccttcccaccctgctgtggggccctgcctttgtggggagcagccagccctctgcccctgcccagggctccccaactataggcctgggacccccgcccagcttggggggctgctcgtacgagtgtagacactgggcccattggacgtgctgttaactactatcttcatttcccacttcccctctctgattgggggtgtatattttacatctttttttctttttattttcgaaggctttgttttggtttcttaggttaagatgctctcgagcgttgagcaggcacagctctgtcgaggtccctgtcccccacctgtggttctggcctctgaggttgggggactacttgtttcccacccc

SEQ ID NO: 90624 - DNA, 1069 bp, Homo sapiens
ctctgcttccttgttggtcaaacagggtccctaacatccccctcccaggcctcgtgaggattaaagcagatcgtgcatttgacagactcagcatagcagctggtaggaaagaggccctcaagaaattctgcttctatcatgttcatagtaaaccccccaaaacgtcagctttgtaacgttgtgttattggtatgaagcattgaccgagaggccagcttaggcgtggttttataacaaggcgtggttttgtaacaaggtggaaaaggctccttggagcttcatgagctctctttccatcctaactgttaaagcaaaaggtgatggagttgattatagccctgccccccagcacatgcacgcgcacacacacaggcgggtacaggagagggttcatggctccgagcagctccatgcagctcagggggtctgcagacactgagctgtggaactccaggcacccccccacccccgattactgagcgctccgtctcattcccagctgataaatgagagcgtggacgaagccgacatggagaatgctggacaccccagcgcagacacgccaaccgcaacgaactatttcctccagtatatcagttccaggtgtgtgtctcggtgtcagcggccagcctggcatggcgatgcaggtggccgcgagggcttctgccagagaggggtctgtggtccccgtgcccgactcaggcccagaatccaggttgctctcaggcccctctctctcattccccactctgggcacaaccttgggtgggccagggtggtgggccttgtcctgggattcactggacgcctgagacaggaccagagttctgtggggttgtccaggggcccatggaggctacagcccagcccttggagtgtgccctctgtcttgtggacctcatgcccagagcagaacagagcaggccagaggcgactcaggcgcccccttattctgggtttgggcacctggggcaaagacctcatcatgtccttgactgacatggctgggggtaatgctacccacggaccagctgcccctccaggtgtctcagaagaaagcgtgtcccga

SEQ ID NO: 90625 - DNA, 1080 bp, Homo sapiens
attcacccccctgcccagctgatttttatgtggttgggttttttataaagacagagtctcaccatgtttcccaggctggtctcaaactcctgggctcaagcgatccttctgcctcagcttcccaaagtgctgggattacaggcatgagccactgcacccagtccattttaagtccttttgttttttttttttttttttttgagacagagtctcgctgtgtcgcccaggctggagtgcagtggtgtgatctcggctcactgcaagctccgcctaccgggctcaagcgattcttgtgcctcagcctgtagctgagattacaggcgtgcaccaccacgcccagctacttttttttgtatttttagtggagacagggtttcaccatgttggtcaggctggtcatgagcccattttaagtcttggttgctggttgttcacactctaaagctaaagtttgtggaatagggaattcttcaggagccttccctcagcctgtgactgggctttgtctttgatggttctgttctaaacacttcgcaagtgggctttggtccaaaacatccaagctcttgcttgctctgggaataacagccgaccctgagacaagcatgtgcatggtagaatgttccagggcaaggaagggaaatcgctcctatccggtgtgatgtgaccattttacacaagtccgctgccctcaagggtggagagggtcgcttttcagctcttggcagaatgaacgggggccagatgaggttcggctgtgtttgagtttaggggtggcaggccagttagcgtaacctgtggagaaacaagaaactgatctgggtgctgcggatgctttcccagccactgagaggattccttggcatgtgtttgtgaagctgggtgcagaggttcatcggggggatgtttgagctttaggctaaaatcctggctctcattcgggtgctgggctctgggaactagctgcccgtggtgcatgttgggatatttgttacggccccgagagttgctcggctgccgtgagcctgatgccctctgaccccggctgtgtgctccttgtttcagaggtcagctggcggc

SEQ ID NO: 90626 - DNA, 1054 bp, Homo sapiens
gtcacgagcattataatcatctgctcccagcgtgcagggcactgggctgagcaccttacctgccctgcctgtcacctcacgcatccctgttttccaggtgaggagaccgaaggctgggcaaggtaaggtttcacccgtagaaaatggcagagccggaatacactgagttcttccggccttcaagaggcagcagggaccaggcagcctctgcacccctcgtgcttttggcctggccggagttggtactgactctagggcctggctgcttgatggcattgcgttttggactcagtggtattttcacaattgccccagtgactaatagaacccactgttgtgttacaaggattttgtgtttcccacacactttgatgatgtcatctcgtggggatagtgataatcagccctcactcgtacagtcccttgggagcatttccaaagccccctcagaacacgggcctcaagcaagaagcccaggcttgcttttcccacacaaacccatgttgtcagctcacacgggaggagaaagtccagggtagctttttttctgaccgtcgtgaacgagctatgtgacttcaagtcaacttcctaccttctctgggctctcactgccacaagctccaggcctgggcctgtaagctaagatgatgtttacatttttaaaggattataaaagcaaaaacaagaatatatgacagagaccaaatgtggcccacaaagccagcagtaccgacagtctggccctttatgggaaaatgcatcgccctgacttgaggggggtctgccttggctcctgtgctcctcagttttatttattgcagtttgctttcccaggccactctgcagtttgcaaagcactttcacatgcatcacctcccctaagccccagcagctcgtcgaggcaggcgggcctcatttggctaaacttgacctctgaggagcattttagaaaataagaaaattggcttttctgcttgctcttgcagggagcgcgccaggaggagcggccctcactcatcggtgcgctttgggctgctaaattctgagacaggac

SEQ ID NO: 90627 - DNA, 1047 bp, Homo sapiens
tgcgtacttctcacagaggcccatgttggagtgtctggaggggcctcacctcgtccacatgttcatctctttggcctggccagcccaggtagatctcagcatcctgattctcatggactttgggtctgaggctctgatcctgagaaattcaagcagtcccccacactggcaggtggaaggtgaagctgtatggcagggagccttgggatgagcttgtgggcaccgtgggagagccaggattggaggctgcatagagcagtatgtaaatgttccaatgtagctctggtggccatgtgcataacatgcaccttgtagttttagcactcgtaacttttggacacccactttcaggagccccaggagagccattgtcaagccccttgtgacagctctgagctgaccagggctcttccctcaggctgtctgcagagaacaccctgactggttgctaagggctcctgttaattggctttctctactaatcgggcctgctcagagcaaagtaaactttattttaggttagttaggccatagatcaagtcagatggaacccgatgccaactgcttcttggcctgagcctttttcgtgtgtgtgaactcagaccgttttcgtttgcatcagaagaaatttgggtctcactctgtatcacactggtgttcaggaaaccacccccatgttacccggcaggtctcatccgtcacatctagtctgttcactttattccatggtccctggggggaatataaagctgagagttcttgatgataaacagtggtgcgctgaattgttacttgtaaagggcccttaccatcttttagtctcgtcagaaccctggccatggaagagtcagtaccaggaaaaagtctctatatatcagacttcctggctttcagaagacagtctgaagaagaccaaaccacatcccgattaagttctctgtttgatgtggagaaagcaggcagctctgggcactcactgcgagcctggtggaattgtactggactgaagctccctgccaaggacctgccgagcttcagatatgttta

SEQ ID NO: 90628 - DNA, 1521 bp, Homo sapiens
gatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctcc

SEQ ID NO: 90629 - DNA, 1381 bp, Homo sapiens
ggctggagtacagtgtggcgcgaccctagctcactgcagcctcaacctcctgggctcaagcaatcctcccacctcagcctcccaagtagctatgtcctgccttttgacttagacacaaaaccgtgcatataagcatttgtgtattttactgaatttccatttgtacctccctcaataagggatctcagtacatgttagctcactgctcactacagaacacagggctgtggggcccccgagtcttcttcaatcttcctgttcagcaacagaatttctctccattcctgtatgttggggagcgatttggtgttaaagcctgtgtggtgtgtgggtatttcatttaagggactgaagacagaagctaatagttcctgatcacacccagatgtttacaaattaagtccaggaacctgaaaaccaggctaaacatgaaagaatcaataagcaaaagaaaatgagggattcattaatctgcttagagaactcaaatcagtgaccataaagatggatttctggccaggcacggtggctcacgcctgtaatcccagcactttgggaggctgaggcaggcggatcacctgaggtcagtagtttgagaccagcctgggcaacatggtgaaaccccgtctctactaaaaatacaaaaactagccagatgtggtgtcggacacctgtaatcccagctacctgggaggctgagggaggaaaattgcttgaacccaggagacagaggctgcagtgagccgagattgcgccactgtactccagactgggtgacagagcaagactccgcctcaaaaagaaagaaaagatggatttcctcatcccatttggtaacacagggaacgcaagtaattctcttaatgagtccacgttggcatgttagcgttcctcaggcttctgacaaacgcagacgtgtctttctttttacagctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggtgggtagacgatccccagcccacctgttcttcctcttcctttcccaagaaatggagcttttgggaaaatgcgaggcttcctcctcctttccaggtggcctgattcgcagccacctctggagtgcttgcagttactttcaattggcggcagccttggctgtggccaggtgtagcccacggtgtcggctttagaagccggtgataggacgtggggatcactctggttttctctctccttttgaaatttcccaaacaatacttttctt

SEQ ID NO: 90630 - DNA, 1036 bp, Homo sapiens
ccggaggggctgtcgtctgctctgggcccaggcggccccacgatggagtcgggccagcctcagacgggccacgcaaccataggcaggcctgcagagttctttgaacttcagttggccattggtataaagaggaggacaagccatgcgtcatgggctgttgtgaaaagggaatgagtcaagcatctctccactggtggatgctgcagcctcctttgctcttattattgttatcgttgttactatcaagcttttagaggcgtggatcaatccatccatgagacacctggactgaatcaagcaggggaagtttccctgcagcctctgccgagttctcgctgccatgccccgatgcaaaataacgacttatctgcttttccagagtctctacatttaaaactcgattacccgtgtttacttttcatttattttccttcttaaattaacacaaagtaaaatcaactttttggtgtacagccttgtgagttttgacatgggtagatttgtgtataatcaggtcacagaacagtgcattgccctgaaaaccccctcgtggtatttcttggcagtcacaacctcccccatccccagcccttggcaactgctgatctgttccctattgctgtagtttcatctttactagcgtggtgtataaatggaatcgtacagattgtgaccttttcagacaggcttcttttactcattctggtgcctttgagattcagtcaagttgctgcatgaatccgagttgcttttttttgttactgagtaatattctattacactacagtttgtttattcattcactagttgagggccatttggatggtttccagtttggggtgattatgaataaagaagctctaagtttcacatgcaggcttttgtaaggacatatgttttctttcttttggatatatacctacaagtggaattgctgctggctcatacagaaagtgtatgtttaactttatcagaaaccaccagtttcccaagtggttgcaccattttgcattcccaccagcaacatacaagagtt

SEQ ID NO: 90631 - DNA, 1010 bp, Homo sapiens
ttatactgcagaagcgaggggcgccacagagtgctctcccacgcagtggtgcggatggctatccagagggccccagcagtcccctctgtactagggacgatcagtgtcaccttgctgcagactacagacccacagaggcaaagctgcctgggcgggtgaaggtgcatgtgcttccgtgtatgtgtgtgtgcatacgtgtgtgtgtgcccacaattcgtgcatatgtgtggtgcatgggctgagtgtatgtgcacacttgtgtatgtatgtgcattgtttgtgtgcctgcacgtacctgccgtgtgtctgcccaggtcggtgtgagtgtgcaagtctgaccatcaccccgccgtcgcctctgatcagtcctgcctatgttttaataaaaagcacatgaacagacaaacagcatcttacattctgtgtgtatcctcagcactgacctctgacaagtctaactggccttctctcccttcccttttagagggtgttggtccaggcagccagctccaatcccaaaggggcccagatgcagccgatctccctccccagagttcagcaggtaccccagcaggtaatgacaagcaccgcagcaccgtgcaaaccggggcgcagttagcactcagcaatccagaacaatctctgaaggatgcatccttttctgtggctgctgttccttgttgtaagcttcagtttcttagccaaaagacttttccagaagctgtgcaattttaaaaaaatcatttactgcagatagttttgcagaaagccaagaaagctggtgatctttcgttcattcagaaattcagcaagcatttggggaaccagtgagcaccccgcacctgctgggtggagctcaggtagaaatgcagacagaaacaaagggctctggactggaggaaccatctgctagtgagtgccataccctcagatgcgggcacaacagaggaaatgcttcttatgatttcaattatctaagaacaaagtttgaaagcacggctgaccagcca

SEQ ID NO: 90632 - DNA, 1233 bp, Homo sapiens
ctagatgtttctacagggcacagagggcagacaaagtggggaggccagctgtccctggagctgaggaaaggtctgaaaagaggatgtggatctgaactgcatcttgagaatagtgttctgcaggcagcagatgggggagaggggtgtggccatgttttcaggactgggcggcccatgttttcatgtccccgtgaatgtgatgactatacactatataagtggaatcatagagtatttgtgtttccgtgactggattatttcacttagcacaatgtcttcaaggcttatccatgctgtagcatgcatcagaatttccttcctttttaaggctaaagaatattccattgcatggatatgccacattgtgtttccccattcatccatggatgaacacttgggtggtttccaccttacagctattgtgaaccatgctaagcagagatctcaaagggactcttaggtagagggagaacctggacagaggctcaaaaggcaaaggaggaaataacttcaagaactgagcaccatgaagagtgagatccaatggcaaccagaaagattagacttgcccaagtcccatgtgaaaaaggattgggtccccacagaaaggcagaaggcttgactcatgaacgcctgtctcctggaaaactgttgaaattataccaatgatatagaagtccattcctaaagctgcaacagcacttaattatacttttttaaaaatgcaaactgtttatcttttagaaactgtgccatgtttccaaggatacatttctgtccaaaaggtgatctgtggggaaaggccttagaagcagtttccaaaaaaattaccagcccacaaaaatgtatgcgggctccacccaggccagtggaaacccaaagaaaataacacgaaggcctttttcccacctctcctgtccttctcagaatacatacagacagatgtagcctgccttgagaaaaaatatatttggaattccagacccactgaaaacagactaaaagatgtgcttctgattttaaaaggaattattcgttttcttgaagaattcaccctactagggacttcagtgaggagctctctggggtctccatccatttctttagaaaatatttgtgggcctgaaatatcaaacatctgaggagcttataattagttaagcatttacgtgtattaatatatcgtcatgtggacagttgagaggggagaaggcactagacaaatttaaaatt

SEQ ID NO: 90633 - DNA, 1015 bp, Homo sapiens
ctgggggtccgtgaaaaacaggcggcgagcgagagtttgctgacccctgatcagactgttcccacatgtcccacactcctcctgtggggtaaacggagtcccttgggtcccctaaaactggactttcccaaaacgcgccaccaacccacggcgccgcgcgcgcgaccggttcgccaaccctctgagccgcgcgcgcctcccgccaagacccgcccctcttcgcggccattggccgagtctcgcactctttttcaagggggaacgcctcctccttccgacagactctgcagacagccaatggaacgccgtagggtctcgcgccccgccctcttgggggcccgttggaggcgagcgtgggcgggccgttaggaaggtggggcgcggagcctggtaaccgttgccggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccaggtgaccgatgcgaccgccccgggcccagcccggccggggagtgtggggggcggcggggaccccgttcgggggccggggggcgggcagcacgtccccgccgctcaccccaaacgtccgggtggtgcgcccgcgggacccgcctccgccaccccgtccgcgcgcgcggcggagtttggggggaccctggcgacgtccccactttccttattgactgaacgcgggggaggtgcggtgccgtcgcctcactttttacaaaacttcctgaggttggggcgtccggggacccctttctcacgcttaccttcaaactcgctgagttgggggcgccccgggaacgtctctcaaactcctcaaactccctgaattgggggcgcttggggaccctcttctcaccttaaccccctaga

SEQ ID NO: 90634 - DNA, 1079 bp, Homo sapiens
ccaccctggacctcagaaggccctgcctgtgtgtctgcgtcgtcctccgtgtagacctagcgccggctcctccccggctcgcgctgcgctggggtctgtgctgtatagttctctctattatatatgtgtgtgcactgtctggtcaagagcagtgtccatgtgcgtttctgtggcagcagtgcacgtggggtgggtggggggtgcgtacggtggggcttgtaggttaagatgtctctgcggtggtgtggggctggaggccgagccaggcacggcagctggccctctccaggcgcatggaggaattctccctttgccgttccaaggatgccgccgcctcctaccggggctcccgggggggtcagccaacactacaaagggcagcgagtcctcagggcgcccgggagccaccagtctgctctcgggctctactcagactagcgccaacagtctccgcggacagactcgcatcagccgccctggggctcggcctcctcccataggctcctcttcctctctttcattcaagtcttcaaactttgaaaaaaatatgagcttttgccaaataagacgggatagtttatggagttttctgaggcgcattgaactctggtcagcccctcgagcgtgggctcggccatcagcaggcccggtgggttggccgggctggccctcccaggctgcctttctctctggtcgcggcctggcccgccccggcctccaccgccgcaattcatgctggtgccgcgcccgcagccccactcctggtatgcctgagattctccaggggccaagccggtcctccttcccggcccactcttccagggccaggacgctcccgcggagccagcccatcgtggctgggggtcccaggggctggaggcctgcctggttagcctctgtttcccagacattgactcgaggcgcctccagtcctctcaaccccctgactttcaagtcctttcaagtccttgtgccctgaccaagttatgaggaaaagagggctgagggcctggaggtgggctcgcaccccctcgaacccacctagatgtctcctcctccccagcctatgagttcagact

SEQ ID NO: 90635 - DNA, 1198 bp, Homo sapiens
gtggggccttcggggctggggagggtgtgggccacagctcagcagagacctgggttccctgcaggtgtcaggccggaggagccccgagtcctgcagcaagcctgagaagatcctcaagaagggcacctacgacaaggtgggggggcacctacgacaaggcggggaggctacggaggggtgggtggtgggagttgcagccagtggaggaccccagagccccccaacaccccacagttggactcttcctgggcaggagcagggacagtccttcctcccctcccggtgtggccttggagctgaggggctgcccctgcagccttgggccttccttggtttggatgtggctacctctgtcctgtgctgggatggactgggtcatgggtggggctgggcatgggagcaggaagggtccagggcccccacacgctgctgagacctgccccccctccccaggcctacacggatgagctggtggagctacaccggaggctgatggcgctgcgggagcgcaacgtgctgcagcaggtatcgcccccctgagggtcctgcccggcagaggtcggggtgcctgtgaggagtgtgggctgcgggggcccctggtgctgccccaggagcccctacctctgttagggaacagggcaaccccacccttggccccctgcccctgaagccacctgccaccaccttacagattgtgaatctgatcgaggagactggccacttcaatgtcaccaacaccaccttcgacttcgacctcttctccctggacgagaccaccgtgcgcaaactgcagagctgcctggaggccgtggccacatgaccctgggccgcgtgccgggcccccaccgccggggtcctgggaggctgcagccaggcctcgcctgccctcctctcccgtctcgcctgcccgcagcactgccttagcgacagccctgtcctcgcccgcacagcccgctgcactttcctcggcggctccctgcccactctccccgctccatcgccaggagccctggggccgggctgggccacacgggagccgccccccgggctctctgggctcccctcagagagcggctggtgttgaaggcagctctgggcagagacagggccgggggcccctcgcccagccttgggaccagcccccactgctcggcgggctgtgcggcgtcgctgccccagcctttctgagcagcggatc

SEQ ID NO: 90636 - DNA, 1165 bp, Homo sapiens
gtcaggggtggcggagcagggcgccccgcaatgccacgtgaccttgtctctccccttgccctccctgctcttggccttgcaggacgccaacaaggagagcagcaagacctccaagccacacaaggtgaccaaggagcaccgggagcggccccgcaaagactccgagagcaagagctcctccaaggagctggagcgtgagcaggccaaaagctccaaggacacctcgcggaagctgggcgagggccggctgcccaaggaggagaaggcgccaccgcccaaggctgccttcaaggaacccaagatggccctgaaagagaccaagctggaaagcacgtcccccaagggtgggcccccacccccacccccacccccaccccgggcttccagcaagcggccggccaccgccgactcgccaaagcccagcgccaagaagcagaagaagagcagctcgaaggggtcccggagtgctccaggcacctcgccccgcacctcctcctcctcctccttctcggacaagaagccggccaaggacaagagcagcaccagaggggagaaggtgaaggccgagagtgagccccgggaggccaaaaaggccctggaggtggaggagtccaactcagaggacgaggcctccttcaagtccgaggtgagtgagtgctgggggcagggcagccaggtgcaggcagtgtggtgggacccgcctcccttctggaacagcggaaggaggtgggatctgagccaggacctcaggtctcaccagctgctcctcccactggcttcttgtaacctggggcctccacgcctcactaggcttcggtttccctgtctgtcaggtgataaagtctgcctcgtgaggagtccctcctcgcctcctcggtggcatttgtgggtggctctggtaaagcatgatggtgtggtcctgaggttctgagctcccctcctccagcagccccctgcatgggcccgggtcttggccgctctggtgccagtgggcaagcgtgtctcatggttgctctgaccatggcgtggtcagcccggcctggagctctgccaatagggcatctgggagactcacccttgtctggaggttaatgatgagggcttcagacagcccctagccatgaggagcaacaggtccgtgcccggctccctatttaggtggctg

SEQ ID NO: 90637 - DNA, 1113 bp, Homo sapiens
gcacaggtcgtctgccttggtctcggcctcagcctgggtgctcttgccctgttcgggtccgctgcagtcaccgcacaccaaggacggctcattctccgggcacgtgggacccactggagttgcacccatgtgcaccccgggaagttgctgcctgcctttcgcaggcatctggctggcctctcacacttctgagctgttccccctaaacctaagcgcgtaggtcaggcttcggccgcagctgccttctcatgattctcagtgtgctccgcaagtcttcttgggccagccctccggtccactgttcccggaaggccgcgtggccccacctggtcccagccatcctgggaccctgggcttttcttcgctccccacccatgcctgcttcttctgcgtgctcagcacccagtccccagcagggaagcacctgggattctttcgggaaagcgctcaggctctcccttctcccctcctgcagagggaagccccaccaccttcagcccggcccgtgtgggccccctgccccctgcccatcgataatgactgtctcttctctgtcactaggtgatggtaatgcccgaaggagcagacacggtgtccaggcccagtcccgactaccccatgttacccacaattccactctctgccttctctgaccccaagaagaccaaaccatcccacggctccaaggttagtgaggcggaaggcccagtcgcgtgggagcgccggggcccagctgtggtgggtctggccccggcgccctccctccactgggctgggccttccgcacctgctcgctcccttggcgtcttcctctttgagctctctgcacacccctcgctgcgcactgccgcttccctaggatttcaggaataagcccgtgatcatgggctctttgccctgttcatcttgaggccagagaccctgcctagtcctctcccgttctgccaagtgatggcagggccccaggactgctcggcctgaagccctgagaccttcgccgaaggctgttggggcggccgctgggtagagtgtctctgtctaggctgcagctacccacctcttcaaccctcctgagggcagctggggctacttctgcccttggctatgccaggc

SEQ ID NO: 90638 - DNA, 1103 bp, Homo sapiens
acaaaattaaccgggtgcagtggtgtgcatctgtaatcccagctactggggcagctgagccaggagaatggcttgaacccagaaggcagaggttgcagtgacccaacatcgtgccaccgcactccagcctgggtgacagagcaagactccgtctcaaaaaaaaaaaaaaaagaagacgaattggtcggtaaggggactcgaactggagactctaaaacttctccagccctgcccactcaatttacttcattggctcctccctttcaggctccgtccctatccccgcctcacccttaatggcgcccgcccagactcctggaagtgagcggcctagcgagcgagctcccaggcgcaaagcacgccggaagctgtagttccgccatcggacggaagccgaccggggcgtgcggagggatgtggcccggaatattggtagggggggcccgggtggcgtcatgcaggtaccccgcgctggggcctcgcctcgccgctcactttccagcgcagcggccgccgcagcggacactccagaacggcctggccctgcagcggtgcctgcacgcgacggcgacccgggctctcccgctcattcccatcgtggtggagcagacggtacggcggccgggcggggacacggttcgggggctccgggctgggtggggatcggctggctgccccggcccctcacctccatctttctacccccagggtcgcggcgagcgcgcctatgacatctactcgcggctgctgcgggagcgcatcgtgtgcgtcatgggcccggtgagcgccccgcgccgggaccctccccaggactctcccaagcgcctgccgacactccctgcgcccctccttccctggccccagactttccctcaggctccgctccccttctaacccccttccctccccttctgactcccctcctggctcccggtcccccaacccgctcctcaccccttctctgctcctcggctcttaatctccgacttccttcctgacacctggcaccgctcccctcattcctacgctcaagactctccccagccattctcaccccttcctttcctgtgtccctagccccctgactccccccttcctgtgct

SEQ ID NO: 90639 - DNA, 1111 bp, Homo sapiens
ccgccttctcgctgtgtcttcacatggtggagagagagcaagtgcactggtgtctcctcttataaggccactaatcccatcaaggggcccctgaccccatctctcctaatgacttcccaaggaccccatctccaaatcccatcccactaggggatggggcttcaacatatgaacttggggtggtgggcacaaacattcaggccaaaacaggacccagacctggccctgggtctctgctcttaccctaatgtgtctcacctcctgcttccccaccagagtccgccatggagagggaccgctacatgagccccatggaggcccaggagtttggcatcttagacaaggttctggtccaccctccccaggacggtgaggatgagcccacgctggtgcagaaggagcctgtagaagcagcgccggcagcagaacctgtcccagctagcacctgagagctgggcctcctctccagaatcatgtggaggggccagaggcctgccagacccccagctgggccctgctcaccccttgttgctgggcttggaggggcctcttgaggaacttttaatttgcaggggtgcccgctatggacggggcattccagctgagacactgtgattttaaattaaatctttgtggtctttgctctgcgtctgggacaccctcccttctgcaccatgacagcgtgtacacatctgtgtttcacaggccccttctgcttttgtcctgaccccaagaggcaagccatgtcttccttcaacagattctcctgatcatatcctatattccaggcagtgttcttttgtgaagaagacacaagaaaccctcctcaaaagagctccattcttgtggcagtagacagttactaaaaaaaacaaaacaggccaggcgcgctggctcacgcctgtaatcccagcactttgggagcccgaggcaggcggatcatgaggtcaggagatcgagaacatcctggctaacatggtgaaaccccatttctactaaaaatacaaaaattagccgagcgtggtgcacctgtaatcccagctactccggaggctgaggcagaagaattgcttgaacttaggaggtggaggttgcagtgagcaggatcacg

SEQ ID NO: 90640 - DNA, 1061 bp, Homo sapiens
aaataagtcagccgagctcccccagcactgcagcttctgggtgccaggccgggcaccctcagccaccacagccgcaggcagccgccgagagctggggcagccgctgccagcggtggcggtcatcgaggaaggccacgtcggtgtagcgagtgggccggcagcagggcccgccgtgggctcggccctggccctgcagccgggccagcgccaggccatgctgggtgcgggcaccacgggggcagctgccggcgcagtagcggaagatgaccttctcctctgaggcgtagcccaggcctagctctgccacggacagggtcaggctccacagctggcatggaccagacagggctcggcgcaggcgggcaagggggcggtgggtgcctgtgggagggaagggcgctgacagtgagcagggtcagggctggggaaagttgggaagtcacagagggtccctggaagtccttacccagccaggtccctccagcctttgccacctgttcagacgagaactctccatcggccacgggaaccccacgggcatcggggccccagccctgtcccagctgcagggacaggagcagcagggagcccagcaggaacttccctacggccattgtgacgggcaggtcctgagagtgggagctgtgccccaaatttatgccctgcctgggctgggagctaacctcttcactgccggcccctgcagccaggaggccccacgtctgcaccagcccatctcctgcaccctcgaatccaggcatctgctccttctgccccacaccccacccttctaagagttaagggctcacccccagcctaccccaccccgacattccacacagccatttccgacgccccagacaccccctgatttacgagtgctgtgctggcggccagggcaggcaactggtgttcccccgacctgctgcctggagtggaagtcagggggcttcatgggaccccggtggggtccctccccactaagtcagggtgctggggctcaggagcccccacgtgtatcatgtgccaggtggagcatatgtgagtgctgggaaaggtgg

SEQ ID NO: 90641 - DNA, 2029 bp, Homo sapiens
ggcctcccgtagtgctgggattacaggcgtgagccaccgtgcccagcctacttatttattttgagacagggtctcactccgttgcccaggctggagtgcagtggtgcgatcgtagctcactgcaggctccaactcctgggctcgagatcttcccacctcagcatcctgagtagctgggactataggcacgccccaccatgcctggctaatttttgtatttttggtagagatggggtcttgctgcgttgctcaagctggtcttgaactcctggggtcaagtgatcctcctaccttggtctcccaaagtgctgggattataggtatgagccactgcccaggccctggggttgtgtttttgaagacagttcactgagttggtgcttgtgcctggctctgaggcagctctgagtgccacaatgcaggaagcttaggtggccagccctgggagctcatgacacttgagatgacctctcagagggggcagactgagggcagaacaggaggggtccaggttaggttgatgaagggtgctccaggcacagcagttgggtgatagtgacagacacaggcagctcacacagggcagtgggtgccaggatgtgctgggtccagcggagccttggaaagctgtaggcagggaagaggcactcacccagactgtccggaactttggggtagaaaagaatgaggtagaggcctcaaggaggctgggcagttgtttaggcttgaggaaatggtggcccgggccaggtgtccacttcagatttggccatgccatggctgggcgcggtggctcacgcctgtaatcctagccctttgggaggcagaggcgggcggattacgtggggtcaggggttcgaaactagcctggccaacatggtgaaaccctgtctctactaaaactacaaaaattagctgggtgtggtggcagacacctgtaatcccagctactcgggaggctgaggcatgagaattgcttgaacccgggaggtggaggttgcagtgagctgagatggtgccactgcactccagcctgggtgccagagcgagactccatctcaaaaaaaaaaatttggccatgccttcccgccccatcttctcacttggctcctcagtttcccgggtgtggcccacagatagcagagctggaggcaaatgtagacagtttgactgcagggttgggctctcctgagataatctcacacagtctttccagaaatgatcccgatgtgcacacgcccagcactttgcagggtaggtgcgccggccctgttccccagatgtggaaattgacgaggcccaggtggttgaagggcctgcccaggcctcatgggcatttcttggtcttcctcctatggcaagtgccataaaggaggcaggccccggggggacacgggggggctggggctggtccctatgggccaggccatgaccgtggctccctgcaggttcaagggcatcaagaagggaggcgtaacagagaacacgtcctactacatcttcacccagtgccccgacggggccttcgaggccttccccgtgcacaactggtacaatttcacaccgctggcccggcatcgcacgctcactgccgaggaggccgaggaggagtgggagaggtgagtgggctgggtggtggctggggacagaagtgagggaaatggggtgccttgccatggatatatcaccaggccctgtgctgggagctggggactcaggggtaaccagggcagaccccactcggccgtctcagagctgtcagttcaggaggaaacagataggaggccttagggccacaatggggcaccccagagggtgctgccagagccagagtctgtgacccggagctcaaattggcagagcagggtggggtctaactgcccccttggctttccgcaggctgcaggtcacacagcctgatccactgcagggcagcagctccaggcagggcacccgaggagggtttctctagcagtgacatcggcctcagaggtggggcgggtgcagttaagggctgtggagggacaca

SEQ ID NO: 90642 - DNA, 1600 bp, Homo sapiens
ggccggaggtctccgggagtccccacgcaccgccagggaagcattcgctgggtccagaggttaaacgaagaggcctccctgcgccggctgcttgttcctgtgtgccgctgtcgtgatgctggggagcgctgagactcgcaggcgggacttctgaactgctggggagtcggggggcaggcagacagcgcggacggtgggcaccggcccggccgccaccacctcgctcacaatctggccacttgggaagaaaacgtctattttttccccttctctgcatcacttttttggtttttgttctttttattcttttattttttaaacccatgatcttttttcctgtgtccaagtgactgtgttgcaggcggcctggctctggcagggactggtggggacgcggggagcggcccaggcccctgccccgccgggctcagcctcccatgcgctcgcgcttgcctgtgtcccgggcttgtctgtgaagtgggcgtgaagatcgttgccaccttccaacctacctcacaggggtgttgtggggacaccatgatctctggattgttcatgtcgtcgtgctgcgccgggagccaccgccctccggagacagggcagctcccctacgaccctagcgcctccgccctccgcggcccctctcctctcttcctgctctgtccctccttctccatcagggagcagcgtgacttcagcgagtcccgcgagcacctggctagacagttaacaagcacgtccttccagcctgagccagcgcaggtttgggagggggcttcctggccccccccacggtgttccagcccctcctctcttccgccccctagtctcccacccttccctccccgtagtgaccaattcctatctcttccctctccgcaggctcaatgaatcgaatgaatgtgaacttcttcatctgtgaaaaatcttttttttttccattttgttctgtttgggggcttctgttttgtttggcgagagagcgatggctgccgtggggagtactggggagccctcgcggcaagcagggtgggggggacttgggggcatgccgggccctcactctctcgcctgttctgtgtctcacatgctttttctttcaaaattgggatccttccatgttgagccagccagagaagatagcgagatctaaatctctgccaaaaaaaaaaaaaaacttaaaaattaaaaacacaaagagcaaagcagaacttataaaattatatatatatatattaaaaagtctctattcttcaccccccagccttcctgaacctgcctctctgaggataaagcaattcattttctcccaccctcggccctcttgtttttaaaataaacttttaaaaaggaaaaaaaaaagtcactcttgctatttcttttttttagttagaggtggaacattccttggaccaggtgttgtattgcaggaccccttcccccagcagccaagccccctcttctctccctcccgccctggctcagctcccgcggccccgcccgtcccccctcccaggactggtctgttgtcttttcatctgttcaagaggagattgaaactgaaaacaaaatgagaacaacaaaaaaaattgtatggcag

SEQ ID NO: 90643 - DNA, 1184 bp, Homo sapiens
ggcccttcaatcctgggcccttcaaccaggggccacccggggctcccccacagtgagtatcctctgcctcctgggttttgaggccgggggcttactgagctggcaagaagaatagcagaccccatttccctttccctagaagtgcaggcggggggcctcatccagcccatttttgtggataccatcaacaggccctctcctgtctactggtagagcatgtgcctttcagcatccctctgtgcacgtgcaagtttcgcggcttctttcatgtcctcaagctgacgctgcgcgtccttcgagttgcttcttgtctaggcctttcccaggcgccccgttgagcctggtggtctgggtctctggcgcctccccactgaaaaacatccccaccccaggtggtccggctgcggccacccccgcaccactgctcaagcatccctttcttctctcctgcagtgccggggggccccctcctcaccagtacccaccccagggctggggcaatacctacccccagtggcagccgcctgctcctcatgacccaagtaagtgatgggccacctggcggagggcaggccctgttctgtccccccgtctcacccgaggtatctcctgcaggcaaagcagctgcagcggccgcggaccccaacgccgcgtgggccgcctactactcacactactaccagcagcccccgggccccgtccccggccccgcaccggcccctgcggccccaccggctcagggtgagccccctcagcccccacccaccggccagtcggactacactaaggcctgggaagagtattacaaaaagatcggtgagtctgcagggtggcgggggggctccagccctgccgggggagtggtttctgacctgtctcggcgcccgcacaggccagcagccccagcagcccggagcacccccacagcaggactacacgaaggcttgggaggagtactacaagaagcaaggtgagtggccaccatgcggggacaggggcaggggcagccctcacccacagcctctcacctgcctttgtccacccacagcgcaagtggccaccggagggggtccaggagctcccccaggctcccagccagactacagtgccgcctgggcggaatattacagacagcaggccgcttactacggacagaccccaggtcctggcggcccccagccgcc

SEQ ID NO: 90644 - DNA, 1811 bp, Homo sapiens
ctgactcccagctttgtgtgtgtgaggcaccggcctcacctctgaccttctgcttttttatctggaaacggggctgctggtagtgcctccccattaaagtggcaggtagagagctcagtagggtgctgtgctgggctcacccagggttcgtgggtccttagttgaggcccgcacccccgaggaggtgggggggtgtggggcagcagggctcacccatgggggctgcttcctgtgtgtttgcagcaagcctgtgagatggtgatggacatcctccgggaacgtgaccaaggcggctttggggaccggaatgagtacggatctcggattggcggaggcatcgatgtgagtgtgggccctgccttcacccccctctcccccgccagtggagggaggggccggggtgagtggctccttgtggccagtgggcagcagagggcagcagagctgcgggccgagctgacgctgctgcctccctccccaggtgccagtgcccaggcattctgttggcgtggtcattggccggagtggagagatgatcaagaagatccagaatgatgctggcgtgcggatacagttcaagcaaggtcagggcctggcccaccctgcccctggccagtgcacccccaccctctttgggaggcaggctctgagggagctgggcaccgtggtcagccaggtggcctccatagcacctcacggctcttagtccagccgtcagaacatggccagtcccttctcttctctgggacagacacatgagggctttccacatccagggggaacgtgtgttcctatccctatcagatctcctcttcctccccctacgatggagcctatcctgacaggacagccctgggtgccccgcaggctggatcagggcactccacctcagctctgggctcttgccagtcctcaggcagtctctgagctgcctgccgtggggagaagggcccctctggcttttcagagatttattgttctgtaaaatctctcagtgctgggggtgctgtgtgctggaagaagcttgagccacctcctggcttggccgtgggtttccttctctgggaatgtgggccgcctccccctcaatccctgagcgagtggaggctgggagcggcgcagcgcgtctgagatctcaggccggcgtggtgtctgcgctggaggcggcgttgcagggctctggggtgggctcttcttttaaacttgtgtctctgctctctcggtgctggcctcagatgacgggacagggcccgagaagattgctcatataatggggcccccagacaggtgcgagcacgcagcccggatcatcaacgacctcctccagagcctcagggtaggtggccccgggtgctgaaggggctggcagggcctccaggggagtgcaagaccagaccggcttccagggttcatcatcctcctcctcctcttgtcttgcagagtggtcccccaggtcctccagggggtccaggcatgcccccggggggccgaggccgaggaagaggccaaggcaattggggtccccctggcggggagatgaccttctccatccccactcacaagtgtgggctggtcatcggccgaggtgagtgtggccccctgcaccctatcccttgccccctcttccctgggccatcactgcaggccaccttcaccttctgcgtttctgcaggtggcgagaatgtgaaagccataaaccagcagacgggagccttcgtagagatctcccggcagctgccacccaacggggaccccaacttcaagttgttcatcatccggggttcaccccagcagattgaccacgccaagca

SEQ ID NO: 90645 - DNA, 1189 bp, Homo sapiens
attttggttttgggggccaaaagagacagttggaagatggaggtaactccctgctgctgcctttagcttaggaggaagggctgggggcctaaagaggtgcttttgtttgagtgtggttcagagggggtgggtgtcactgttgtttggtcttttaaaacctcagcaatcccggccttgttaattcttcttgttccgtctgccatcctgaggtatcaggtggcagagaggagggcagattgattgtgactgggtcgaagttgtaagttcccaagatgattcctccctttctgggaggctgaggcaacctggagcagttactgaggcttgatgtgaagttggcccagctctggggtgcgtagtgtgaccccaagtagcggatgatcaaccctgaccaactccactgttatccacgacaccctccctgctagaggcaggtcctgtcctaaaccgggaggactcaggtgcctggtggtggttgcgtgttctgaaggcttttttactctgagcgttggtggcggaattggcggggtctggcctccctcaggggccagtctctcctgggctcctgtctcagctcctgttaagggtgggggccgaggggcactgtttaccttggacatgtggcaccagcatcaggttcgaggcggccgtgggtgggtgggtgctgcatctgccatcctctctctttcccagatcaaccggagagcaagaagctggcttcccagggagactgtaagtccagggggtctggtggcagatatgtggcttcagagggttgaggttttcaggagtcaggagctggaagcactgaggaggtggcagctctttacagaggcccctggtgcttcattctggggcccatacgtttgagggatcccaggaaccctgaaattgagggagatgagctctgtgcttttatggggaggaatccacagcatccatgaggcactggagcaggctggggaccgtggtgccgggctcagctcccactgacccggggcaggcagtgccaagtgcccgaggaggagctaagccagtctttgctttgggttttctctctacagcaatcagttctcaacttggacccatccatcctcccccaaggtaagccatggtggggcccacactgctttcttgtctgttggccagcagactggcctttctgctgacttgggagggctctgactgg

SEQ ID NO: 90646 - DNA, 1036 bp, Homo sapiens
gtaatcccagctactcgggaggctgaggcaggagaatcgcctgaacctgggaggcggaggttgcagtgagccgagatcccccgaccgcactccagcctgggcgacagagtgagactccgtcaaaaaaaaaaaaaaagaaggaagggaggaacggaggaagggagggagggagggaacaaaaagggagaaagaaaggaaaggatggaaggaagaaagagagagagaaaaagactgaggagatgaagaggaggggtgaggtgggaatgtaggttgatgttggctttgggtcagggttgcatgcgattctagaactggccggggaaggagctgaagaaggaatggggatgggatggggatgggttggggttgggtggcttgggaggtcccggtggggctgcgcttggggcagggatggggacggagacagaggcgagcaggggctcctccagggtcctccctccacccaggtctactcctccaagacgaacttcaccaacctgctgggggggctacagagcatggtccaggagggcggcttccgctccctgtggcggggcaacggcatcaacgtgctcaagattgctcctgagtatgccatcaagttctccgtattcgagcaggtggggaatgaggggcctgcttcccccagctcaagcccaaacccctcccatgcccccaaaactccaggcccttgttcaagcacacactcaccctccagaccccaggcctcttccctgcgcgggttttgtgtcggagggtggctgacttctctctcaccctcctctctcctctcccagtgcaagaattacttctgtggaatacaagggtccccgcccttccaggagcgtctccttgctggctccctggctgtggccatctcccagaccctcatcaaccccatggaggtaagagagcatgtgccccgcaggtgaggaaacgccgtggaaactagttacccacgttgctggggctacttcctcttcctcctttctcccctcctcctttctcctccttttttctcacacttctccctcct

SEQ ID NO: 90647 - DNA, 1050 bp, Homo sapiens
gaccaaaaaataaaagaaagatatcaggagacagttactggtggtgccacatgtgtgcactttggtaggtgtaactatttctaggtatagggatttggggatagcagaagattctagagtaggtggtttttaaaattcggttgttctcagggcatctgttttcaggagtagctatttctaggtgtcttcattcctggatgtagcgatttggtgggacagcttttccagggataaccaggttctccccaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgaggtctgtgggcagcgcgttcctctttccctgctcccctctgggatttacccacaggacaccccttccccttcccctggggctggctcagttgacctgctatagttagagaaaggcagttatgaggtgaggagcaccttggccctgggaatcctggggaacccttccaggtattggactctcccacttctccacttacttttgattagcagctcagccttccggggtcacctgaaagtcagggaccactctagctgacaaacataagatcaggcaaagattacaaaaattagccaggcatggtgatgtgtgcttgtaataccagctactccaaaaggccgaggcatgagaattgcttgagcctgggaggcggaggttgcagtgagccaacatcccgctactgcactccagcctggtgacagagctactgcactgcagcctgggcaacagagcgagactccttctcaaaaaaaaaaaaaaaaaaggcaggcaaagatgagtctcaaagacacccaacttccccgaagcaagtatcagacccagccacggtctctaagccaatgtcatcttcagggcctgcccatttgagcatctgctgttaccataagaaccacacctaatcaccagcatcttgag

SEQ ID NO: 90648 - DNA, 1042 bp, Homo sapiens
cagaatttgggggctttctggagggctgggctcagtgggtgcagtggagagccagggagtggggttttcctgggctgtagaatcttcagctgccttgtgggaaggggtgagatgaagaattaggggctctgtgagaggagagggtttggggtccccccagatgcttgggtctgcagaagctgttgaggactgggatggagacgtgacttcttggtcggactctgagggtatcagctgggacctggagtcctttgaagagctggtggcatccaaagacgaggcattttgcagggatggcagggaaaggggctggggctccggctctggtagtttcttatcgtctggttgccatcttggtatgttgggctaggtgagatggatagggaagttgtggcttttagatggcagaggggctggcaagttggatggaccattaggggaagacttggggtagggttgggggagtgggcgaggctctcaccaggctgaagcagctgtccaggtctcctctgtgacagcagtctaaactctggctcggtctcaggctgcctgcgctcttggctcccatgctaagactgtccagaatctcgctcaacaaatccagttcttctccagaccccaagaagctgctgtccagagcttcttctgcccacgggcacccctcatcctcagggctcagtgggggtgtcctgggtgaggatgggcagcctcagatatttgcccaagacccccagccctggtcaggctgctctggagtttgggaaccctcctccccatcagtcctggcctcccactttcaacactgctgttccctttttgccttaccccgcccctgggggctcggaagttccctcttccagctggcgtctcctgctggggcgaaggggccggttctgcaaagggtgggggcgataggacctcaggagactgcagaatcggggggctgaggcttgctggagaagggtgagtgtgaagtgggtgccacatatttggggagttgaagaaggaggtgagatgtctggatggggactgggatgggtag

SEQ ID NO: 90649 - DNA, 1026 bp, Homo sapiens
tatactcattttttgttggaatcctacccgcccccctccgccccgcccacggcccctttaaaattgacagccaagatttgctggcaaacattctttttgtccttggatgctacaattccaggttctgccttttatctcccaagctcagaagtttcctggggccaatttttgcagctcaaaattgtccgtgcgattttgttcttcaccgctttgaaacaggaacaccttgccctgttgctttgccactccccattttctttggggatgactgcctccaggaatactcattttatattagtcaaaggggtgaaagtttgcattgacttcttaggtggtgtatggggggtggtgaacgtatttgagacatgcagatggcaaaaaaaaaagctatcttaggggacagaaggctgagctctcaaatgcccaggatcccaccacccttgggtaattctctgtccactcctttataggccaagagtggcttgaagggggtgcagagccttctaatgtataaggtaagatcaactggccgggtgcagtggctcacccctgtaatcccagcactttgggaggccgaggcaggaggattgcttgagcccaggagtttgagaccagcttgggcaatatagtggggccttgtctctacaaaaaaatagttaaaaattatctgaatatggattgcttgagtctagaaggcggaggttgcagtaagctgagatagcgccactgtacaccagcctgggtgacagagagaccctgtctcaaaaaaaagaagactgtggctgggcacggtggctcacgcctgtaaccccagcactttgggaggccgaggagggtggatcacttgaggtcaggagttctagaccagcccgaccaacatggtgaaaccccatctctactaaaaatacagaattagctgggtatggtggcgcacgcctgtaatcccagctacttgggaagctgaggcatgagaatcgcttgaacctgggagtcagaggttgcagtgagccgagatggcaccactgc

SEQ ID NO: 90650 - DNA, 1014 bp, Homo sapiens
gcctcagctctggctgggagccacatccctggctcaagaagaggaagtccgtccttggggatactgggaaaggtagtttatttaatgctttgtggcccttgtctgctcccgctgcattctgggtaatgtagtcccggacagttaagagtgggtggagaaattccgctttaagggccggatatcagatccatgacaattggttagataaactgctcattaaatcacatccggacaatctttatagcgattggtgagagtgagctgggggttaagcgttatcggctctcccattcggaaccggtgctgtccgtcggtgacgcaagcaggcgggcttgcggagaggcaattgctgattggttggcggactggaaactccgaaaggccgggccccgccgtgcggcgattggctcatcggtgggcgggcttgggcgccagaggcggagtcggggaggaggtggctccagagatggcagtgagcgagaggagggggctcggccgcgggagccccgcggagtgggggcagcggctacttctggtgctgctgctgggtggctgctccgggcgcatccaccagctggcgctgacggtgaggcccgccgcgcgagggtctggggtcggtggcgcaactttgtctcggagaagccccctggcttggagtggtctcgtccgccctcccccgtccccgaggcggtggagtggtccggcgccccccgtttccgggcccggagtggtctcgtcccgggatccccttcggtcctccggatggagttgccgggtccgcctcgctggggtcggccccctcccttcgggggcgaggctccatctcttggggactacaccccccttccccccaactgggtcttagtcctttaaattcttggaatcacttttggggcgctagagaccctggagccgcacagcggggtcctggggggctatagagtggggtcctctgggcacttaatgggatttggggggttctgttgaaatattgctgggagctcaactggaatg

SEQ ID NO: 90651 - DNA, 1032 bp, Homo sapiens
taaattgagtcacccatcgggggatccctggaagcagggagattcagggaacctggtgcctgccccctggccactcaggggcccccagtctgccaggaaccctgcccctctggccttgactcacgccgggccggccggattttccggaatccggggggattaggggagcccgagctgggggagtggccctgtccccttccacgcccctcttggcggtcctatgtcggagacctccatctcccggccggggtggctggggcctgggcgctgttctccggcccttcccgggaaggggagggggttcccgccagtttcctgcctccccccgcgccacgccggggcggcgccgggaagccactccttctaggagcgcagagccttggccctccctgggagtctggtcggcgggctgtggggtcccaaaatcgtgaccccggcccctctcccctcctcccccaccatgtcccatgtcaggatcagttcgaggtgctcgagcgccacacgcagtgggggctggacctgttggacagatatgtaaagttcgtgaaagaacgcaccgaagtggaacaggcttacgccaaacaactgcggtgagaccctggggtggacgctacggaggacgcgcctggggcgacggggagcggtgggagggctgcgggctcagccctcctacctctgtctccccttaggagcctggtgaaaaaatatctgcccaagagacctgccaaggatgatcctgagtccaagtaaggttggagaggggctgcagggctagatttgtggggaaaggcggtgcttgggtctcacttcccctccctcagctgggacaccccaccgctcctctcacttccccttctagaggtgagagcatggatgcaagatgcgggattatctggcttggaatcctgagtccactactatgtagagaaattgacttgggcttgtgactcaggttttctgccactattttccttaactgttaaatacagaggccccagcagttacaaaaccagtaactttgggcagatgact

SEQ ID NO: 90652 - DNA, 2517 bp, Homo sapiens
cttgagcccaggagtttgaggctgcagtgagacgcaatcatgccgctgcactgcagcctgggtgacagcaagaccctgtctcaaaaaaaaaaaaaaaaaaaatctactcaagggttggggttaaggaatatggaccagaatttgtcatcgcttcagggattacattcttggggcttaacccttttccacctggaggtgcgtcctggggcatcagcctgctcgggaggaggggcctgactccctgttccccgattctcatccaaccccagattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatggtgaggagccccccgattcaggttttacaaagggcttctgctggaaccctggcgagccttatcactcttctttctgtagcacttccaagaagggcggcgggcccagcagcagctggaaaatggctttaaacagctggagaatgtgagtttgcagaggtagcagtgactgtggcccggaggcatgggggcagggttgcggatccggagtcagggagctgccctctttgtcagacctggaccttccctcccccataggcttccagtactcccttgacccctacttactggatgacatcccaataatccctgaaaccttggtttcccaccctgctgtctttgggatggtggctccctcactccggttctgtcccctacacagagtaagcgtaaatttgagcgggactgccgggaggcagagaaggcagcccagactgctgaacggctagaccaggatatcaacgccaccaaggctgatgtggagaaggtgtgtgtggcgggggcggggggggggtgcggggtctgggacaagcttggggagtccgagtgggacgtgatcggaacctggcagtaccttccacctctgcattcttcaggccaagcagcaagcccaccttcggagtcacatggccgaagaaagcaaaaacgaatatgcggctcaactgcagcgcttcaaccgagaccaagcccacttctatttttcacagatgccccagatattcgatgtgagtgctcccagttctcagacctaccttcccgaaagcctccaaatgttagccaactcctacgcattcatcaaaaccccagctgcaatgtcccagtccctagattgaaagggaatcagaaacctatagtaacagtgagctgtgcttttagtcagctgttcttcctgctgggcatgccttttacttgtttgtttatttacttctatagagagatggggcctggctctgtcacccgggcaggagtgcagtggcataatcacagctcactgcagcctggaacccctgtgctcaagtgacctttctttctttttgaaattcctacttattcttctaagctccacctctaacaacccctctgaaaggtctcgaatttcccctctcctgtttcaatctagcgctccactctctgtcccatccgtggccctgggagtatcagggctggttctgctttttcttcaaatccctgttcccttgtctcctcctttgagaagcctttgctgaccccctaggcacgcgtccccctctgagatccccctggccctgtgtctcttccccaaccacagtgggctggagtctctcttcccgactctgtcttcccctccagactggcttggggctggggccagcgtggagcgcgatcatatttgcagagtgaatcactgtgcttctagtccctctgttagcacccctgagccacccttgtccctgtccttacagaagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgtgggtgcctggtctgggtccactgggctacgggaagggcagagggaggtacccataggctaggcactcgactgctcatccactgtccccctcccccaggactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaaggtgggggccgggacccttgggatggtgggggagaaggacagtgaagtggggacagtggggcccctattgagtcagccccagccgcctgaacgccgagtctcgggcaggaattttcctcttggctgccagcccggactggagggaaggaaggcggccgattggcctgggagtcccccgaggcgaaggcgggggcagggtggggaggtggggaggtccgtgg

SEQ ID NO: 90653 - DNA, 1022 bp, Homo sapiens
ctccgggttaggccggaatcctggaagcaaggtcaggtgggctgggggcggggcccaggcgcccgcctcgcccctcccaacctcccggcaccttcctttccccagaggactttgacccaacaggggcccgggagggacctgccccacctgcgggatgactaggcggggtcagaggggagggggcttccagctctctgcaggaatgggggtggggtgcctgaggggctctaccgcagtgcaatggggtggcctgttccaggtgccagatcctggaggtcccgccttaggggctgtgcctggacgtggggctgccccgaggacgggatcccaggttgtcggggaaggtggggggatcttgccgggtgggctgccctaggataggacggaggagtcgttttggagggagcagggcgttcttggggatcgagatccctgggggacgggatcgtcttaggtgggaagggggagtggggacccgcggaggtggctctgggggcaggacagcccgttttgaggtggacggccctgttcctatcaataccgctggatgcagcgtttgcttggggtgagaaccttcctggagtggagccgtcccagtttgggtggggctccgggaggcgtggcgagaggctcccctcctgggacaggctgggtttgggggatccggttagaacctgcagggtgctctgaagtctgcagtccagcgcagagggaacgctcacctcgcaggcgctgggctgccaccttgcggaatttgggtgcgtcccggaccatgtgacgcgccccgtgcagggtgcgcaacagccgctcacagctctcgtccagcggccccgcgacttcctcgccctccagtaggcgaaccatgggtgccacgtgcggcagcgccacctcgccggggtcgcagggtcctgcggagggggagggtctgatcagggtttggggctgtagatggggcatagggcagaggtggaacctaggacaaatgcaggggcggggcttaggactgagcgacagcggggtct

SEQ ID NO: 90654 - DNA, 4363 bp, Homo sapiens
ggcagaggctgcagtgagctatgatcatgccactgcactccagcctgggtgacagaatgagacgctgtgtccaaaataagaagaagaaaagcaaaaagaaaacaccatctctcagcacctctagcaatgctatttctgccttgacaattgtccacacacacagccagcatctgatgtgagcacatgtggtccgtgggtgtcggctgcagggacaagagtgggggtttgggaggatgcgtggcagggcccccagactcacccaggacgtgtccttctgccccgcagcactgacctcatgcgcatgtgctggcaattcaaccccaagatgaggccaaccttcctggagattgtcaacctgctcaaggacgacctgcaccccagctttccagaggtgtcgttcttccacagcgaggagaacaaggctcccgagagtgaggagctggagatggagtttgaggacatggagaatgtgcccctggaccgttcctcgcactgtcagagggaggaggcggggggccgggatggagggtcctcgctgggtttcaagcggagctacgaggaacacatcccttacacacacatgaacggaggcaagaaaaacgggcggattctgaccttgcctcggtccaatccttcctaacagtgcctaccgtggcgggggcgggcaggggttcccattttcgctttcctctggtttgaaagcctctggaaaactcaggattctcacgactctaccatgtccaatggagttcagagatcgttcctatacatttctgttcatcttaaggtggactcgtttggttaccaatttaactagtcctgcagaggatttaactgtgaacctggagggcaaggggtttccacagttgctgctcctttggggcaacgacggtttcaaaccaggattttgtgttttttcgttccccccacccgcccccagcagatggaaagaaagcacctgtttttacaaattctttttttttttttttttttttgctggtgtctgagcttcagtataaaagacaaaacttcctgtttgtggaacaaaagttcgaaagaaaaaacaaaacaaaaacacccagccctgttccaggagaatttcaagttttacaggttgagcttcaagatggtttttttggttttttttttttctctcatccaggctgaaggattttttttttctttacaaaatgagttcctcaaattgaccaatagctgctgctttcatattttggataagggtctgtggtcccggcgtgtgctcacgtgtgtatgcacgtgtgtgtgtccattagacacggctgatgtgtgtgcaaagtatccatgcggagttgatgctttgggaattggctcatgaaggttcttctcaagggtgcgagctcatccccctctctccttccttcttattgactgggagactgtgctctcgacagattcttcttgtgtcagaagtctagcctcaggtttctaccctcccttcacattggtggccaagggaggagcatttcatttggagtgattatgaatcttttcaagaccaaaccaagctaggacattaaaaaaaaaaaaagaaaaagaaagaaaaaacaaaatggaaaaaggaaaaaaaaaaagaactgagatgacagagttttgagaatatatttgtaccatatttaatttttaaagtctctggtattagcctcataagttattgactattccccggggttggcggggagtggggacatgagttggtctgcctgttgtggggccgggaaggggagggagtcaggcacaagtggcctctttgtttggtcttaaaggcatccatttctgggaatgaagccatgttcgctgctaacacttttggatgttgtgaggccacgtggagtgtgtgagagactaggttttatggatggtctggttcaggtaccaggtctgctggaaggttcctgttcggataagctggtagctacctagctctgagcctgccttcaagaacacctgtgttcatcctctgattctctgtgtgtacctcttgtggcgtttcctctcccgggtgtgaacatcctaaccgttattgtgcaaacccaagaacgtcagatcccaaagcacaacaacctggatggactttgggaacatctaagcaatgtaagagagaggtgcactgagagtacgtcttggtcccctccaccctgagagcatctgacggtcctcagtactgaactcccggaagctgctctgagcccggtgacctcatctgggccaggtgtggtgcctgagctgaatgctcaggtgcttacagtgttgcaatccctaagagagtagagtctggaggagaaaccgtgaaaaagaccttacacaccaccaagaacttccgaatgggcgtgaatccaccgtttcttctctttgcaaaaagaaccaccacagctgctcaaagaacacagtgaactcatcactttggttcatcaaaaaatcatcgcccatgcgttattcctgagtgcattttcttacaactttttgactgcttccttttcttcttctcttaagagttgtgggcttaagaatgggatagagtcataatggcaacctccaagccctctcaattcttgattaagaacacaggtagacatgaatcccaattgtctattgctatcttatttatatgattcgggaaaatacagcatgtaaaaatattgctgaggagcctcagtgattgggtacaagaagcaagagtacagaaattatttttgccaaatttattttgtaaatatgagggtctgtacctaaatttaaaaaaaaaacacgtagaactaggtattttgttctcttcttagtaaatttgtagtggttgtatactacactagctgcaattttcacatttttctaattcagaaaggtttttcttatattaggggaaaaagtatttattttaatatataaaatcactctgaaaatcactctcataaaaaatggagcgcatgtaaatttttatcaaagaaaaataaacaggtgaatgggggatagtgattttcttttttcagcacagtctacctcagtgtattgttaagatgtgattcaatcatggacatctttgagatttcagaattctacctggaaccggtctgaatcagggaacgtgtgtatcagctgattcgaatgccagggaccagtaagaattttgagggagggagttgggatggagaaggtatggcctttatgcgagcatagatccttttcttcctggctggtaatattcttctctgaatttaatcttcctttaaaaaaaaatcctccatctattgtcactatgttccccaaacataaactaagttccaggctgtcatgatgtatctgatatatggggtaacccagcaaggtgtaccttcctttggtgagagatggctgccggggcaaagacgggctttgattcagagcaagcattcccacctgttccatggaatccccctgaagtgagcacaaaggtgccctgggctccctgatggtttatgcccactcctttcaggctggtgatgcaccttacacacaaacacctaatgcaatgtctttttaaattctccaagtgggatgggagcatgtgagggaaattccaatccaaaacccattaatgtgctgaacgctttttttttttttttttttttttttgcaacaacaccttggacctctgtgttggggtttgactgacctcaagctgatattattggaccttgtgcagctttgataacccatgtgagagtctaggcaggaccagtggggcccaaatcttgctgctcttgtacttttaggcactgcccttgcagactcacctttctccacctgccctggagaaaggtagggtgtgctgggcctgccccttgcaaatgggattcaccagtttcatttatttgactctactgccacagtgaaaagagcaaacagctattgggttgcaaacctcctttgacattaggaaatgttgactttgtaacaataaaactttggtcctagaaagacacggttgtcctgggagtttgtagtgttaagttgcaacaacaacaacaaaaagcaacaaaaccagcttaggataacactttttgttgcttgttcttaaagatgtctcactatgattaaaacccttttcattaatgtagtgaaagccacacaggagttccttcttccaggaggagaataccaagcacatcactttctctctgcatcagtgatgtcaaatacgcatcagaaaatgttcaggttttaggagctgtcctaggtgctgtttcatcattggaagcagtgagaaagagaagcactgctgcttgtctggatataggctgaggatgattgagagaagctgtgggaactgacacaagggtctgcatag

SEQ ID NO: 90655 - DNA, 1032 bp, Homo sapiens
ttcggcatggtgtatgagggcaatgccagggacatcatcaagggtgaggcagagacccgcgtggcggtgaagacggtcaacgagtcagccagtctccgagagcggattgagttcctcaatgaggcctcggtcatgaagggcttcacctgccatcacgtggtgagtccagtgggggtgggacatgggctggctttcctgacccttccctttctctgcctcctcctcctgcacagagcgacagaggacacagggtgtaacctcctacccacccctcactccactaagcttcccatcctagaggtgtgaggagggatcattcccttctcaaatcccatcctctcccacttcgcctggaaccagactctatcactgtctcatcactttctggaatgtttcattgctttccagaatctttcatcactttctggaatcttccatcattttctggaatcttccaccactttccggaatcttccatcattttccacaatcttccattgctttttagactcttccatttcttgctttttcctggcacctttgtaacccaggaccacatagaggtccacctgataccacctgccctcgttcctactctcctttgaaggcagcaccaactcttcctgcctttctgctcctttgttcctctttgagtcctatgtgctttcatccttgccacacatatttatggggcatttaaagccctgctcttgtccctgtgatacagtggatacctgcccctgtagagcttccaaaacagcaggcggagacagactccaaaacctttatttttattttatttcatatatatatatatatatatatatatatatatatatatatatatatatattttttttttttttttttttttttttttttttttttttttttttttttcctgaaacggagtctcgctttgttgtgcaggctggagtgcagtggcacaatctcagctcactgcaagctccacctcctggattcacactattctcctgcctcagcctcccgagtagctgggactacaggcgc

SEQ ID NO: 90656 - DNA, 1029 bp, Homo sapiens
aggcaggagaatcacttgaacccgggaggcagaggttgcagtgagccgagattaagccattgcgctccagcctgggcaacaagagtgaaactccgtctggaaaaaaaaaaaaaaggaaaagaaaagaaaccatcagggtttaatgctcagcttctggcttaggaagtctggctcttaccgataatgataacctctgcatatatctttatccatagcactatggttataaaattctgcaattctcaaagtcgcttatgtgtcttagtctgtgctttgctgccttggcgtcatttctgagcaggatcctggctgtgagctccctgcgaggggtggacactcccagatgtgcaaagctcagccaccctccttctcctcctctcttcctcccaggagctgcatctctgcgtctcccgcaagcacttcgctctggaacggggctgcaggctgcgtgggctgtcaccggggaactacagcgtgcgaatccgggccacctcccttgcgggcaacggctcttggacggaacccacctatttctacgtgacagactattgtaagtctccatggcagcctcagctgactggggctgtgcttagcactgagcatggtgggacattgcaggggatgacttggagaggccgcaggtgctggccctggccttgactctcaggcctatcagctgctgcggtgcttgccctctttgatcctgcactttttttttttttgagatggaggcttgctttggagtgcactggcacaatctcagctcactgtagcctccgcctcccgggttcaagtgattctcccacctcagcctcacagtagctgggactacaggtgcccaccaccacgcccggctaattcttgtatttttagtagagatggcatttcaccatgttggccaggctggtctcaaactcctgacctcaagtgatccacccgcctcggcctcccaaagtgctggaattacaggcatgagccaccatgcctggcctgatcctgcacttaaaaaaaaaaaaaaaagtttcagag

SEQ ID NO: 90657 - DNA, 1028 bp, Homo sapiens
ggggtcagaaggacccttggttgagatgaccaggttagtgtgggattgctggataataaaatgctgcctaggccaggtgctgtggctcatgcctgatgcctgtaatcccagcactttgggaggcccaggcaggcagatcacctgaggtcaagagtttgaaaccagcctgggcaacatggcgaaaccccgtctctactaaaaatacaaaaattagccgggcatgatgatgcacgcctgtaatcccagctacttgggaggctgaggcaggagaatcgcttgaacccagaaattggaagttacagtgagccaagatcacaccactgcactccagcctgggcaacagagcaagactctgtctcaaaaaaaaaaatcagttgatgctttgtcttttgccacttcatggtctttttggttataatctttttggtatataaactcatttggcctgtttgatgagcccattttacatctctggttgttgagataccaatttctcagtagttactcatgaagcaccaacgtcttggttattttcacgagacccatttgtgcctgtatagaaattatctgaatcttgctaatacggacatatctttggcttgataagtggtggagctgttttcttttccattctacaatgttgttagtcttttaatacaaaaagaccataaagagaatcttaagaaatgcccccaaagtaggatttgttttctgaccacacattttctgatgacgctgcaatagaaactaaaagttaatttcaaaagattaaacagaaaacttcacttcttggtggttaaaagttaaacacttacaggctgggcgcagtgactcacacctgtaatcgcagcactttgggaggcccaggcaggcggatcacctgaggtcaggagtttgagaccagcctggccaatatggtgaaaccccttctctactaaaaatacaaaaattagccagatgtggtaacgtgcgcctgtagtcccagctactcaggagactgaggcagaagaatcacttgaacctgggag

SEQ ID NO: 90658 - DNA, 1050 bp, Homo sapiens
cagtggtgcgatctcagctgatgctacctctgcctcccgggttcaagcaattctcctgcctcaacctcctgaatagctgggattacaagcatctgccaccatgcccagataatttttgtatttttagtagagacggggtttcaccatgttggccaggctggtctcgaactcctgacttctggtgatccgccattctcggcctcccaaagtgctgggattacaggcgtgagccactgcacttggccaagtctcaagtgttttgaataagggatgcccaagctgtgttttttcattgagatgtcagggttgacagttcctttctctttggctgttcccgagttattttttcttgtggcattagattgttgggtgagtaacatgtgaccctatgggatgtaacttcccaggcctcatctgcacggcactcagtgtgacggtcttgtaagggtaactgccttctgctgttttgtcttgaaagcccttatcagaatgtgacggagttcgacgggcaggatgcgtgtggttccaacagttggacggtggtagacattgacccacccctgaggtccaacgaccccaaatcacagaaccacccagggtggctgatgcggggtctcaagccctggacccagtatgccatctttgtgaagaccctggtcaccttttcggatgaacgccggacctatggggccaagagtgacatcatttatgtccagacagatgccaccagtgagtgtgtcttgggaatgtgaattcgtatgtgaatcagacctcttgcttttaataggctgatgcagtgaggttgtataaaatgctccttgatatggttattggctttttttttttttttagacagggtcttactttgtcacccaggctagagtgcaatgcagtggggtgatcatggctcactgcagcctcaaactcctgggctcaagcaatccttctgcctcagcctcctaagtagaaggaactaccagagtataccaccatgtgtggcttttttttttttttttctttgagatgaagtctcactctgtcacccggact

SEQ ID NO: 90659 - DNA, 1212 bp, Homo sapiens
gttgaggttatttactacttttgtgtcaatagtagatacattttgtgtatacttataaatactacttagaggaatgctactgtgtatcttttgtcagcttatgtttagtaacttcatgttggtggcctgaaatccaccactggtaggaatatttacaccatggaaatcggcaaatgctatataaatctgggcctccctgggcccctccctcaggcagctgttaaacatttacaagctcaccaatggtttggaggcttaaaccagttaatagatgtgtctgacatgtgggtaatgatgtagacgtgccgcttttactgttagtgtttggttggctttcactgtctgatccagaattgctgcatatgcagacaggaattggacaaagccatttatttatttatttatttatttatttatttatttatttatttccctctctctctctctctctctccagtttgcccgaccatctgtaagtcacacggctgcaccgccgaaggcctctgttgccacagcgagtgcctgggcaactgttctcagcccgacgaccccaccaagtgcgtggcctgccgcaacttctacctggacggcaggtgtgtggagacctgcccgcccccgtactaccacttccaggactggcgctgtgtgaacttcagcttctgccaggacctgcaccacaaatgcaagaactcgcggaggcagggctgccaccagtacgtcattcacaacaacaagtgcatccctgagtgtccctccgggtacacgatgaattccagcaagtgagttctggatgtgggtctggggggcagccgagaggagaaggaacgtggggttggttgtgacgatgccgcttgttaaaactgtgtgcaaacccagggttaattggctatgagtgaggtctctgctctcagatgctacttttgcaccctgttttggtcctgggcttgggagtgggagttgactacctttttctctaaaggaccagatagtatatacttctggcattgtgcccaccattctttttttttttttttgagatggagtcttgccgcaagactcccaagctggagtgcagtggcacgaacctggctcactgcaacctctgcctcctgggttcaagcgattttcctgcctcagcctcccaagcagctgggactgcaggtgcctgccaccatgcccggctaatttttgtatttttaatagagacagggt

SEQ ID NO: 90660 - DNA, 1041 bp, Homo sapiens
tcctgatctccagtgatcttcctgcctcagcctcccaaagtgctgggattacacgtgttagccaccacacctggccaacattggcagttttgaagagcacaggccagttattttatcgaatgacctcaagctagggttagtaatatatggaaagaaagctacacaaatattttgtctttttcattgcctcataatgggaagtacgtgttgttgccttgtcccactattgtgggcaatgttacttgaagtatttttaactagaatttttaagaagaaatacatttcccgtaaggctcagtacccaagacatgcatatacctgaatgaaaagtttcccacaacaagatttactcttgccattttctagtactgtgggattttttccttttcttttccccctgcaggaggggatgctgctgggggctgaggacaatgctaaacctggatgtctcgaggacaggggatggggtttttgtgtcatctatgttctgatgctttttcatttaatacgagaacaggtttcctatgatttggcacactgggacattcgacatgtgtttgttgaatgaaaaaaagaaaaaagagaaatgctaacaatttgttgaatagtccataaaagagcaaagctggcctggcgcggtggctcacacctgtaccagcactttaagaggccaaggcagacggaggtcacgtgtttgagaccagcctggccaacatggtgaaaccgcttctccactaaaaaaaaaaaaaaaaaaaaaatcagttggtgtggtggcgtgtgcctgtaatcccagctactcaggaggctgaggcaggagaatcgcttgaacccaggacatgggggttacagtgagccaagattgcaccactgcactccagcctgggtgacagaaagagattttgtctcaaaaaaaaaaaaaaaaaaaaaagcaaagctattattaaaacacactccacacttcacccctgagccccatattgattttgtaataaggcaaagataatttttttttctttttttgagatgaagtctcattctgtc

SEQ ID NO: 90661 - DNA, 1007 bp, Homo sapiens
tggtcccgtatcctggattccgtggaggataattacatcgtgttgaacaaagatgacaacgaggagtgtggagacatctgtccgggtaccgcgaagggcaagaccaactgccccgccaccgtcatcaacgggcagtttgtcgaacgatgttggactcatagtcactgccagaaaggtacgccggggatacagggttctaagcagtgtctcgtgccttgttctagaaagcttaaaatgttttatggcttaaaaatgttaaatggtcattaggtaggggccggggaatagtgggtggtggcattcactagcccagggagtggcagacattttctgtaaagactcagatagtagatacttcagattttgcaggccatatggtctctgatgcaacgactcaattctgccactgtattggacaagcagccacaggcatgcataaatgtatgactgtggctgtgtttcaataaaactttatttacaaaaacaagtcgtgggccggattttgctcgagggcagcagtttgccaccgcctgtgctagtcagtgaatgttcttcttgcttgggagaggaaaaggagtggaaaactgtagattcggtttttttaaaaaaatagtttagttcttatctgattatagaagtgatattgcttataatagacatttggaaaaagacacttgtaaacgaaaaaaaagcaaaacattcatcttattccacaacgcatgtcgccgagagtagtttattgggggttgttccttctagtgatcttcaggaatctgtcgtgtctactgaaggtttccttaaccattcctgttattgggcattaagatgatttccaggccgggcacggtggctcaggcctgtaatcccagcacttggggaggctgaggcgggtggaccacttgaggtcaggagttcgagaccaacctgaccaacacggtgaaaccccatctctactaaaaatacaaaattagccgggcgtggcggtgcacgcctgtagtcccagctac

SEQ ID NO: 90662 - DNA, 1036 bp, Homo sapiens
ctcctctctttgttcaataatcctcggccgggtgcagtggctcacgcctgtaatcccaacaccttgggaggctgaggtgggcggatcccctgaggtcaggagtttgagaccaccctggccaacatggtgaaaccccatctctactaaaaatgcaaaaattagccaggtgtggtggcgggtccttgtaatcctagctacttgggaggctgaggcaggagaatcgcttgaacctgggaggcagagcttgcagtgagccgagatcacaccattgcattctagcctgggcaacagagagagactctgtctcaaaaaaaaaaaaaaaaaagaaaagaaaaaagaatcttcatttacccacgtgctttttcagcctctaaacacccagtaccccccaatccccattacctaccactgacctccagcctccaccctgtccagcttccccaggccagtcctccctgccctttccatctcactcttttctcactgttctgcccccagcatctggcttgcatctccgctgctttaccgatggctctcgaagttaatctctcatctcccagttgcgtctcctgcagcctcacctcacttgacccctctgggtttgacattgccagtcccccctcctggaaggctgtgtctcccgtctcacctgtgcctaagttcttctgttttactgttctcttctccttctacctgggctaagatgttggctctctcttcccagagggtcagtgtttcctttaatcttctctcagctcacttttttttttttttttttttcacttcttcacccgggctggtgtgcaatggcatgatcttggctcactacaacctccgtctcctgggttcaagcaatggtcctgcctcagcctctccagtagctggaattacaggcatgtgccaccccgcctggctagtttttgtacttttagtagagacagagtttcaccccattggccaggctggtcccaaactcctgacctcaagagatccacctacctcagcctcccagagtgctgggattacgggcatgagc

SEQ ID NO: 90663 - DNA, 1042 bp, Homo sapiens
ggctgcggcccgcgggtcgcgggcgtggaagagaaggacgcgcggcccccagcgcctcttgggtggccgcctcggagcatgacccccgcgggccagcgccgcgcgctctgatccgaggagaccccgcgctcccgcagccatggccaccgggggccggcggggggcggcggccgcgccgctgctggtggcggtggccgcgctgctactgggcgccgcgggccacctgtaccccggagagggtgagtctgggggcgcgggcgtgggcggggagcgccgcgatggggagaggaccccacccaagccaaaatcgagcccccgcttgtggactgagaaccctccccaggggcggggggcggtggccaggacggtagctcctgcatcgcgtagggggagcgggaagcctctgaccttggcctttgcccgcccgggctcgcgcctccgcgccctgcgtgcccgacctgagcccgaggaaccttgccccggtgcccgccccgccgcgggctcctctctggagcgcgcctccgacccgtgccccggcccctccgagcccaagtcgctccggagacacgacacgcgtcatctttgggtcgcggccgggaagtggggtcactgggtctggacagccccgaacagccaagtcccccgagcgcatatggtgtaggtagagccaagcgccctgagtgcctcaccggtgggtgacgctgcctggggtcagggactgcagagcccccctctacccaactaccttggatctaggcccgtggccaccccggactctaggtccatgtttacccttttgggttctgtttccagatgtccggaggcaaattctaaagccttagcaacagcagcaattgtagcagaagtagtggcggttttttaccctatttattgtaattggtatcaccgcacgccacagcctagtctatcttatctctctggactgtcacagtggcccccggaggcagatacagttatgcacccatttcacagaggagtaaactgaggctcatgtaggacgcataactcccttgccctaaag

SEQ ID NO: 90664 - DNA, 1725 bp, Homo sapiens
acagccctccctggcagggagcgtttgggtgcaaaaccgtgagaactatctgtgccatgggttttagtttcttgtataagaactcagttggtgctttcattgcggacgggaacgagaagctttcccctggtccttacatgtttcgttttgttttacgtttttaaatttcaacttttatttgagattgagggggtacatgtacaggtttgttacctggatatattgcgtgatgctgaggtttggggtgtgactgatctcgtcacccaggtactgagcatagtactcaatagatagtttcaacccttgacctcctccttcccttcccgctctagtagagcccagtttctgttgtcttcttggtgtccatgagtacccaaggtttagctccacttacaagtgggaaagtgcagtatttggttttcttttcctgcgttaattctactagcacttgagtgttttgctgtggctatctgccccttatctcttgctctgttgagattaaagcctggaccacaggattaaaaaacattcttaaagttttaccacggaagcgaagcggccaacacaccttttcccctttgccttgttttcgcggagatgaagctccagccagtagctttgaagggccccattctcttcccattgaccagagagagagttcaggacagtatagacagcccagtggccaagggatgagttttgcaggtgtctgagtgaatgattaatcctccagctgtaagaggtgtcaggagaggctgggcgcggtggctcaagcctgtaatcccagcactttgggaggccaaggtgggtggatcacgaggtcaggagatcgagaccatcctggccaacatggtgaaaccccatctctactaaaatacaaaaattagccgggcatggtagcgggcgcctgtagttccagctactctggaggctgaggcaggggaatcacttgaactcgggaggcagaagttgcagtgagccgcgatcgggccactgcactccagcctggcgacagagcaagactgtctaaaaaaaaaaaaaaagaagtgtcaggagcacaggcttgaggtcagatccgagctgggttctggtcccagttccaccacctgttagccgtgtaacttcactaagtttccgtcttcccatctttaaaatgggaataagggttggttggggtttctatgaagtaatctgtgtaaggtgcatcacagaagtgtctggcatatggcaaactttccatcagtgttatacaccctttgcatatgcgaatgctcccaggcttggatgtttaggttaacattccaaattataaagagtttggaaaatttgagcatctcggatgttgtttggaccgagtcagggtttacgctttatcagtagtttcctatttctgtaggtcagcaagcctttttgcgaaaaaaaaaaaaaaaaaaaaatgaagatgtgtttgttctagagcaaaaaagagcaaacagctggcaggcataatacatttcatttttgtaaacgttactttgttttggttttgtatagcttatttagtttttgttttcttctgaaattagtatgtgattttacttaaaattttttttttctttttagagacagggtctcactctgttgcccagactggagtgcaatagcacaatcatagctcactacagcctcgaactcctgggctcaaataatcctcctgccacaaactcccaagtagctgggactaca

SEQ ID NO: 90665 - DNA, 1114 bp, Homo sapiens
gactggagatctcctctcaaacaccgcatcatcagtcccacaacaaaatgtgttctaacttttcttttttttttttttttttttgagatggagtctcaccctgtcacccagactggagtgcagtggcaggatctcggctcactgcagtctccacctcccaggttcaagcaattctcctgcctcagcctcccaagaagctgggattacaggcacacaccaccacacccagctactttttgtatttgtagcagagatggggtttcaccatgttggccaggctgatctcaaactcctgatctcaagtaatccgcccatcttggcctcccaaagtgctgggattacagtcataagctaccccaccaggctgttttaacttttctaaacagatgtgtaaataatttttttttggaaacatggctcatgggtcatcagtgactgtctggacagctcagggattaatagccgggaggagctaagccccagttcctcctcgttccattgtgctggggtttcatggattattactgagcccatttgcacggtccggtctgcgttcaggagaatattgtcccatctatcttcagttagctgtttgagtattcgggttgggtgtgagggagctaacagttggccccttgctctgttctcagattcttgaggtttatttcccccttgaattgtcccaacagtcctgtgaggtggatgtcatttattacttctgcacagatgactaaacaatctcaggggagcctggtcattaattggccatgatcaaaaaggtagtgaaagcacatggcagcactttgggaggccgaggcgagcggatcacttgaggccaggagtttgagaccagcctggccaacatagtgaaaatccttctctactacaagtagaaaaaattagccgggcgtggtaatgcatggccgtaatcccagctactcgggaggctgaggcacgagaatcacttgaaccaacccaggaggcagaggttgcaatgagccgagatcgcgccactgcactctagcctgggtgacagggcgagagactctatctcaaaaaaaaaaaaaaaagcacgtggcagaataagattcaaacccgtgttccacctgatgcc

SEQ ID NO: 90666 - DNA, 1027 bp, Homo sapiens
ctcacgcctttaatcccagcactttgggagtccaaggcgggtggatcacctgaggtcgggagtttgagaccagcctgaccaacatggcgaaaccccgtctctactaaaaatacaaaattagcgggcgtggcggcgcatgcctgtaatcccagctactcgggaggctgaggcagaagaatcgcttgaacccaggaggcggaggttgcggtgagccgagattgcgccattgtgctccagcctgggcaacaagagcgaaactccagctcaaacaaaagaaatactaagtcctcaggacacagcctggaatgcaagaagcactcaataaatagtacctgttgctacgaattaccacatttttttaaatggtattttgggggtttgacgtgtagtttggggtaggaggcttttcgttttgttttttgtttttggatagtaccaggtttgggaagaatattctgagtcatacttaccttctaagctgcaagatgtcttttttaatttttctttgtcccctgaggtgcgggatgaaggggtttttttcttcctcctacctttttattctttttaatactgtcttgcttgtgtaacatcaaaatgaggcaagaaagagaaatcaatgaagtcatcttctcatcgatttagtctattcccaggtggccgaaaaggcaggaactgtgaactgaaaacttcatctggcatcagattttctttaattgtctctcgaacactcaccagtaagccagtgcttgctagaactctctagagccaggttgcactctcagcctaaaagaaaagtcttggctgaaacaaagaacagaaggatgggtggggacagaaaacctccctaaatgtgagaaaaggagtcattatttctgagaccaggccttgaaaccgaggtgcttgtctggttcacttgtttctttctttttgtttttgttttgttcagagacagggtctcactacgtcgcccaggctggaatacagtggtgccatcatagctcactgcagtctcgacctgctgggctca

SEQ ID NO: 90667 - DNA, 1048 bp, Homo sapiens
tgcaagatcttgctttccgtttccgagatgttaatgcgggatcttgctgtccgtttccacggtgttaatgcgggatcttgctttccgtttccgagatgttaatacggggtcttgctgtccgtttccgagatgttaatgcggcgtcttgctgtccgtttccgagatgttaatgcggggtcttgctgtacctttctgagatgttaatgcaggatcttgctgtccgtttccgagatgttaatgcgggatcttgctgtccgtttccgagatgttaatgcaggatcttgctgtccatttccgagatgttaatatgggatcttgctgtccatttccgagatgttaatgcgggatcttgctgtccgtttctgagatgttaatacaggatcttgctgtccgtttctgagatgttaatacaggatcttgctttctgtttcctagaaaattggcaacttctccatcgtgcggcggcttggcgtgcaggagtgcattctcctggttacacaacgcataaccaaatacccagtgctggtggagcgcatcatccagaacacggaaggtaggccttctccccactgccccgcccgcccgtgctgctgcagcacagggctctctccgtgtacccactccctatttgagcagcaaactgaataaattccctttgaaatccagtttgctgggtgctggggttccttccttttttttttttttttttttaagagacagagtctcactctgttgcccaggctggagtgtagtggtgaaatcatagctcattgcacagcctccaactctggggctcaagtggtccttctacctcagcctcccaagcacctgggactacaggcatacgccactacacacagttaattttttttaattttttttttagagatggggtctcgctgtgttacccaggctggtgtggaactcctgggttcaagtgatcctcccacctcggtctctccaaagtgctgggattacaggcatgagccatcacatctggcctgggtttttttgttttgttttgttttgagacagtcttgctgtgtcc

SEQ ID NO: 90668 - DNA, 1276 bp, Homo sapiens
cttagcttctgcattcgatagatgctctacctaggtaaaaattcagctctgggccaggcacagtggcttatgcctgtaatcccagcactttgggaggctgaggcaggcggatcacttgaagtcaggagtttgagaccagcctggccaacatagtgaaaccccgtctctactaaaaataccaaaaaaaatagctgggcatggtggcgggtgcctgtaatcccagctacttgggagactgaggcaggagaatcgcttgaacctgggagacaggttgcagtgagctgagattgcgccattgtactctagcctgggtgacagagccagactccgtccaccctaccctcccccccccaaaaaaaacctaaactctgacgtgttgcatttattttggagaactatttgcatctcaggagattacatttgggaagtgatcttgagggtcttctgagtggtggccttggagaacacacctcatagatcccacacgcccatacatagtgtgtccacacacctcatagatccacatgtccatacatagtgagtgtgtccacttctgttgtgttaaagtggaaaagaaagacgctaactctgctatgtgtggcagctggcactgaggactatgaagacctgacccaggccttgaacctcatcaaagatatcatctcacaagtggacgccaaggtcagtgagtgtgagaagggccagcgcctcagggagatcgcagggaagatggacctgaagtcttccagcaaactcaagaacgggctcaccttccgcaaggaagacatgcttcagcggcagctccacctggagggcatgctatgctggaagaccacatcagggcgcttgaaaggtaaaggcctgcccctgcccacctctagtgggtgccatcttggatcagtgggcactgtcttggagtggtgggcactgtcttagattagtggcaccatcttgtatcagtgggtaccatcttggagaggtggtcaccatcttggattggtgggtactctcttgattggtggcactatcctgtatcagtgggtaccattttggagtgttggttcccattttttattggtgggtgccatgttggattggtggcattatattggattggtgggtgctatcttgggttggtagcaccatcttgggagttgtgggtgccctcttagagtgatgggtgccatcttggatcagtgggcatcatcttggattggtaggtgccatatgggattagcagcaccatcttggagtggtggcaccatattggattggt

SEQ ID NO: 90669 - DNA, 1015 bp, Homo sapiens
cccagctactcaggaggctgaggtgggaggatcacttgagcccaggaggtcaaggctgcagggaacaatgattgcaccactgcactacagcctgggtgacagagcaagacctggcctccaagatagtttaaaaaaaaaaaaaaaaaaaaaaaggtttctaggatttcactgcaatagtatcttttttcccccagatggcaaaatatttccgctttgaattgtttgaaaagaaatgaggagcgtgacccccactcttagttcccctcaccaggcccttgacctccctgctgtttgggtgctgtggggtaaagggtgacctccccaatgccctctactcatgcaggactcaaagccacccgtcatctcgttacaaaagctcatcgtgagggaagtggccaacgaggagaaagcgatgtttctgatcagcgcctccttgcaagggccggagatgtatgaaatctacacgagctccaaagaggacaggaacgcctggatggcccacatccaaagggctgtggagaggtgaggagggcctgggggtctccccacccactgtgttccttccgctgattggtccacccttggcttcgaccgttggccatcagctgtgaccttgaactccctcatcccagcttgggacccatgacgccattccagctccttctgatgactcaacctgttggacgttgaggccaacgggcccagaaaggcagctgtaacctgggcctttctgcatgcgtgggccactgcacctgccatggcgggctctctgcattctagggccagatttgttggagcagggcatggcatcttgtccttcctccttgggccgagcacccctcagggcccagaaccagctggcttcccctccctctctttattttttatttttttgagacagagtcttgctctgtcacccaggctggagtgcagtgatgcaatctcggctcactgcagcctccgcctcccaggttcaaacgattctgctgcctcagcctccccgagtagctgggat

SEQ ID NO: 90670 - DNA, 1050 bp, Homo sapiens
ctctttctttttttcttttcttttttttttttttttttgagatggagtctcgctttgtcacccaggctggagtgcagtggcgtgatctcggctcactgcaacctccacctcctgggtttaagtaattctgcctcagcctcctgggtagctgggattacaggcacccaccaccacgcccagctaatttttgtatttttcgtagagatggggtttcaccatgttggccaggctggtctcgaactcctgacctcagatgatccaccctcctctgcctcccaaggtgctgggattataggcgtgagccaccgcgccctgcctcaatctgctctttcaacagtgagggaagccgactcagcccctgccttccagagcctttccgcagaataagacggcagagacgggggtcagtctttctccctccaggcccactgacatccttccacccggctccagtggccattgttcttggccccctggggacactctcatatcccgcaccttggcctggaatgttcttgtccccacctctgtgcctggccacagcctgttggtcctagagggctttctgtagacagcccttccccacaaagtcactctcccatatggccattgtcacacaatcagtgtatggtcattgtcatataacacaccaagtgtttcctgctggccctgggcagggccacatccagcattcgccagcccctggcccagggcggcctggtggaaggagctgcaggagcctgtacccgccctccccatggctgccccacagccctgtcctctcacttagacgcagattggcctgtcctggtggccatacctgaagtaagggtgtgcgcagggacagtggggctgaaatcccacggcacacagaagggggcaggcgatcaccaccccagtgagtccctccgtccacccgggtctcgctgccccagcgctccgtattcccccagcacacttccgcagggcgacccgtgcctcctgtccccttccttccacagtcgagggcatccagagcctgatctgcaggcagctgggcagcgccaacgg

SEQ ID NO: 90671 - DNA, 1037 bp, Homo sapiens
cttgcagctgtttctgtagggttagcggtggtgccggggtcactttctgaatctctttttttttttttcaaaaaggaaagtttttaatggaaagttgagccagaactaaaccagggagctgtctgaaatcatagcaccccatccgggtggcggggagatcaactccgagctgtttttccgaggcagtgaggaacggtgccggctctgcacggagctgaggacaggacagaccttgctttgagaaggagctgccggccggggccacgctccacagccgccgcgcgacagtggagccaagggttagggcaccaggaggggccaggtggcgtcggcagcatctgtccccagaatcaggcagaatccacttcccaaacagagccccacgcaggttcaccatgaacctcagggtcagggaatgagccaggcacgggggcatgggcagagagggccacggggcagggcccactgagggaacatcagtggccctccagtcaggttctgtgggtttggaagcccatcgtgaaaggggctgacctttgcccctttttacttggcattggttttgaaaccagctgtttcccaaactctgcttcccaagggcaaccgttgctgttcacacgctcagcctgtctgggggagcgggcctctagcttcagccagggcgggtacacaccctgggcacagggtcctcagcccccgggaaatgagctcccagggctggcgtcccaccttccaggtgggggctggcacatcacagactgtcgagagcgccatgtcccagggcatgcagaggatgcacctagagacgttgcagcaagtggacaagtggccgctgtgcgggcccctcgcttgtagtgagctgttgcagcttacggtccgttccctggaggggtggaggaaggaggtgttgggcagcatcaaaggtgctgggacatcccagggtggtgagatccatccacgatccagctccggtggagaaagggcccatgtcaagccttgttctgcaccccaagcattggtggtaggactgggtcctg

SEQ ID NO: 90672 - DNA, 1076 bp, Homo sapiens
tgagcccaggagtttgaggctgcagtgaggctatgatcgcaccactgcactccagcctgggtgacagagatcctgggtcaaaaagataaaaatcaaggcagtgcaattgatatcacatgaggcccaagggcgcacacacactggctgttgtgtgttcctgggccaggctgtgcaacaatgtctgccagaggccacatgtgcacagactctgaagggttgttctcagccagcagactaagcagtgccctcatcccatcccaccacacattggctgaggtgggagccccaagtatcttcagcgatgccagtgtgtgttgcccagtctcagcctggagcccttaaaatgctcacagtggccctgcgtcggcagcacagtggcatgaggccacgccctcgggtggcctgatgagaggtggcgcctctggcctgtgtgcccaggactctggggagtagagaacagccctcaatggctggaggccacttggggtccgtgggcaacgcttgctcaaagatggagaggacccaccgggctgagggcattcctgaaggtgggctggggtagtgtggtttccaactttgggtccgtcctgtggagggtaaggggccaggagccagcagtgtaataaccttcacccctgagccaggcgccagcaccacaatgtttaattgattcccgttccagctttctcaaggcacgacaggccccctcttcctcatcttgatttggatacaagacgccagctggcaggcaggaggtgctgctgaagccctgcacggcccctgaaaactgtcacggctcaggagctccaggctgaggcctgggggacctcgcatcagtccctccacccaccctgcccatgggtttcaccacaggcagctccatgagagccccggcccctgccctggcggcttctgctttgcgggaagggccctccgtgggctctggctgtgtccctgtgctcttccggcagtgtcagggggtagtggcctcggcctggccgccggcccgggccgcctggtacatgctgaggattgaggagatggtgcccatgaggcccactagccacggcgggaag

SEQ ID NO: 90673 - DNA, 1118 bp, Homo sapiens
cccttctaaaatgtccatgtcctgaacctgtcaacatgttcacctccaaggcaaaggatattttgccgatgggattaagctaaggattttttctttttttgacacggaatcttgctctgtcgccaggctggagtgcaggggtgtgatctcggctcactgcaacctccacctccccaaattcaagcaatcctcctgcctcagcctcccaagtagctgggattacaagtgtgcaccaccaagcccagctaattttttgtatttttagtagagacagggtttcaccatgttggccaggctggtctagaactcctgggctcaagtgatccacccgccttggcctcccaaagtgctgggattacaggcatgagccaccacgcccaacctaagctaaggatcttgagatggggtattaccctggatcatccaggtggtccccatgtcatcataggggtccttataggagggaggaaggaggatgagggtcagggaaggaggtgtgacgctgaaagcagaggtcatgcttggaagatgaaggaaggggccatgagccaaggaatgtgggtggcctccagaagctggaaaatccaaggaaacggacctccccctgggacctccagaaggcatcagcgcctgctgacactagcccagggagtgttctgacttccagccttcagaatcctaagataagaagtttctgttgcccagcactacagagttgtgctaatttgttccgacagttattctaaacaaatacacccacaaaaggaagaaacaacaaaacctccaaggaaaactctaagaggcaaagacccaccgcagtctgaagcctgtgctgttgctggggccgctgccactttgctaaggaggcaccgcccagggaccttgggtgctcccttctggcccatgccacttacctggcaacccccaggagcagagagagggcccacagggttgtactcagcgtccaccaccgagaagagtccacgtggaggacccgggcatcagccgcccaggccacgtgctcacaggggtagtagagctggtcagccaggttccctaggacggagacacagcggacaaaggcgtcctcctcctgcaggaccaggagcagagggggc

SEQ ID NO: 90674 - DNA, 1049 bp, Homo sapiens
tgtagtgagctgagatcataccatggcactccaacttgggcaacagagtgagactctgtctcaaaaaagaaaagaaaagggacccagtcatggtacttaccctgaaagtttgggtttaacacagaatcggacatccagtaaacatttaatgaacgttagtccctgcagtgagatagatgagtccccaccctgtgttgtacgggggaggacacagtggtgggcgtggcatggagcttatgccaggaggtggggtgaaattaatcaaagcaaagaaatgcacaagtgaaatccgtgtttgtggcccaagttagcagggccctgccccaccccagtggacatctgcagggccctccctgtcctcttccagggcctgtgccctgagggagatacaccccaacccccatcctagccatgccaacctctactaccctctccccagctcatcctgtttgggctcagtaatcagctggctgtgacattccgggaagagaacaccatcgccttccgacacctcttcctgctgggctactcggacggagcggatgacaccttcgcagcctacacgcgggagcagctgtaccaggccatcttccatgctgtggaccaggtgctggtgggcgggcaggtgctggtgggcaggcaggtgcaggtgggcgggcaggtgcagttgggcgggcaggtgctggtgggcgggcaggtgcaggtgggtgggctgcagagagcgggccggactcacaggccctccccttctctgcccacagtacctggcgttgcctgacgtgtcactgggccggtatgcgtatgtccgtggtgggggtgacccttggaccaatggctcagggcttgctctctgccagcggtactaccaccgaggccacgtggacccggccaacgacacatttgacattgatccgatggtggttactggtgagtgggcaggacgaggcttcactgttgggagcctgagctgctgggattaaaatcaacagctgtggctgggcacggtggctcacgcctataataccagcactttgggaggctgaggagga

SEQ ID NO: 90675 - DNA, 1467 bp, Homo sapiens
actacaatgtgagttttgcacatgcagctgggccttccacatggttactccacaccctccaaataaatccctacacacgcagccctcaccagccccggccaatggccccttgcaagcctcctcctcctacctgcccacaccagatatatctgtcactgcacctgcgcggggccccgggagcctgctcctttgtgcccacccagctgagtctagccgtgcgttgccctcggaccccctcagacgtggccacgccccctctaggcacccactggctcccatgaccacaccggctgtgccctcggcaaggccccgcccctcccacccccatctgggtgcccacagctgacctgagttgtggccacaccctcaacgaggctccctctgccccaacccagatcctcatcgccacactgcgggtggccctgcccagcgtcatgcgcttctgctgctgcgtggctgtcatctacctgggctactgcttctgtggctggatcgtgctggggccctatcatgtgaaggtacatctaacccctgatgtccctgacattgaccctgtgaccttgtcattgacactgtgacccccagatgaccccttggtgactgctgggagtctgtccactgtcccctgtggtccttggtgaccctgacactgaccctgtgccattattgttgtcacagttgttgatgaccctatttcgacctgaattactcccctcctgctctatctacccagaccctaggtcggccctgtggccctgtcattgacccgtggtcccggccattcacatgggaccccagcctgggacctggccattcacatagtgaccccagcctgggacccggccattcacgtgggaccccagcctgggtcccggccattcacgtgggaccccagcctgggacccggccattcacaggggccctagcctggaacccgaccattcacatggtgaccgcagcccgggacccggccattcatgtggggccccagccaccagctcctagccatttgcatgggaccccagcctgaccccagcccccggttcctggccatgccttggctccctctgaccccgccgcccctctggcagttccgctcactctccatggtgtctgagtgcctgttctcgctcatcaatggggacgacatgtttgtgacgttcgccgccatgcaggcgcagcagggccgcagcagcctggtgtggctcttctcccagctctacctttactccttcatcagcctcttcatctacatggtgctcagcctcttcatcgcgctcatcaccggcgcctacgacaccatcaaggtcagccgcatgcacccagccctgagctcgggctctgggtgccctggagtctgccatgagggggtcttggggacaccgcagggtgaacagagaagacccaggagagaatatgggagactctatgaaaccaaaaagagggtggttcagaactggggggcgc

SEQ ID NO: 90676 - DNA, 2029 bp, Homo sapiens
ttttgattttaattccggctgggcacggtgactcacgcctgtaatcccagccctttgggaggccgagggggggtgggggtggatcacctgaggttaggagttcgagaccagcctggccaacatggcaaaaccccatctctactaaaaatacaaaaaattagcggacgtggtggcaggcacctgtaatcccagctactccggaggctgaggcagtagaattgcttgaacctgggacgtagaggttgcagtgagccgagatcaagccactgcactccaacgtgggcgagagaccgagactctgcttcaaagacaaaacaacaattttttaaaaattttaattcaaatgaagtacaattgcaaatttagcctctgacttgcaccatcctgtatccagtgctcaaaagccagtgtggctggtggctgccatattggacagcatagatattgaatacttccatcgcctctagactgaagagatgggagcccaggggcagtgcaccgaggggaaggaatagctaaagcaaaggtctagtagcctgaaaaaacttggagaaaagatggcccctccatgaggccgagtgagaggaaggaagccttggctgggaccctgccacatccaatgtcaccggcagatgggtacacccccttttccccatgcatggattcagctgtcccacagacacattgactcaggcccttggaactacttcctgtcttgccttagcacgtagacatcacacacatgcatccactcaggtgggcagtctcaggccctgctcccactgctgtgctcagcgtgcatccagctcactcaatagatggtttctgagcatcgaggtcatgtcagccctggctctaggtctgtaggtgctggacctacagcagaaggcaaagacacagactggcaaagacacagcttgtatccaggttcaggggtcagggaaggtccctctgtgcaagcaaactgtggaacaacgggtggagcaggcccagcaagtgcaaaggcccggaggtgggaagcgatgcagatatggctggaggggagggcggacttcaagggccttggaggttgggagccactttcaggctgagcctcccggcttctctccccagcatcccggcggcgcaggcgcagaggagagcgagctgcaggcctacatcgcacagtgccaggacagccccacctccggcaagttccgccgcgggagcggctcggcctgcagccttctctgctgctgcggaaggttcgagtcccgggtctggcacattcagattggaggttagggaatggggaaaggggagcgagccagagaaaactgacgcccctcttccctgcttccttcctccagggacccctcggaggagcattcgctgctggtgaattgattcgacctgactgccgttggaccgtaggccctggactgcagagacccccgcccccgaccccgcttatttatttgtagggtttgcttttaaggatcggctccctgtcgcgcccgaggagggcctggacctttcgtgtcggacccttgggggcggggagactgggtggggagggtgttgaataaaagggaaaataaatgtgtcgttttcatttttagcgggaggagcagtccttgcgttaagcggtgtgaggccctttaaggcgcggccacactcagcatggcggcctcagtcggccttccaagcatggcgcggggaggaggggtgggagggtcgggagggactgcggtgcgactaggagtgaataatttaaaggggccgtgcctgcggagccgggcggaacgctagcggtgttggcgcggagtggaccccggctgcggcccctgggtgagtctgggtttccgttagcctcgcaggggtgtcccttcgagggtcgttagcgagcctccgctttcccacgatctgtcctccgattcctgttaactctagactttctgatgttcccataccccccacgtctcggcaggtgtttccacaccggtagccagctgtgccctgaggtggaagaggaccggccacccaggaa

SEQ ID NO: 90677 - DNA, 1050 bp, Homo sapiens
ccctggaggtggaggttgcagtgagccgagatcgcaccattgcactccagcctgggaaacaagagcaaaacttcgtctcaaaaaaaaaaaaaaaaaaaaaaaggtggccagcctgatttggccagcgggccagagtttgctgtacatgagccctggggaaaggggtatgcgggggtcttaggtttgcctgagccttctccgtgcccccctcacccccggcacccctcccctcccaccaggatcctgcgcatccagaaagagacgcccacgctgcagcggaaggagcccccgcccgcagtgctagaagctgacctgaccgagggcgacctggctaactcccatctgccctctgaagtgctttatatgctcaagaacgtccggtcagtgttggggtgcaggtgggggtggagggctgcagacgtggggccgccctgacctccagcctctgtcgcccaccgcctgtccaacagggtgctgggccacttcgagaagccactcttcctggagctctgccgccacatggtcttccagcggctgggccagggtgactacgtcttccggccgggccagccagatgccagcatctacgtggtgcaggacgggctgctggagctctgtctgccagggcctgtgagtgggcctccccaggggctgctgcaggaggatgggtggtggggatgggcagcaggcattggtctgtagagctggtggtctttggagatgcgtcatcgggagtcaggggaacgggtgaccgaggacatttggggtagtctgcgtagttgctcagtagttacaagtattgaacgatgggagatgcctgctcgttggaagggttggtgggttcccctgagaagggatgagaagtgtcagtgatcattgggatggatgagggggcgacatgccagtcaccagggcgaggccactgagggtccacggtctcctgtgtctcaggacgggaaggagtgtgtggtgaaggaagtggttcctggggacagcgtcaacagccttctcagcatcctggatgtcatcaccgtgagtgaccagtttctg

SEQ ID NO: 90678 - DNA, 1034 bp, Homo sapiens
tctctgcccccaggagatccagcccctgcgtctgttccccagccccggcctcccaactcgcaccagccctgtgcggggctccaagagaatggtcagcacctcagctacagacgagcccagggagaccccagggcggccacccgatcccaccggggccccgctgcctggacctacaggtacccagggacccgaggccagccgagcccaatctcccaggaagccccgtctcagccgccagcccctttttcagttctgcatagagtcaacctgaccttgtccagccccacagggactccatagcggggtacccaggtctgactcctatctggtaccgaggaagctgtggcctcgtccccaagggcccattggaattgctttaactagttaatcagtcgccagcatctccttatctcccaacctgctaatcctcctagtggctctgaggggcaggagcctgaacatgtgtctcccccaggggaccctgtgaagcccacatccctggaaaccccctcggcccctctgctgagccgctgcgtctccatgccaggggacatctcaggtttggagcactgggtctgcggggagggccatggagcttccaggtttgaatccaggtccaccgcctgcctgtcttgattgttttaatctgcgaaatgggaacactgccagtacttccccaggcactgttttgtagatattcattgagatagtgcttctcccacctgttaagagggattcagagggagagtgcaggcgttgattagtcatgtctgctacagcagtggcccatggcacattggtatccattggtctcagactgcaactgtggttactctcatctttttcttttcttttgagacctgtctcccaggctagagtgcagtggtgctgtcatagctcactgcagcctcgaactcctatgctcaagtgatcctccagccccagcctcccaaatagctggaactacaggcctgcaccactacacctggctcattttttaaaaatcttactctcatctttatggtttttgttgc

SEQ ID NO: 90679 - DNA, 1746 bp, Homo sapiens
tggggtccacgctgtccgggttctgtgttcatcacatcccctgcccgcacaggacgtgagcctgcacttcgtgctctggggctgcctgcacgtgtaccagcgcatgatcgacaaggcggaggacgtgtgcctgttcgtagcgcagcccggggaactggtggggcagctggcggtgctcactggcgaacctctcatcttcacactgcgagcccaacgcgactgcaccttcctgcggatctccaagtccgacttctatgagtatgacagcccgaagttggagtgtgggtggcactcggaggaccccaacccgtgggagtggccagaaccccatccctcaacctcactcctggaagagcagaagggagcccccagatctggcctcccagcgccggtgtaggacggttttgaggccttcctctttcatcccaagtctgttcctgcaggatcatgcgcgcacagcccagtgtggtgctgagtgcggcgcacacggtggcagccaggatgtcgcccttcgtgcgccagatggacttcgccatcgactggactgcagtggaggcgggacgcgcgctgtacaggtgcagctcccaccgcgctgctcaggcccggcctaggggtggggacctgggggtggtcagaccttgctgacctccacgcccactcaggcagggcgaccgctccgactgcacttacatcgtgctcaatgggcggctgcgtagcgtgatccagcgaggcagtggcaagaaggagctggtgggcgagtacggccgcggcgacctcatcggcgtggtgagcgcgacccccacccactgacctctggccttttccaggccagtccctcgacaactcacacacatcatcccgggtaatccagggagtggtgaatgcagctcccgacctctgaggtcacccagtccactccccgcccagacctcatttcgttggaaaaaggggattccgcctgtcgtggatccctgtcctctccctctccccagagctctaatgggtagcgagcgaggcttgcttccctacacccccattgcaggggagccctagatggggcagtacagccccctttccacccatcttcggcctcctcattccccacccaagcagccccaatcatgcacgcggccccccaggtggaggcactgacccggcagccgcgagccacgacggtgcacgcggtgcgcgacacggagctggccaagcttcccgagggcaccttgggtcacatcaaacgccggtacccgcaggtgcggcctgttgtgggcggggcagagaggcggaggcgggactccgggggggtgggggccgggcctagtgtgtgggcggggcttacagaggggcggggtcgagggaggggccgaagcgagagagtgagggcgggggctctcgggggtgggacccaggtaacgggcacccaggagccccggcataggagggagaggtgggacctggacagccgcttcccaggtctcactgaaatgccggcctccaacgcccccaggtcgtgacccgccttatccacctactgagccagaaaattctagggaatttgcagcagctgcaaggacccttcccaggtgagagccggccggcccagagcgtgctgggagatgtagtccggcgtccagagcatgctgggagggaagccttctttcctgagggatgctgggaaatggagttccgcgaagaaatcgtgcccctgagggtttcaaaccctaagtaggacccaggtgcagagca

SEQ ID NO: 90680 - DNA, 1050 bp, Homo sapiens
cacaggggcggggtaatgggtattcttttctgagttaggccccagccctgtggaccatggttcccagcctcccttccccacctacccctaggtccgacgctactccttaacagtgacatcatccgggcacgcctgggggcctccgcactggataggtgtgtgttgcagaagggagtggggagggtggtgggtgggcctggagcctcaaattctttcagacctgagttcaagttcttggcttccaaccacggagcctgcgtcttacccataggtcaatggggagattcgcagtggtgtgaatctgcccaccggagcacggacttccgtggtgggggtttgggtgtctaagttcctcccagcaacggagctatgtggtctcggggagcacactgaccccaggccaaccccaggatgacgctgcccccttcccaccctagcatccaagagttccggctgtcagggtggctggcccagcaggaggatgcacaccgtatcgtactctaccagacggacgcctcgctgacgccctggaccgtgcgctgcctgcgacaggccgactgcatcctcattgtgggcctgggggaccaggagcctaccctcggccaggtcggaagcccgtgccccctgatctcacccacctcgggtcccgtcctttgccctcccgtgcctgcaccaggccacgtgcaccctcgccatgggggtaggcgatcagggacccaggtgtggccaggtggtggtggggcggctggtgacctcagccgtccgtattccgcagctggagcagatgctggagaacacggctgtgcgcgcccttaagcagctagtcctgctccaccgagaggagggcgcgggccccacgcgcaccgtggagtggctaaatatgcgcagctggtgctcggggcacctgcacctgcgctgtccgcgccgcctcttttcgcgccgcagccctgccaagctggtgaggagcgggccggcccccaccttctaggggcgtggctggtgggcgaggcttgggagactggggcggggcctgggagggctgaggacagg

SEQ ID NO: 90681 - DNA, 1011 bp, Homo sapiens
tactgaccctaacccataacccccaacgagagcacccagggcccttggtgaccaccttgtggatggccttggatgaccacatcatccctaagtgttcctttttttttttttttttttttttttttgagactgagtcttgctctgtcgcccaggctggagtgcagtggcacaatctcggctcactgcaacctccacctcccaggttcaagtgatttatccgcctcagcctcatgagtagctgggattacaggcacgccccaccagcccggcaaatttttttgtattttagtagagatggggtttcaccatgttggctaggctgcttttgaactcctggcctcaagtgatctgcccgccttggcctccaaagtgctgggattaccagtgtgagccgctgcacctggcccctaagtgctgcttgctcaccccctattgatgaaccttatctgtgaccccatgtaactcctatttgaccctgtctggccccttgtccctagagcatgacttcggtgctggaacctgtgttggacctcacgtacccagtcacctccatgttcactgggtctgcctttaaccgcagcatccatcgggtcttccaggataagcagattgaggtaggcccacctcatcccctgccctgcctacccctccccggaggagccccctgctcctcccccacctcgatccctgtccccgcaggacctgtggctgccttacttcaacgtgaccacagatatcaccgcctcagccatgcgagtccacaaagatggtgggtgtccccgcccagcctgcagcaaccgctgacgccacgtggggttggggggatgcttccgggagggccgctgagcttctgggacgttgttaacacgagtgaccgtccaccctggcccgatcaccgaccactaaccgccacccactaatgccccggagaccccaggtacgtccgtccttgggggaggggagcagggagactcgtcggacgccttacccccctcacgccatccccgcagg

SEQ ID NO: 90682 - DNA, 1511 bp, Homo sapiens
agaatcaggcttttgaggggccagagaatgggcagacagagtggggacaagcaaagcagggttgcagacatggacccagcccctcatttcccacaggatgtgggctaccagtacgggaaggcggtgtttggaggctggagccgtggcaacgtcattgagaaaatgctcacagaccggcggtctacagaccttaatgagagccgccgtgcagacgtaagcctgtgatgcccccagggccactctgactccactgattacagaacccaagcccccttaaagtctccccgaaacctcagatgaccccacatgtccctgggttttgctgagctctcagacctctgctgacttcagagagttcccaccctaggatctcctctgagcccccaatgcaccactgggccccccaggggccccaagactctgtgggccccccctaagagcctcaccagtgtcaccccacaggtgcttgccttcccaagctctggcttcactgacttggcagagattgtgtcccggattgagccccccacgagctatgtctctgatggctgtgctgacggtgaggggcccaggggaccccccaagagggaggggagtggctggagatggcaggccagccccaatcccctcacctgtgccctgctccccgattccaggagaggagtcagattgtctgacagagtatgaggaggacgccggacccgactgctcgagggatgaaggggggtcccccgagggcgcaagccccagcactgcctccgagatggtgagagtgggtggcccagggtcccctcacatcccccagagggtcatgagtacagtgtcaggcaggggagccgggggcgtatttgagatcctgtgtgtgctgggtgctggctgacatgtgacgcatcagtgtcccgtgctgggtgacgtgtgtgtgaccttccctcgcaggaggaggagaagtcgattctccggcaacgacgctgtctgccccaggagccgcccggctcagccacagatgcctgaggacctcgacaggggtcaccccctccctcccacccctggactgggctgggggtggccccgtgggggtagctcactccccctcctgctgctatgcctgtgacccccgcggcccacacactggactgacctgccctgagcggggatgcagtgttgcactgatgacttgaccagcccctcccccaataaactcgcctcttggaaatggcttcctgtcgttttcggactggggacccaccttctgtgctcaggatggctggggctggggtctgacaccacctggtgcttgccccccacagggaatgcctttctagaatccacacggagccccactaggtgcttgtccccactctgccccttctctggctcctcagaagccagtgctgactccggaccacagggccagacattccgtgccaccctcccgggctcacaggtgctcttgggggcccgatatggcacccctcaatttctttctgtgtgttttttgttttttgtgtttt

SEQ ID NO: 90683 - DNA, 1075 bp, Homo sapiens
ggagctggggttcgcgaagccggccagagcagtcagggagctggacggccggggctcaggaccagggtcagggctaccccctcccccccaaggtgggcttgggggcccagcaggtcagcacccctcccccttgctgatggctgctcctctccccccagcacgcaattgccttctgtttgaaggagtcggggagcaaaccccccatggtaatgtatcccccgccccggggtcccaggagtccctgtccccagcccccgctgctggcctggctgctcgaagacatctcctctgcctcttgctgctgcccctcccctgctccaggctggccccccaactctgtctctgggacccccagcttcccgccccctcatggcggaaaccccaggcctccctgcccagcctgcatgaccgctgaccctgggggccagcctggccactcacctgacctggctcccatctgcagatccgataccgcaaggaccgtgtggtggcgcgacgtgccccctgcttcccgacggtgaccagcctccaggacctggccagtggggccgcgctggccgccaccatccactgctattgtccccagctgcttcgacttgagggtgagtaaatggatgtggaacagatcttgtgccggggagctgggcatcctaagtcccagcccctagaccctccatccccaggtccgcgagaccagcaacgatgcagtggtcatgagggcagcttccggaactggcaggcctgagtttgtgtctctctcttccccaatgagctttgtgacctcacacaagtatataaacctctctgtgcttccaggagttcattcctgcagcagatgaaacgtatggagtgtggactgtgtgccagaccttgttttaggcactggggatccagccagaatagagacacactccccacttcacagacggctctagctgggagagaaagatactaagtttatccaaaagtacttttttttttttttttttgagacgggagtcttgctctgttgcccaggctggagtgtaatggcatgatctcggctcactgcaacctccacctcccaggttcaagc

SEQ ID NO: 90684 - DNA, 1034 bp, Homo sapiens
ctcagggttcccagggtccccatagtgaccactcatcgcctcccccaggctccctgaagtcttccccgtccatgtcccatatggaggccctgggcaaggcctggaaccggcagctcaggtgagtagacctcacaggccagggtagggggtggagcaggctagggcgggttggggccgaggctggtcccaggggctgacccctccctccggccgcccagccgtcccctctcccaggctgtgtcattcagcaccccctttggcctggacagcgacgtggatgtcgtcatgggagaccctgtgctcctccgctctgtgagctcggacagcctgggccccccgcgtcccgcgccggccaggacccccacccagccacccccggagcctggtgacctgcccaccatcgaggaagctctgcagatcatccacagtgccgagccccggctcctcccagatggggcggccgacggcagcttctacctccactcccctgaggggccctccaagccatccctggcctccccctacctgcccgaggggacctccaaaccactgtccgacaggcccaccaaagcaccagtgtacatgccacaccccgagaccccctcgaaaccatctccctgtctggtgggggaggcatcgaaaccgccagccccatccgaggggtccccgaaggcggtggcttcgtccccagcagccaccaactccgaggtgaaaatgaccagctttgcagaacgcaagaaacagctggtgaaggcagaggctgaggccggagcggggtcccccacgtccactccggccccgccggaggccctgagctcggagatgagtgagctcagcgcccggctggaggagaaacgcagagccatcgaggctcagaagcgacggattgaggccatattcgccaagcaccgccagcggctgggcaaaagcgccttcctgcaggtgcagccgcgggaagcctctggggaggcggaagcagaggcggaggaggccgattccggtccagtccctggtggggagcggcccgcaggcga

SEQ ID NO: 90685 - DNA, 1026 bp, Homo sapiens
aggtgtgagtggctgggtaaggcctccatgggtgggagaggggggaaagggacatttgcacggtggggggcaggtatgtggggtgacaggggcctcagatgggatttgaccctgtctgttgggtaaggacttccacaaggggctgtgggggtgcagtggggtgagaggtcctccccctgtggcttaatgagtgaggccctcgggtatgtttgggggtgaggggtttccagtgggggctgacccagtcatgtccctcccaaacaaggtatgggtggccggacaagggggatagatagatgtggggaggggtggagaaacagggaggagtcatggatagacagatggatgaatggctggttgcatgggtgggtgggtgatggacagatagacggacaggaccaggatcttcagcgcacctccttgctcatcctctccttcaccccctcgcccccagcacgctcctaccacccctttcctggccctgccctgtgtccactgtctctccattcccatggctttcccagccggggacacctagggttacctgactggcctctgctgcctgcctccatcccgggccattttgcactgagtggtcggggattttgactgctccccttacccttgcttttagaatgaaagtcctccccagggtggccgggcgcagtggctcatgcctgtaatcccagcactttgggaggccaaggcaggcggatcatgaggtcaggagatcgagaccatcctggctaacatggtgaaactccgtctctactaaaaatacaaaaaattagctggcgtggtggcgggcgcatgtagtcccagctactcaggaggctgaggcaggagaatggcgtgaacccaggaggtggagcttgcagtgggcctagatcgtgccactgcactccagcctgggcaacagagcgagactccatctcaaaaaaaaaaaaaaaaaaaaaaaagtgagcacagcccaaagccctggggaggacttccttttcattttttttttttgttttgttttctttt

SEQ ID NO: 90686 - DNA, 1065 bp, Homo sapiens
ctggcccgcttttgggccatctcgtcctcaggcttgtcttcatcctggggacagacgccgagtccagccagccaccccctcccccaacatggctggaggcccatcttccctccacccagcctgcccgccacccacctgtgcttttgttttcatcattgttctaaatgcacttagttggtgcctactgtatgcacagccccacactaagtactgggacacaacagggatgggatacactgggtgccgctcacacacacactgcttaacccaacggggaagacaaaagcagcagacagcagtgagtgccagcaaaagctcgtgttgggcacagacactctacactgcgggaggaccccggcctggcctggagacacccaggaaggcttcccagaggaagtaccctgtagaatgatcaggatttaactaggtgggcgtacagagcagagcgttccaggcagaggggacagctagtgccgaggccctgaggctggagcaaacctactggggggcacggaagtacaagggggccagtgtggctgggacacagagctgaggacagtggcgcaggactaagtcagaagtgagtacaggccagacgcggtggctcacacctgtaatcccagcagtttgggaggccaaggcaggtggatcacttgaggtcaggggttcgagaccagcctggagaaaccctgtctctactaaaaatgcaaaaatcagctgggcgtggtggcatgctcttgtagtcccagctactcaggagggtgagacaagagaatcacttaaacccaggaggtggaggttgcagtgaaccgagatcatgccactgcactccagcctgggccacagagcgagactctgtctcaaaaaacaaaaaacaaaagaaaacaaaacaaaaaaaaaaaatgaaaaggaagtcctccccagggctttgggctgtgctcacttttttttttttttttttttttttgagatggagtctcgctctgttgcccaggctggagtgcagtggcacgatctaggcccactgcaagctccacctcctgggttcacgccattctcctgcct

SEQ ID NO: 90687 - DNA, 1049 bp, Homo sapiens
agctgggaagccagtgccagcctgggttgcagggcaggccttgcatctgagagagacacccaggcaatggcagggggcaactggattgtcaaacacagatctcagagaaacctggaatcactggcccagaggtagatgccaggcctggaaacaccaggctggccaggggagacaagatcaagttagaagttggccccatgccaaacgctggttagggccagtaacaacagccacacagaccaggagaatccagcaagcgggggtggccaaggccacaggaagggccagtgggacacctcgagcctgagagatcagttcagaggcagcttcgaaacagccctggctgggggctgggagtgccctggctgaagctgcattaggggattatgggggttgaagacaggagttggtttgagaaagaacaggagactaaaaacacagccagggagtgtgggaccccggccagcctcggagggggggacaaggttcaacttctctttaaattattttattcaagaagtgggggaggacagacaaggggactgagctgagccctgagtccctgaacctcccagctcagcccccacagcaggactggactcaaagtcagagggtggagactccagccccacccagacacggttggggacagacaggacccaggaataccgactgactgtcctccaggggatggcggccgcagcacacagggcccggcccgtggaccgcccgggtggggctatttgggggtgccgccgcccttcttgggagtggtgggtttcttgccctgccagaggtgtccctggatggtgaaggcatcgacgctcatggacatggtcttggcggggatctgggtgaagcgcttgcggtccgagttgtacttgtagatgccttccaccatggcgggcgtgacggtccggggcccataccctgccagccgcgacagctcctctgtctcccccgacagcgtgtagagcgcccggaactggcagctcgagtcgcgaaagaggatcaggaagtggttggccttgcttttctcaatttcctgg

SEQ ID NO: 90688 - DNA, 1038 bp, Homo sapiens
gccgtcccagctggctgagttcctgatccagggcatctcagcccggcctgacctgggctttccgggtctgggagcctcggatcctgatggcaatctccttgagggctgggccatcacctgggggactgggatagtgcaacgtccgatgtgtgggaggggcccccgtggcgctgaccccctgctcccaccccctagtgtctgacctggcccctgggcagagtggcatggacgacatgaagctgctggaacagcgggcagagcagctggcggctgaggcggagcgtgaccagcccttgcgcgcccagagcaagatcctgttcgtgaggtgagggcggatccttggacgggacaggactgggacaggtcccaagggggcccggggtggggaactgaggcagcatggcccgtccctaggagtgacgcctcccgggaggagctggcagagctggcacagcaggtcaaccccgaggagatccagctgggcgaggacgaggacgaggacgagatggacctggagcccaacggtgagggcccggctggggcggggacggtggcattaccagggtgggcctcgggggacaggccaacgccaggagggtgactggctcccgccttccccacagaggttcggctggagcagcagagcgtgccagccgcagtgtttgggagcctgaaggaagactgacccgtccctcccccatcccccctccccaccccctccccaatacagctacgtttgtacatcatggtctgagcctccttcctgctgcccaggtgcccgagggagtacagctcaggagtgcctggccctgggccgggattggctgctgtgggaggtggggcggctgggccccaggccagatactgcccggcctcaccccgcagagccagttctggactcgagaggccagtccctccgctgcctggggccttggagtgggtcctgcccggaaacttccttgagcctctgtagcctgggaagggcaatccagcccctggctgcccaggtctcgccagcccctgcctctcagagccctt

SEQ ID NO: 90689 - DNA, 1050 bp, Homo sapiens
tcacgcgcgtgctcgtccgacagcacctggacaccggggttggggaggccgggagtgaggccggggtagctcgggggctcccaacacaccatggccatccctgtgcttccagaaggctcctcctcagcccctcccacctgcctggaccccttccgtctgctcagggacctctggccccggcccagccccccacggtgggtacctcaatggccttctggtagatgccgcgggtgtgggtgaccccatagatctcggccgcccgcttgatgtagatgttgaacatgtcatactgctgggcgggctccacggccctggtggcacgctcgtacacggccatggcatgccgggccaggccccactcctcctccagctgtgcgtacagcaggtacaaggctgggcggggtaggcggggagaggggagcacggtcagccggggccagtcagaaacccagcccgcccgccaccccccccatgccctctgcccgcctcactcttggcatattttggggggcagccgtccagagcctgttcaaacaggtcccgtgcccgctccagcttgcggcccccatagcgggcaatgaatttggtcaggtaggtgctccagatgtcggacacgttgggccacttgaacagcgagatgccgcgctcgtacgcctgttaccagagggagagtcacatgtgagagtctgcagatagagaccaccaggcacccgggatgtccttgggtggcgtctgtagggagcctgccaggaactcccttggggcccttccctgtccacgcctccctgtccctaatggcagttgtgggggtctgtcctctgcactgtctccctctgtgagaaccccaagaacaggggtgcaatgggacctgctaagcacagtctggccccataggaggtgacatgatgggtgaaggtgggtggctccccagctccgctgacgctggctgcctgtccccagggagaaggccgcaccccctgacagaggggcaggcagtagcacgcgtatgcatgtacgacctccccatttgtgtatctgtataatgcccac

SEQ ID NO: 90690 - DNA, 1058 bp, Homo sapiens
ctctctccttagcttacagacagccgccttctccctatgtctttgtgtggccttctctttgtgtgtgtcacttttgaaatttcctcttcttataaaggacatcagtcataatggattaggtggcccctaacgacctcagtttaacttagtgatctcatcttcaaacgaatctactttctgaggtactgggggttaagatttgagcatatgaatgttttgaggggggcacagttcattccatagcaggcacagaatcctacttccacgtgcacccatgactcatggggagggtgttggtgccagtgtgtgcgggctctccctgccccgctgctcaggagacgggttgtggggtccagggggtgggttgcgtgtccgtgggaaggccatgtcccgcggccggagcagtcatgtttgagtgtgtgtttctatggatcgtgtgggcattatacagatacacaaatggggaggtcgtacatgcatacgcgtgctactgcctgcccctctgtcagggggtgcggccttctccctggggacaggcagccagcgtcagcggagctggggagccacccaccttcacccatcatgtcacctcctatggggccagactgtgcttagcaggtcccattgcacccctgttcttggggttctcacagagggagacagtgcagaggacagacccccacaactgccattagggacagggaggcgtggacagggaagggccccaagggagttcctggcaggctccctacagacgccacccaaggacatcccgggtgcctggtggtctctatctgcagactctcacatgtgactctccctctggtaacaggcgtacgagcgcggcatctcgctgttcaagtggcccaacgtgtccgacatctggagcacctacctgaccaaattcattgcccgctatgggggccgcaagctggagcgggcacgggacctgtttgaacaggctctggacggctgccccccaaaatatgccaagagtgaggcgggcagagggcatggggggggtggcgggcgggctgggtttctgactggccccggct

SEQ ID NO: 90691 - DNA, 1742 bp, Homo sapiens
cctcgaaagccaaacgggctggccatgctcctggctgggggagccgccagtggggtgtgggcggtatgcgcttcgcagcgccccttccaggggcacgtgtaggccaaggctgtcggaggcagcagggcaagacccgtcagggctgggtagagagaggggacctgagctggggtgggcgagccaggtggaggacaggcgggctggggaagagggtcaggcaagcgagagggacgctttggagcaaattctgaggcctcggaggatgagctgaggcgagggtccctgcagggtggacccataggcgctggggggtttttggccacctattgggtgccaagtgcttcacacatgtgtctcagtcgagccctgaggtcactgtgtgcaaagggcagtcacccagtttactgaggaggtcctgaagctcccaagaccaccctggcagtgcagggcagggcgggggtgagaaggctccacggaggctctgtcctggggtcactacccagaggtgctggatgcgtcactacccagaaggcccccaggggttccacattgaggctggtgctaagagtgctgctgcctgtcccctgcgccactttcctctcacctccccttccctgggtccccacaggctcgggacgtgtacgaggaggccatccggacagtgatgaccgtgcgggacttcacacaggtgtttgacagctacgcccagttcgaggagagcatgatcgctgcaaagatggagaccgcctcggagctggggcgcgaggaggagggtgagcctctgggggccccggctggtggggagagagctgagtggacattagcggtaggggcgggacacatctcaggtgaggcagccctgggaggctcagctgggggccagcagggaaggaggctgagtggatgcagggggtgtgggggtcttgaaggagccaggaatggggacacttctcaggcctgggccagagcctggcagggcaggagggctaggggaacagtgggggtaggagggggtatccacagtacctggggctgggggtggggctcaggtggacacccgagctgagtgtctagggcccagagcacttggctgggggctggagcggagtgagggtggggagtggaggcggtggcatccggggacctgcatcctgggtctccgcccctgacaaacatgttcgcggctcccagatgatgtggacctggagctgcgcctggcccgcttcgagcagctcatcagccggcggcccctgctcctcaacagcgtcttgctgcgccaaaacccacaccacgtgcacgagtggcacaagcgtgtcgccctgcaccagggccgcccccgggaggtacatgaagcctgccccagtcctacccctgagggccagtttcctgcagaactggggagccacccaccttcacccataatgtcaccttctaggggcctgactttgcttagtaggtccaattccacccctgttcttggggttctcctcctgcccgagccccgcccctcagagccacagtccctcctggccccaccccttggagggccacagctccctcgtggccccgccccttggagggtcacagctctctcctggccccgccccttagggccacagctctctcttggtcctgaccattgtcaagggccatagttcgtttctggcctctcccgacaggggccacagcaccctccaggccccacccctcagagccacagctctgccccgaccgtcatctgc

SEQ ID NO: 90692 - DNA, 1060 bp, Homo sapiens
gggttgagcctaacccagtggggccaaggctagaccagtaggaaccgggctggaccagtggggctgaggctggtttgacagggcttgcttttgcccaagacactcataaatgggtggggggggacgccccgaagccactgaatcgggaggtgggcgtagccctgccaccccactgactgcctgaggggtggctcggtccccagctgagtcctgagagtgcagaggagtacattgagtacctcaagtcaagtgaccggctggatgaggccgcccagcgcctggccaccgtggtgaacgacgagcgtttcgtgtctaaggccggcaagtccaactaccaggtgggcctgccgggagccggcaactgggtgggagggccaccccctccatgactgagcctgagactctcccccactgccccatgccctgcagctgtggcacgagctgtgcgacctcatctcccagaatccggacaaggtacagtccctcaatgtggacgccatcatccgcgggggcctcacccgcttcaccgaccagctgggcaagctctggtgttctctcgccgactactacatccgcagcggccatttcgagaaggtgcatgctggcacacggggctctgggttcggggcggggtctccctccgacactcggggacacatgttgacacatgcacaggcagaaaacatgccatttatggctgggtgtggtggctcacacctgtcatcccagcactttgggaggccgaggcggtaggatcacttgaggtcagcagttcaagaccagcctggccaacatggtgaaaccccatcactactaaaaatacaaaaattagtcagacatggtggtgcgcgcctgtaatcccagctactcgggaggctgaggcaggagaatcgcttgaacttgggaggtggaggttgccgtgagctgcgatcgcgccacggaagtccagcctgggtggcagagcgagactccatctcaaaaaaaaaaaaaaaaaaaaaaagtgccatttttgacagacatgcatatccctgcacacgattactatcctgctgagggtggg

SEQ ID NO: 90693 - DNA, 1050 bp, Homo sapiens
gggcagggcaaatggttctgggggtgtccataaagctgaccgatcagcatctgtcccctcctattccccagctacaaactctggtaccgatacctgaaggcgcgtcgggcacaggtgaagcatcgctgtgtgaccgaccctgcctatgaagatgtcaacaactgtcatgagagggcctttgtgttcatgcacaaggtttggggctcggcgaggggatgaatcgggaagtggagctcagtccatggtggtgggtggggcggggacaggggctgggctcagcatgttagggatgggggcttggattcctgttgcttctttgcatgggaagttgggctggactcagtcctggagctgggggtttctgggtcccgccgcatttatgtggtggccccaggtgtggctcagccacaggacatcgagtgtctgtggccaggccatggagtccgtggcttagccccagccgcctctccccacacccccagatgcctcgtctgtggctagattactgccagttcctcatggaccaggggcgcgtcacacacacccgccgcaccttcgaccgtgccctccgggcactgcccatcacgcagcactctcgaatttggcccctgtatctgcgcttcctgcgctcacacccactgcctgagacagctgtgcgaggctatcggcgcttcctcaaggtgagcctagcaggtgcgctggttccccaggttagtttccagaaacggcctcactgtgacactagctccgcgtaggatgtcacccagcagacgggatgtgggaagaggctcctggagatgcatgtgttttgttgttgtccgtgattcatgtctttattttccaaatagtttgttcacactggtttcacattaggcatagcgatgggtgctgaggacagtgtgactaagacactccctgcctgcacggagcttttagtctaagtaggaagacagatgcatatgagctgatggcatgaactagagtaaaaccacagccatgaagagggccaggaataggggtggggagaagcaggcagggtggagagtggaa

SEQ ID NO: 90694 - DNA, 1473 bp, Homo sapiens
gtggccacctgagaaggtaagtgatctcttcttcctgccagagggatggaggaggctggattcttgtatccgggatgggttttagatgaaaattttaggccaggcgcagtggctcatgcttgtaatcccagggcatgggaggctgaggtgggtagatcacttgaggtcaggagttcaaaaccagcctggccaacatggcgaaaccccatgtctacagaaatacaaaacttagccaggcatggtggcaggcgcctataattccagctgcttgggaggctgagggagaagaatcacttgaacccaggaggtggaggttgcagtgagcccaagatcacgccactgcactccagcctgggcaatagagtgagactttgtctcaaaaagaaacattttactctcagccatgagtaaggaaccgagagcagaggagtagatggtttccttattgccttctcctggaagagtgaagcggatcccacgcggacccctttgtaattggcagggggcttccagtgaagacactgaaccctgaagccgtggtctggggcagggtggtgggagaggtgggcgggggggggtggtcccggctctgaggtgtgtgcccctccccccttcctgtcccacccgcttctccacccctagcttcaagagatagaggaattcaaagagaggttacggaagcggcgggaggagaagctccttcgcgacgcccagcagaactcctgaggcctccaagtgggagtcctagcccctcccctgatgaaatatacatatactcagttccttgttattcatttaagtgttttattcttttatcagtttttgggggccgagtgagacccaggatgcctcaggccctcagggggcttgtgtcgggggctgggggctgctgttccgacggaagccgagagcggtcgggtcctgaggggtgagcaggggttggggactgagggtcccagctcgtttctgtgctccgtcctgtggatgaagaggggtcagccagggggagggctcaagggcagtgccggccacaggtggcgaacaatggagagagggtgcaggtagccaccgtgtcccacctcattgtgagcactggtctatgtttaccctcaatatctgccatttagggtggcatttgagtgtgaggtggcaggtcttggggccctcgctgggatcttgatcagaacccaagcttcgtgtatgtgtgaagtcaacagatgtgagtatacagatgtatatatcctatgtgtgagcttacgtgacttcctccctgggatactttcctaggaaggggtcctattttctccctttggcctccccagaaccttcagacttgggggcaggagccacaagttccagccatgggtcttacactagcatggcccctgtataaccttgggcccctctagccactgcctgggccttggtcctcccatctgaagtcagggcagcggatggacagagatggggcag

SEQ ID NO: 90695 - DNA, 1720 bp, Homo sapiens
cctgtaatcccagcgctgtgggaggccagggcaggaggatcacttggggccaggagtttgagaccagcctgggtacagagcaagaccccgtctcttaaaaaaagaaaaagaaagaaattagcttggcgtggtggcgtgcacctgtagtcctagctactcatggggctggggtgggagagtcgcttgagcccgggaggtcgaggctgcagtgagctatgattgcactgctgccctccagcctgggcgacagagcgagatcctgtctcaaaaacatacataaagtaaaattttaaaaaggggaggtacccacagagtccaaggagctcttgccttgagttctatcccactaggcccttgcagggggcagcgtagagcgcaccgcggggttgtccagccagcttaagggacacgggctggggtatttatccactgactcctgcaggcatgggtttagggttgacctgggcctgcctccaattcggcaaagcaggcttcagggaccagggacggctcccaggaggtgcaggtggcggcagcgggaagcggggcaggtgtgcacctgcagcggcaaccctggtgcttctgtcccctcctcgcccaggtgttctccctcgatgctccccacagcacctacaacctctactgccccttccgggcagaggagcgcacgcggcagctcgaggtgctggcccagcagattgccacgctgtgcgccaccctgcaggagtacccggccatccgctaccgcaagtggggaccccacccagccccaccccgatgccgacccccccttaaccgcgtgcaacacctaacctttaacctctcttgtgaccccagccccggccctaccctggcccctgactctcaccttcaaacccatccttgaccccatcccctgatgatgtcccccgtgtctgacctccccgccaggggcccagaggacacagcccagttggcccacgccgtcctggccaagctgaacgccttcaaggcagacactcccagtctgggcgaggtgagggggcgtgcttgggaggtgaggggcagccccaaccggctcagggtcagtgcctcattcctgccctaaaccccaccccagggcccagagaaaacccgctcccagctgctgataatggaccgggcagctgaccccgtgtccccactactgcatgagctcacgttccaggccatggcgtatgatctgctggacatagagcaggacacatacaggtctgcagacttggaacccgtccccacccttgccactgacctggttccccagtcctcagctcccctgacccccaggctccctccttcctccccaggtatgagaccaccgggctgagcgaggcgcgggagaaggccgtcttgctggacgaggacgatgacttgtgggtggagcttcgccacatgcatatcgcagatgtgtccaagtgcgtgcacacggggaccggatcccccccccaccgcccactgtgggcctggtagcggccttgggatccctggctgctgccaagtctttggccctcatgagcacccctcgtgtgactccagactggcctccaatttcaccccacctctccctgtcccccctgagtgggctcacccatggcctgtggctcctctcccctcactctcacccccgcccaccctcatggccaggaaggtcacggagctcctgaggaccttctgtgagagcaagaggctgaccacggacaag

SEQ ID NO: 90696 - DNA, 1058 bp, Homo sapiens
ctccaaggccccacccctcactcaggtcccacctctccaaggctccgcccctctcccaggtcccacctctcttaaggctccacccctctcccaggtcccacccctccaaggttccacccctcatccaggtcccacctctccaaggttccacccctcacccaggtcccacctctccaaggctccgcccctcacccaggtcccacctctccaaggctccgcccctctcccagggcccacctctccaaggctccattcctctcccaggtcccacctctccaaggctctgcccctcacccaggtcccacctctccaaggctccattcctctcccaggtcgcacctctccaaggccctgcctacctctccaaggtcccacccacctatgaataggccacattcctgtcctgggaccacctgtccaaggctctgcccctcacccaagtctgacctctccaagccccatccacctatgcacaggccacaccctcatcctaggaccgtttctccacaagacccactccttccccaccaggtcccacctctctccaaggcccctccacctctccacaagccctgcccctcccccagaaccccccatctctacagttcagcccctccccaataccccgccttggcaggaccatcacccctgccccccgcaagccctgccccacctgctccacactacacagcttctccaccgagcccttgaagtgcttcatacaatcatctgctagatgcaggtgcgtagaatactgcagggtgcagggtgggggttgggggataacaaaggctgagtcaaggcagaacgcagacagagcatggggttgaggggccgaggtgtccccgctccctgcccacccgagcacaccttattcagctccttctggtactgcggcatctttttcaggatctgggataggtctttgatgttcgcctggggaagtagggggaagagggtagggattggggggcgaagccaggcagtgcccacctgggtctcagtccaggctcgaaatccaggctgtggccctgcgcccatggggaggggggcttcct

SEQ ID NO: 90697 - DNA, 1862 bp, Homo sapiens
ctctctctctcacccttctctctgccttcccctttctctctgttctctgtcttgctcccctcccctctccgtcccccttctgtccccatcttcctctctctgtttcctgcttcatctcttgtctctctctttgccttcatactttgtctcactgcttcttatctctttgcctatctctgcctctgtctttgtctttctctggctcgctctctctccctttggctttctctctccgtctctctctggctcactgtttctctctctcgctttcttgctgtctctcgctctctctcgctctctgttccacttccccatctttgcctgccatcccccaccctaccagccacaccaggcgcagcccctctgtgaccagcctccttcccctcaatccccctgctgccctccctgccctgcctgtagggctcggggacctccagccggctggagccgagagaacgcatggagcccacctatcagctgtcccgctggaccccggtcatcaaggatgtaatggaggtactgggtggcaggtcagggtgggggccagccctccgcatcggctggcggctcagcctccctcctgctgaggtgctaagcctcagggcttaggggaaaatgctcattgctggcattcccttggcaccgatctgctctgctgaggggggcacgccaagcccgcagctgaggaattggggtgacagcggggcctgtgctggggagcctcacttcctccccacctgccggctgcctccgctatatctctctagtctgttcccctgtcccgcaggagtgcccctgagccccagccctggccttcccaggatcccagggcagcaccatccaatggcaatgggcctggggcggcttcctggcttcctccttgtccctctaagagccccggcccctctttctgcgtgggggccagagacctgggcctcctcatccccatggaccttgaatacctggacttctggggctctgaggggctgagagcccagacactgggttccccaaagggctgggggtattgactgatggtccccaagggcctggaggcccagactactgggttgccgaggaactgtgggtttagacttctgggtacccaaggagttatggaattagattcgtgggtccccagtgagttatggatctagatttctaggtccccaatggactagaggcctagactcctgggtcccccagaggcaggaggtggagatgctggttcctgtctgccaggatcttggcccctgaataccccgtggggggcactcctgaccccggaccccatgcctggggttcctcccctaacctgcctctcggccgccaggacgccgtggaggaccggctggacaggaacctgtggcccttcgtatccgaccccgcccccacggccagctcccaggccgctgtcaggtgaggccccggggccgcccccgcccacgcctgggtctgtgttaggtgggcggcctggcggcggtgagggcctcctgcctggactttctgcccctgccctgcacagtgcccgcttcggtcactggcacaagaacaaggctggcatagaagcccgggcgggcccccggctcatcgtgtatgtcatgggcggtgtggccatgtcagagatgagggccgcctacgaggtgaccagggccaccgagggcaagtgggaggtgctcattggtaagtcaccaggactgggaccctggggtctggggcttgggttcccggggcctgggcttgtaccttctaggtgtctggactccagagtccttggagtcagggacctggtttgctgagggacagggacagccccacaccagccgggaccgggagcctgtcaaagacgaaggcagcgcccc

SEQ ID NO: 90698 - DNA, 1062 bp, Homo sapiens
tatcaagggagtccctgggagttgtgctgagccaggcctgtgccccaggccccaccaacccctattatcctctcagaaggagaattagcctctccctgcccctgagggcatctcaagccctcatggaggttaagaacttggacttttggcagggcacggtggctcacgcctgtaatcccagcactttgggaggccaaggcgggaggatcacttgaggtcaggacttcaagaccagcctggccaacatggtgaaaacccatctctactagaaatacaaaacaactagctgggtgtggtggtgtgcacctgtagtcccagctacttgggaggctgaggcaggagaatcacttgaacccaggatgtggaggctgcagtgagccgagattgcccctttgcactccaacctgggcaacaaagcgagactccgtctcaaaaaaaaaaaaattggactctcatttgaatatcagctctaagatattctagcggtgaggccctgaccaacttccggggttcccaatctaaaaacagggagcccaaaatagcagctgctttgcagaggagagaacagagatagcgcaggaaggctggtggcgtgcaagcatgacagctgctgctaccccattttcactggaaccattttggctgctccgttaatattgttattaagcagaatggaccctggaactccaacccccctagaactgttccaaggggacctgtaggcatacgatgccaggagttgtgttcagcttctgctgtattcatgtgaggcacacagcaaacgctccctgctttctcctcccagccccacggggttcacagagactcctgactgcaggacttatcagggccttcggtgggtgtatctgtttgctagggctgtcataacaaagtaccacagactaggtgacttaacagaaattgccaggcaccgtggctcatgcctgtagtcgcacattgggaggccaaggcaggttgatcacttgaggccaggagttcaagactagcctgggcaacatagtgagatcctgtgtctacaaaaaaatagaattagctgaatgt

SEQ ID NO: 90699 - DNA, 1034 bp, Homo sapiens
gcccccactggcgtccttctcccctgcaccctagagacccttatctctgagccctcatccgctttccgatgcagtttatctagggagctcctccctccacggtatttccatctcctcccctggatcccagaggccccctcctcacctgtagtccacgtggctcccatccacccagataaactcccccttcaggtccaagttccgaaggccaatccaggagccggtgtggctggcatgcttggtcaggaagtcctgggggacaggacagggctggaggactggagacatgtgcccggggccttccagcccacttcgagaggttgggtagagtggggtgggggtccccccaccctcgccatgctgcccaccacctctgcagagccccagcccacctgctcctccgggctgtggatgctgaccagctgcccttccatgtcgtcacaggcataccgggcgtggacccactgcttggtgcccttgccgaagtagtagcacttccgttggaaattgatccacttttcagggcacgtgttgcacacaaagcctggggtggaggagaggctcgggggtggggccaatggaagtgccttgggcaccctgggcagactaggtggcagcacccctcctagggccactcctggggtcccggctaaaagcagacccaccccagggcctaacagacagcctcacgggctgtgttctctgctggagctatgatgctgaccagatccatagtagaagcacctcagccaccatggccacaaacaccttcatggttagcagagcacggtgtcgaccatcaacacctcaactaccatcagcatctccacaaacacctcatggccagaagcaccacaagcaccaacactgccaccacacattcatgtccaatatggtcaacaccatgaccacaaacacactcatgtccaacaacacttcaaccaccatcaccacagacacctcacggctagaggtccctcaaccaccagcaccatgaccacaaatgcattcacgtccaacaacgcttcaaccac

SEQ ID NO: 90700 - DNA, 1006 bp, Homo sapiens
tgtccacactgcggcccccacccccgccccctcaccacccaccacctcccttctctggttgtgacctcctgctggtcatcccttgaggctcagcccaaggtcgtttcttccaagggcgctttgatctccacttcccatggccaacccccaacacaccagatacgtactcacttagtggagtttggagcctgtgtctgtcctcctagtgtgttggggtcgaccagagcgattggcagggaccgtcagagacagaggtttaagcaggaagagagacactttcttctgaaagtagagccactgacagcttctattttcatagacctaaatatgggcttgccacccggataacattacacgcatggcctctcctggtgctccccacacccgggtgaagtccgtgttattattatctccatttctcaggtaagagaattgggtgagaactagagatgttaagcagcaagttcccacagggctgaaggaggtgagtggtagcgtcaagatgtgaaccactgttactgcacactgaatcataccactatggccgatcacagagggccctggggagccacggaaggctctaggcagaggcagggcctcttgggttagaaggacggcctggagttgggatcctgccacccggcacttaccagcagacaccccaccatgagattatgtctcttgatgattgagcaaataggctcccaggtcaaatgtcccaggtttgagtcccagcaagaaaaaagggaagaggagagagaggcagaggaaggggaaaaaaaagacagaaggaaggagagggagaaggaggagtaggagggaaggagggaagcggggggaaagaaagatacgtgagataatattcaggtcaaatatggacagttttggctgggcacggtggctcacgcctgtaatcccagcactttgggaggctgaggtgggaggatcacttaagcctgggagttcaagaccagcctggacaacatagcaagccgttgtctctaca

SEQ ID NO: 90701 - DNA, 1036 bp, Homo sapiens
tcatagggaagtgtgcctccaggacatgctgctagatctgtcccagccctagacccaaacacgggtcagtgcggacctcatccagaaagctggatttgggtcctggagcacaaatcctccatcaatgagccctgggacaccaggacagggccaaggctggcactcagcctgttcccagggagagggactgcctggcctggtgtggcctggcctgggggccagagggcagacagggtgtttctgctggggcaggtcctccacctgatcatgtccctgaggggatggatctcagacctcggggagtcagtgtgtgcagcgcggcgtttatgggggttgccctaggacaccctgtgagagtaggtgctgttactacacccattttatagctgaggaactccaaccgggttccacaggcgagtccgctccccgtgggccttgtcaagggggtcgccctcccccatctgagccgcccaaggcagagctcaggaggaaacgtggctgggggcgtttgtcctgcaggaagggccatgcggctgcgctgctcccccaggccctgaccccactcttcccgcagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggtgagggccgggtgggcgccggcgggcagagcgccccctagggccatcccctcggggttcttgggcggaggctgaccgccggcttctcggcttcaccccccaggcccatctggcccgcggcggccgctggaaggagtccccacggaagctggtcgtgggcgagctgcaggacgagctgatgagcgtgcgtctgcgcgaggcccaggccctggccgagggccgcgagctgcggcagcgcgtggtggaacttgagacgcaggtggactcggggggcctgctcgttggggaaggggcgtggtgtccgtggccagcccctgagtt

SEQ ID NO: 90702 - DNA, 1073 bp, Homo sapiens
cacccccccccgcggtcccgcctcctgatccgcccccgcccgcggccacgcctcctgacccgcccccgcccgcacctcccttgcccgcggtcccgcccctgcccgcggtcctgcctcctgacccgcctccgcccgcggccccgcctcctcattcgcccctgcccgcggtcccgccccctgatgcgccgcgccccctgacccgccctcctttccccccaatcccccgaccccagagcaaggaggaggtgatggctgtgcgactgcgggaggcggacagcatggctgcggtggccgagatgcggcagcgcattgccgagctggagatccaggtgatcggcggggccggggtcggggggcgggggcgggggcagggcccggggcaggagcggggccggaccccaggcccagcatggcactggccccgcgtgacctggcgcaccccgcagagggaggaaggccgcatccagggccagctgaaccactcggactcatcgcagtacatccgcgagctcaaggaccagatcgaggagctgaaggccgaggtgagccggcgcggggatgccggggacaggcctgggtgtcgtcggcctgggacgagccgagcgcaggtgccttgcggaggatgcggctgggagggcggggcagaaggccggtccacgcctgcagcgccggtcccccgccccaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtatcctctgtccccgcgcgatgcgcgcttcttccgccgtctggagcggccggccaaggacagcgagggcagctcagacagcgacgccgatgagctggccgcgccctacagccagggtctggacaactgaggccatgcccagcgcgcccggagtcaggaggccgcagccgcggggggcgcccgggcagtccgcgttctgctccccacctgccgcacttgacaaactacgcgccctctgt

SEQ ID NO: 90703 - DNA, 1264 bp, Homo sapiens
cgtcctggttcaaggatgtcatggcgaagactgagtcaccgcggactagcggcgtcctgagccagccccacctgcccttcttcaggtagctgcttggcggcggccagccccacagggggccaggggcatggccacaggcccccctccccacttggccacccagctgcctgccaggggagacctgggacctggacggccacctaggactgaggacagagagtggggggtgcccacccaccccccccgccccgggcctaccaagcccccgcccttcccaccccggggtcagccggccgtgtgcgtcccccgacagacactgtgaacggaagacagcaggccgcgatcagagtcgctgttcattcagccgcagcctctgggccggggcggcccccaggggccaggagagagccctggagtcccgcagccaccatgcacgctcccagcgtgctgtgtccttcgccactcccacgcgcccgttcctcttccgtcgccctctgtcccctgctctacctctctgtccttgtctggctctcccgtcaccctccctgcctctgtctctcttctggcctgagcctgggcccagccacctcctgacgggtcccctgggtctgcataggtctcccatggcgcaatgagtcagtggcccccagccaggcagtgtgggcattgccactgcggctggacggggctgcgcgctcgcgctctctctctctctctctctctctctttgatctcagggggtcctttttggagtttattgtattttattgtacttggtggggtgtttggggtgggggcggaggagagcttgttctcgtggggttgtcggtaccttcagaaacttttaccaaagtcacgattagctgcttgtggtggggccccaaccgccctcgggcactggggagctgggctggggctgctgctctggggtctccgggggccacagcttggggtgagttgaagacctcaggggatgtggaggggtctgcggggccctggccgcacaggatggccttcagggaaggtggtcttggggcatggtgcagagcaggtgaccggagggaatcggtgacggagcggggccaagggaggggtccggagggagtcagggatggagggcagagggagtggatgtgggggtttgaggacgtgtgacaagctccagcaggggtgggggccgggctgagggtgggggtgcgaggtggtcactcccatcgtgcccctggccgtccctccactcacccacacctggcccagtccacgt

SEQ ID NO: 90704 - DNA, 1682 bp, Homo sapiens
ctgcggggcaggctctcccgggcccacggggcggacgctgcataccaatttgccctgcaccgcctgtcccggagacggagcccgaaggcctgccatggcggctgtgtcgaggatgcgtggcgcctgccgtggcgggacagcgtgggcaggctcatttctgcccccaacccgggccccaggacaggtcagcgcgccctgccccggtgcccaccgctgccccccatccgccctcctgccacttgcccctgacccccctgccgtgcctcccgcagccctcccatgccgttccactcctccctgcctctgagccgaacatgataataaaagctattattgagcgcttactgcatgccaagtagcgtgctgagttggcacctcctgtttatagcctgtctcctcttcgggatcgtgagaatgagccaggccctgttagcatccctattctacaggccaggagaccgagggccaggcagctccagtgactgacttgcccacagtcacatggctagagtctggtagggctggaagtggaacccaggtctggcttttgcatgtttttaaagcttcccagggctgcaaagacaccaagatcacaagcacctttcaccggctttgggggggggggctgatgtgtaacccccagctgcctcccctccacacacaattctgttgatctggggaggcgccgggggtggtgagagagactcagccctgtggggaactgggaggcgcaccctctgccagccctggagggaggctccgacgaccgaccgtacctgcagcctaagcctcctccccctgcccaccaccattggcagcgtttgtgggtctggtgcggtggggcggtgaccacggacggagtgggctggctgtgctccaaggccctcccaagagatgtgcaccccaggggagccgtgtgcagtgtgtggggggaggaatgagcgtttctataaaaggcaggctgggtgaatgcacaggctccgagaacggagaatttaccgacttggattactagctgggcgtgggacgcggtgccgtgggaggacatctgcttccctctctaggacccgaccctcggtccacacccacagggcaggtgaagctgatggagggggcctcaagcggggtcccagcacccccaggggtttggggtcagccctgactccagtacccctccctccccgccttctagggatccttgaggtcccaaagccaccccaggggacactccactcccactagcctcctgccactcggggcagcccacccctatctatcttcctctaaccgcccagcctggggctcaactccttccaccgggtcacccccactctctgctgccttctcccctccacctgtgcgatgtgattttgccctactctgaaacccatccctgacgcctgtccccaaggtgccctgccggctctccccatccacacttgtcagcttcacagtcaccaaggggctcctcaccccaggcctcatcacaccagtcaggtggcagctctcctccctggcacacacccccagccctgtgacccccaagctctgacacttcagggcccccacttccatctttaagtcacaggtgaaagagaaagagaatgataactttattcatggtcacagaatacccccgggaaggggaaggacctggcagcagggagtaaccacgactggtc

SEQ ID NO: 90705 - DNA, 1048 bp, Homo sapiens
ccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaagagcagctacggagtctgaagtgtcttctctggcgcgggagtggccgaggcgatggtgggggtgggagcaggcggctgctgtgggaggcggtcaaggtcgagtgaggaactgcagccgcagtgggtggacgccttgcccagggctggaccctgagttggaagacgaggccagtgacagacaaaactagggggacttactcatcccagtgacctgcctgagctctctgagaattgaggtccccagggccgggggagcttgagtgcccatatgagtgttttagggccactgaggtccccccacaaacagggagtctcgagtggggtctatcgcggaggagaatgcaggcacagggcaggctggggggcccgaagtgccaggggaggtgggagtggcagctgcccactccccggcgaggtcgtgggtgctcgcgggtcctcggggctggggttccgtcctcccgcaggcccgggcggggtcgctggctcgcgcgccgctccctgcgcagcctccgccccctgcagccccgccccccgcggcggccccgcccccgtcgccataggaacagccgcggcggcccggctcgcgcgctgcttgcctgcctcggtctccgccgctccaggggcgggtggggtggg

SEQ ID NO: 90706 - DNA, 1013 bp, Homo sapiens
cccgggacacagtcacctgccctccaagacaccttcactcacggttaaacaccacgttgttctccttgaagtccttccactgctggtaccacttggagtccttgtgcagcacgacccccagggcctccctggggaagagggtgggccctggggtgagcggcggcgccagggccaccctgtgccctcctgcggctgcaggcagggggcagtacaggacagcaggcagctgagacctcaaacctaggggctctgaggaccccgccctcacctctcaccctcaaattcgagggagccgggaaccttgggcagaaggcaaactcaagaaacggactcaggagggaaccattggtgggctcccgaaatggacagcagtgaaagctgcccaaaatgggggcagcgagggccacgggctggtacctactcgtttggctcaaacactttctcctccttgaacttatctcccgcaaactccgttctcttccggagtcgctggggcctccggtagggcccggtctgtcccaggacgctgtcgtcaatttccttcttcacggactccaccccctgcgagggaggcacagcggggctggggtgggtgtctgggttcggccgccccaggctgcatgccctagcccaggactgggctcacctgggagagggctctgaaggccgctgtcctgcccagcttctccccgcctttggataccgactcggccgactgcttggccgtcttggctgcttcctccacgccctccttgattttccggccgagatcacttttactgacttcgtgaaggctctactgagacagacacagagagggggcgttggcaccggccctggcggccggggggcggggcaggaggaatgaattcctgccggagagaagggcggatctggttccccgaggccggcagaggccttctgtgctcctgtggtacgcggcacccccagagccatgagcacaacggcacccccagagccacgagcacaccgccacccccagagccacgagc

SEQ ID NO: 90707 - DNA, 1025 bp, Homo sapiens
cctcggttgtctgttctgtccagctttgcgcagcatggggcgccctcaccgccgttctttccccggggtcccctccttgggaatccttgctgccaggcagttcccgggtctccagaggactcctgcccattttggaaaggggccagcagacccagcgtctcacccagagcccagggccagcatcccggaagccgtggcggtgtgctcatggctctgggggtgccggtgtgctcatggctctgggggtgccggtgtgctcgtggctctgggggtggcggtgtgctcgtggctctgggggtgccgttgtgctcatggctctgggggtgccgcgtaccacaggagcacagaaggcctctgccggcctcggggaaccagatccgcccttctctccggcaggaattcattcctcctgccccgccccccggccgccagggccggtgccaacgccccctctctgtgtctgtctcagtagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccaggtgagcccagtcctgggctagggcatgcagcctggggcggccgaacccagacacccaccccagccccgctgtgcctccctcgcagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgagtaggtaccagcccgtggccctcgctgcccccattttgggcagctttcactgctgtccatttcgggagcccaccaatggttccctcctgagtccgtttcttgagtttgccttctgcccaaggttcccggctccctcgaatttgagggtgagaggtgagggcggggtcctcagagcccc

SEQ ID NO: 90708 - DNA, 1015 bp, Homo sapiens
tctagctaaaaaattccaaagcctttatttgggagtcttagcttgcaagcttgtggaaggatttagcttaacaactgtcactcctgaaaagcaatctctgttccatcaaggttctagttgctggccctgtgtcctcaaagttcattacatcttatcaaggcctgtttgcaaaggggagatcccttttcttaaaaaaggctcaacccaaaagaaaccatttcttaaaaaattttacatagatcagttgtatttctatttagcaaaaatgagtgctctgcttttatttgggaatttcgatgaaaaagcgttcagagtagataatgttcatttatcaaaaatctggtttgggaaataccaaagaggctttgattgaattcccttttgacccgtgtgtaacttcctctggtagttagaccccaggcagctccgaatttgtgaacctgcttcctgatgaattctcccttgttcccccttggctctgccattatttcgttttcagtgtaatttgccaagccgcagttttctgtgctggctgtgcctctagtcgcagctctgtgactgattccctcccgggtgctgagtcccctccccggccaccatcctgcgtgaatatcctgaaattcatgggcttcctcgggggcccgcccgcaggtggtgctgggtgggttccgccaccttctcctggaaggtgagccttttcctggccaagggcagctgccttaacctctgagagtctgcgcttggccttagtcctggagacccagcctccagggactgaaccgtgctgctgttgggagccaagaccggccctttggagccggcagcccaggggtccctgctggatcagagaaatagaagcacccgaagacggttagtggcaattccttgacccggtttgcttccaaatgaaggccatttgtccaccaggcattgaaaagacatgacttacccagtccggcatcggacttgaaaaatcgaaattgacatcactcagctgttacatttcacatccgat

SEQ ID NO: 90709 - DNA, 2275 bp, Homo sapiens
gcgcccatcatctaaaatgtggggaaccgcaggaacccctaaacagaaaccccgacatacacagtgggaggagtggagggcaccaaccagcccctcagagtcagctccctacagaacagggtcccgcccctccactactgtatttaattcctcccagggttttgacccatgcaggtgtctcaaccgtgagcacctcgtggctgcgcagagcgggatggggcccagcggccatggtcagcatgcgtccaggccttgccccatccccaggccgcctgcgctgaccgtggcctgacgcttgctctctgtctgccaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaattttgttttgttttttattttaccttttctttctttttggctagggaaggtgcaggtggcccagcattcagggaggagtcgtaagatcttaagaaaccaatccttgcctcaagcaaaagcatttctgaatctgtgacgcaagaatgtgcagttacaggctggtggcttttaaaccaggagcccggaggaagggtgaaagagaaagcctgtgaaataggcagggccagatcacccaaaactcctcaggactgggatctggcgtttataaataactagtttacagagagaatcacaaacaggataacttagtaccagcagtttttaaccttgacgtgagactaaaacgtgaccgtaggctgttttttagttattgctctcatgagatgatggctgtatttatctgtttatttatacctatttatgtatt

SEQ ID NO: 90710 - DNA, 4351 bp, Homo sapiens
taggaaccccacctggcatgcactggccctgccgctgccggccttcgttcccgctggggcccgaggaggggaagggcccctttgcacttcatgggggccctgggagcttcctgtagcctagcacagactcgcgccctggcaccgggcagtgccgaaggacagggctcactcgcacggccgccgccattctgcctttgctctggggagagggtcgggggatgccagttactcggtgtaaactcccctggtctgcaccagaagagtctcctgtggtccctgaagtcctctcacttaagtgccagctgagcgaatgatcctgtcagtgggccagtgtgtgggtttattgccccccattctgcactggggcatctgagctggctgtgcagggcccagggccgggggaaccaacctcactggcccacagtccactcccctcctcctctagaccccacatgcactgctctgcctcggcctgtctgtgtccagtatggccctgatgagggaagcctgtgctccacttggagcccccaatgcctgagaacatgcctccagccacccaactctcttggggccttccctagtctctcaggcacacacgggccacaggcagggggaactcacctctgcacacagctgctgggggcattgcttcctttccctctgcaagatagtgtctcccagggtgttgggggcaccttagtattgcgcccccagggtcggctgtgaacctcaaggtggcctaaggaacctttgtcatctttgcagagcagtgagggaggcagagagaagggagccaggagggtctcccggctctgcttcccaccccaggatgcagaattggtgggaaggtgaggctcccatcccagggctgtagctccctctgctggagacagagtgtgtgtggcaggccagcctgtgtggagtttgccttcctgtgacgggctttttagtgttaaatagatgaggatggccgggcgcggtggctcacgcctgtaatcctaatactttgggaggccaaggtgggaggattgcttgagcccaggagttcagaacagcctggccaacatagcgagacccccaactctttttttaaaaaaagagaaaaaaaatcccaccctgagctgacagagcttaattttttgtattccttcgcttctatatccaccttaattgtgaactttatagtgtattcatctggagattatgccgtttcttggactctgctgttaaattctaaaaaacacaagggggccgggggccgtggctcacgcctgtaatcccagcattttgggaggccaaggtgggtggatcacctgaggtcagcagttcgagacctgcctggccaacatggcaaaccccatctgtactaaaaataggccgggcacggtggcttatgcctgtaatcccagcactttgggaggccaaggtgggcggatcacgaggtcgagaggtcgagaccatcctggccaacatggtgaaaccccgtctccactaaaaatacaaaaacttagccaggcatggtggcaggcacctgtaatcccagctactggggaggctgaggcaggagtatcgtttgaacctgggaggcggaggttgcagtgagccgagattgcaccattgcactccagcctgggcaaaaagagcgaaactccatctctaaataaataaataaagtaaaataaaataaaaattagccaggcatggtggcaggcgcctggagtcccacctactcgggaggctgaagcaggagaatcacttgaaccggggaggtggaggttgcagtgagctgagatcgtgccattgtactccagcctgggcgacagagcgagactccatcttaaaaaaaaaattaaaaataaaaaacactaggggaagaaaaaaacaaaaaatgcagagccatcttcagaaagtatacatccattaaataattgagtgaattgatatccccctctgctaaacagcatccctcctgccccccttactagagctttcttcctttcactcaggcagtttgcatttgaaagccactctacaaccccagacgaggaagccacacttgcacacgtgccttctctccgctgggccgcagggtctttagaaacagaatgaagccatctgcttggagccagcttccctacgagccggccagcgtcagctctcagtcgtatttgcctaaagttcgattttcatttaggtttccaagactgactaagctgtcattcgtgtcgtgagagactcaaagaaaacagcatctgtcagggttgtgttttcaggtgttccttctgagcagcagctcagaaatgagcttgagccccagaatattcctggcacgtgtgcgtagcgctaggtctgaccttactaaagctgctgtctctgtgctcacggggggcctgcagtgtcgcgattgtgggggcagctggcgggaccctctgggaagtggtggagtaaggtgccgtgtgaggcgtggagacaggacatggggacagttgggtgcccgctggacaggtcacccaaggccccgggctgcctggctttggtcgttgtttgttaccatgcaccagaggcctttgcctggagaagaaacctgacttaagacaccctttgactggaagtctttctttttccttaagaggtgagatcttactgtgttgtccaggctggtcttgaactcctggcctcaggcgattctcttgcctcagcctctggagtagttgagaccacaggcatgagccttggcctggcttgactaaaagtcttgagaaccagggtgtttgggttgggctgtctgtgacggcctctcccactgggacacacccgtgactcccgcctagtgatgtcactctcagactggcctctcagctgtcacctctcccacccctgggccttcccctgactccatcatgtccttgcccccagagaaggagctagtgcgctgctcagtgtgccctcatccccatccccctcatccagtttccagcccgcttcccaggttcctcaagggacgggctactcatgtttccctcccgggcctagtgtatggacaggcaggggtgcaggacagccatgctctccttccacccgccttgctcagcatctcacacccatgcccagctgaccaatgtcccccatagcaggacggtcctcaggtctcacactgctccgtccagggattgggtttagccgggaacccgggactggcccttgggtggctcagttgaggtggcaagagaagatgccctctgggcttggctgctggggccctggcccttcccatacagggaccccaggcctgcctggcgagcctgtggataggttcagctctgctgtatgagcctgggcagtgttctggcctcatttgattctgatggcaatttggggcccacgggaggggtgtaggaccttagagtggagtatcccaagacaggagtgaggtgacagcagcagcatggagctggcagggggtggccacaggaccctactccctcctggcatgaaggagaaggcatgcaggctgagctgggcacctttgcagcaggctcggccacgaggcctgctgtcacagcgggcccagagacagcagccaggagagtggcccctgagcccagggaggatctctcagacgcagtccccactccaaccctgttacccaccaaccacacaccacacccacgcacccactctgtggcggacacctggcagctaaatagtgacggtggatgtgctgtttcctaatgttgctttcttccaaataagaggcctgggtgtctattggggatgtctgtcaccaaaatatctttgggcgccaacactgtggagtcatggcttcagccgggaagaaagtctgaagctttaatcttctgttagtcattggttttctttactccatccatttgttttcacttttaggtttaatttttgtttatttccttaaccagacttctagcctggcccacagtagactgacctgacttttgcttttcagttttgaaagtcctagcgtttttccccctaactccgtttttgttgatttgttgaaaaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggtgggtcgggagggtgcgcgctcctgaaagccatacttagccccgctggcaggcgacggcacagccacagaatagaaaccacgggg

SEQ ID NO: 90711 - DNA, 1506 bp, Homo sapiens
tggggtctgcacggccgtcagcgccaacctgagaaagcaccgaagaccttgtcttgcattggcctccgggctcccctcaccaccctctccacacgaatgatgaatgtaccattttgtcaaagcacccagaaggttctcttcagttttctttgattttgcaaaatataaatccaaaaggcattgagtcgtttaatattgaacacttgagtggatttgagtacaaactcggggtcctcccagaactcacagcccctgtcagggcttctgtggcgagcttgctctttggcaggggagtctcctgtgttcccagtagctcccagcttgcttgcccgctgcagcacgggctgctttcaggcaccaggacctctctggcaccggctcactgtccagcacatcagagaggtagccacacacaagctgcgggccctcagttgctgggctttgtgacataggagtcacgcctgcctccttgaggatggtgagcacccagtgaggaagcactgccaggcatcctggctcacggcccatccctcagtgagcttgccaccatgcggctgcaggcggtgagcgtcagtgatgataatcgttccctgcatgatttctaacacacagtgttggcttttcctaacccagcattcaacaccctcctcaatgctttggccacgtgcctgtactaatctcggaaagtggttgtgttcccaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtaccagaggggccccagacgcgtggggagggtgttctctaggtgggggctgggttttctagggaaggcagatcaccgtttgattttaaatgtcattagttattccgcaaacgaggacagcaccaaaatgagaagacgttggctttggtttgaggaggctgaggaggtaagatggcattaaaagaagctggggatatctgggcgtggtggctcacgcctgtaatcccagcactttgggaggccaaggtgggtggatcacgaggtcaggagatggagaccagcctgaccaacatggtgaaaccctgtctctactaaaaatacaaaaaattagctgggcatggtggcgggcgcctgtagtcccagctactcgggaggctgagacaggagaatggcatgaacccgggaagcggaggttgcagtgagccgaggtcttgccactgcactccagcgtgggtgacagagcgagactccgtcttaaaaaaaaaaaaaaaaaaagctggggattaggccagcatttcatgtacagtgaaaacgccaagagattctagcaccttccctcaggcacccaaatgtgctggccttgcccatgaatggggtgaaaaggacactgcaggccgggtgtggtggctcacgcctgtaatcccagcac

SEQ ID NO: 90712 - DNA, 1044 bp, Homo sapiens
ggtttcaccatgttagccaggatggtctcgatctcctgacctcgtgatccacccgcctcggcctcccaaagtgctgggattataggcatgagccactgcgcccagccaaaaaaaaatactttttttttttttttaaagacaggacctcactcagtcacccaggctggactgcagtgatgtgatcacggctcactgcagcctcaaactcctgagctcaggtgatcctcctacctcagcctcccgagtagctgggaatagaggtatgccccaccacgaccagctaattttttttgtagagatggggtcttgccatgttgcccaggctgaactcttgggttcaagcgatcctcccactcagcctccaaaacagtgggattactggcctgcgccaccacacctggcctaaatttccctcttttataaggacatcagtcacatttgattagagatcaccctataccagtgtgacctcgtcttaactgattacatccgcaatgactgtatccaaatcaggtcacgttttgaggtcccaaggggttaggacttcggcatatgaatttggattgtggggtggggggaacacgattgaacccctcactggatgaattcttgagaatgggcagccagaaaaagacctgattgaggccaaagagcaagcgatgttgggagcttaggaaagagggttctggccgaggggccggggagccccaggtcagtgcacgcctgctgtgcgccagctgttctgattctagcctgactgaacatgacagtgtccagagagaagaggaaagcagagttcccatggtccttggagacacctgtccttgggaggcatcagagctttccccagcatttggctctagggcacttctcctctggggcttcatccagggacggcagtaggtccagtcagtgccagcctcagctccgctccactggcgccagggtcatggtttggcaggcccccaaatactgccccagtccagacaggtctgcagggagccagggcaagcccggacactaggggaggctgggggccaaggc

SEQ ID NO: 90713 - DNA, 1029 bp, Homo sapiens
aaaagtaaaacctcttggccaggctcagtggctcacatctgtaatcccaacactttgggaggtcgaggtggggccgaggtgggaggattgcttgagcccagaagttttagaccagcctgggtgacatagtgagaccccatctctaaaaataattttaacaattagcttgggcctgctggagcgggcctgtagtcccagatactctggaggctgaggtgggaggctgtcttgagcccaagaatttgaggtggcggtgagctgtgatcacagcgctggactccaccctgggtgacagagcaagatcctatctctttaaaaaaaaaaaaaaaaaggaacctgtgttcattgcagaaaatgtacgtgtttgccaaagaaaataaagtttgctagcacctgtaatcccatttcccaaaggccaggcagatatagtgcttcccgacctccctgtccctcactcgcagacggttggcttaccaatgtcttcatgttctcttgcacaggacacagcttgggctatggctttgtgaactacgtgaccgcgaaggatgcagagagagcgatcaacacgctgaacggcttgaggctccagtcaaaaaccattaaggtaaagggatctgatcaccaccgcatccattcctgccctgggcacaggtctgtgctgagccccgcccagcctcacagtcactctccaagggactatgagcacagccgctcctcgggggctcccatcagataccctggtcaggtgtatctgacccaggccttacatgagtgtctcaggacccactccccgcccagggtgcccccaggttgcgtcagctcccaggcctcccctgtcgtctctcctgcctggctctctgtgttcccatccctggacagctccatccacccccagcctgcccagtgctccctctgcgctccttggggccagttgtaacccttccctcacccagcacctcactcagcacctactgtgtgccccacagtgaccaaaacagacaaattcagtgcccccgtgggtcgggggtg

SEQ ID NO: 90714 - DNA, 1021 bp, Homo sapiens
ggagtttgagaccagcctggccaacacgacgaaaccccgtctctactaaaaatacaaaaattagctgggcatggtggcagacgcctgtaatcccagctactcaggaggctgaggtaggagaatcacttgaacctgggacgcagaggttgcagtaagccgagattgtgccactgcactccagcctgggtgacagagtgagactctgtctcaaaaacaaaacaaaaaaaaaaaaaaagaaagaaagaaaatctctaagtgcaaatgcagttactagttttgccttcatatactgcaatatgaacattttgaatttacttgctctttttctcttggcagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggtaaagaaatggaggcgttttagtaaaccgggtattggtggccatcctttgggcactgtctcctttgcctgtgactctgtggcattcctcagtgcaggataactacagccttgaaacgatggctgtgaagtttcatttttatttcaaactctgtccattgctcttgtataagatcggacataagttcccaaaagaggaaaaattcattgtaagacagagagcatgtacaaaataagacagtgggaggagaggaaggaaccagagacagggcattctgagagctggaaggggctggagaaccacagcctgacctggcttggcctgggcagattgattgggtcccacgtgtggaagggaccctggcgagtgtactgtccagggcaggtgcaggtaggcctgcccctgtctgtccaggcccccactcttggtcaggcccaggtcagcagaacaccgaggaccttgtggacagcccttcgttatgtttgggctgctctgtc

SEQ ID NO: 90715 - DNA, 2028 bp, Homo sapiens
gacaatacataaacaaatgagacaagctgtattccaataaaactttatttataacaacaggcaatgggccagatttgtaccacaggccatgatgtgtgtttcaggaggtccacttttcccagacctagaggataccacactgtggacagtaagcctgggacagccattgtccatctcaccgtccatgaaagcagaatgagggaaaaagcaaagtagatgcctaactcttagagaaagggcgaggagaaggaaaggtaaaggaaaaaagagaaagaaagaagggaaatgcttgaattacattttgagcaagcttcaatgtgcattttaattcttcagtgttaacccttgtggtctgtttggatcagcttccagcaaatgtttttgtctgtttgtttgtttttgagccagtgatctattctaaaatctcgtggccacagatggtgtaacagacacgtggagtttctcatgattaaagtctataggtcccgagctgctactgaaagttgaaatttagccatttcccattaacgaatatttagaattctatccagttttatactcttatgaaccatgaggtagtgccttccttgcactttttgttttgttttgttttgagacagagtcttactctgttgcccaggctggagtgcagtggcgccatcatggctcatgcagccttgatctcctgggctcaagcgatcctccctgcctttgtctcccgagtagctgaaactataggcatgggtcaccatgcccactaaattattttattttttgttgagagtcagggtctcacgttgttgtccagactggtcttgaactcctgcacttgcgtgattatttctgtagaaagatcctgcagttgtgagtcagaaggttctaccatctcatactcagatcagtagcaggtgatcttgcgctggattttattccatgtgactggcagaaaatagcatctggttttcttttgcattttcctcattgttcacgaagatgaagttcagtgtctttttctggacttacgagccatttgaatttaaggcctttataaattgctgctcacatcctttgcctacttccctcttggttacgtctcttcttttatcccttaccaatttgtagatgttccgaatcaagttttcccaacctcggcagtactgacatttggggttagataattcttggttgtggggccgtcctgtgccctgaaggatgctttacagctctctgacttctacccaccaggtgtcagtagcaccccctcccccgacccctggccctgaccaagtcacagtaaccaaaaatgtctccagacattgccctgtgtccccttgggggcagaatggcccagtgtgaaaaccacaggtctaaataatagaatatgcagtgaatcttttctctaggctactcctcttcgtctaggtctgtgatgccttttgctgtacagaggtttttaatttcatggagtctcacttttcagtctttttttctatggcttttgatgctaacctactttttaaagagcagggagcataggacatcctcaaataaaagaaatgttaggaaattgtactgattttccacattgtctgagactagtaggagggtagggaagacctggatgtttctaccaggaagaaagaaaccagacctaattcttccctcggcgttgattcagggagtaggtaggaaatctccacatgagaggtgtgttcagatttttatgtaactgctggcaaggctatttttaaagaaggccaaaggcgcatgaccgtgggcactgggtgttcaaacataacagaattgagcaacagggatctggggaaagggatgggctctcaccgagacctccaggcgggtggccatccacagggatgactacctgtgtgtttagaggcagggatgaggggcctctgagaagtgagcccagtgtgcggcgcactttcagcagggcgggctcggcatacttggccgcattgatctggactcttctccaaagtcatcactggctctgatgtttatcactga

SEQ ID NO: 90716 - DNA, 1005 bp, Homo sapiens
ggtgtttgtagctgcagacagggaggttggggagacatacattcgccttgattttgttcatgaagtgggactagagacaggtactcactgtaccaggcactgtggagcaaggggtgacatccccagtggaggaagctgaagctctgggaaggggagcgacttctgcacagtagttcagctgatgagcaggagacttagtgcccagctcgggcctgccaggctccagagctcagggttttttcctgccatgccctgttgctttgcacttctgtgtgagatccctgcagtggcctttggccttgaccagccagaaagaagccagagcccttagcagggctgtggggtgcctggactgggccacaggccagccacacctgacctgctcctgccccgggcttctcagcctggctgaaagggaattgtcacttagctggagctgctccagccaggcatcctgcccttctgtgggccatgggcaggggcttggaagaagctggtgccatgtccacctgagaccttgccttgcatggcatttataactgggtcaggtggtgctttgggttttttctggcagcagagcatttcctgaatgacctaagccttttttacctggaagactcagaatgttgcatctggaaaggaccttaaacattattgggtccaagccctgtcagatgatgtgtgaagtgtcaagattgagcctgaagatagatttgactgttctagttttgctctggctcaagtggtttagaatacctgctccgtcatggtgcaatgaaagtgattctcatgcttgcctggtggaaagcagcctcactgcttcactctttttctgtcacacataaagacacacacatctctctcccctggatatgcgctagatgatcgacggatgtgaacaacatcactgatgtcacatagacaaccaggattgtttaaaatagtgcattggagtcaaaaaccttcagagatcatccaaacaagacttctcccagaggccaggca

SEQ ID NO: 90717 - DNA, 1039 bp, Homo sapiens
ctgttgcagcctccacctggagacagatctcttccacctggagatcctttgcttatgctccatggctcagcccagagctcactggccgtttgaagcctcgtctgactgccactcttcctccacccgcaccggaatcaactgttccctccttagtgttcccatcccattcagtttattgaatcgaattcaaggctgaatggcgagagaagcgcagcgcccggctggcgcccctaggtggcagtagcgaggcggtgcggccgacccgagctgtgggtcaggggaagaccaacggaagccagcctgtgggagggaagtgaggctcgctccctcctctgaacgactctccctgctccgctgctgtgtcctgggcccccgctaggctctggagagtgtgcatgatgtgtgtaggtcatctcagcccactctgatgagtgctgtgagaattatgccctggctgatgtggaagcccagaaaagggacctgggtgggcacaggagagcccagaatgcttcctggaggagaggaggcagtagcggtggggaggagctaaccaggcaaagacaatagggtggggctttttaggatacagccaagcccggaggtgggaacatcgcagtgttcagagaacatcgtgtgttcaaagaaccacgtgggttctttagggacaagaaggctgagatgggtagtggtggcaggagtgctcaggtgtccactgggcagagggcttggctgttaccctgcaggtaggccaggggtggctactgagcagttttagttcactgctcaccctggtggagaggctggggggagacaaggagaaaccagtcacaggctgttgcagtactgaggtggccccgtaatggctgaaccgcttgagggtcaggactgggactgcttctatattttgtatgcctgatgctttgctctgtgcctggcacgtggttgatattttgtctgtgccagggaaaggaaagattggcagactactcagaagcgactggatccaggtacctgtcaaacagacatctgtggctgggtg

SEQ ID NO: 90718 - DNA, 1012 bp, Homo sapiens
gcggcgctaacggctccgctcggcctcggtagcggtggcggcggtggcggcgacggcgacggcggcagcggctcctcctcagcgcgcacgacccgctccggcccgcggcccggacacgccccccccgcgcgcgagcccattggccgacgtccgccacggcgcgctgctcattggccggcgtagctgtcgcggcgctccggggcgcgcgggagaggcgggacttccggtcggcgccgcctgcgaagtgctccgcggccggcggagacgcgggcagccagcgatggccgcggagggggcgaactgggttccggccctcggaggctgacggaaggcggtggctgaggagcggcgcctctggttgagcgctcgccgtgtgtcccgcacctgtctgtcctgccgccgcccggtaaggtaggaaaggtcagcgcgccggggttacgggtacagaacctgggttcgaatcccggccccgacgtttccgcactacgtgccgttgggcaggagctgacgtcaccttgccgggcctcagtttccttctctggtgcgctgaggaggcggggcatggaacgtggtcagcgcttcatcggtgctggctctttgagcaagccagttcccgaaggctcagcatctcattcattcattaaaatgtcattgagcgcctactgtgtgtcaatcactgtatgggcagtgagcagaaaaaaaatacctggtcttattgggctaacattctaaaccagcgctggcctagaatgccctagtagaaatacatgcaagctacatgtttaatttttttttatgtaaagatgggctctggttctgttgcccaggctggtctcgaactcctggactcaagcgattctcctgcctccgcctcccaaagagctgggattacaggcatgcctgcactctgcctaattttttcttttttttttttatgatctgaaaataatagtctttttatttttatttatttatttatttatttgagacggagactcgctctgtcgccagg

SEQ ID NO: 90719 - DNA, 1020 bp, Homo sapiens
ctccccatcccgggttcaagcgattctcctgcctcagcctcccgagtagctgcgattacagacatttgccaccatgcccgggtaattttttgtgtttttagtagagacagagtttcaccatgttgcccaggctggcctcgaactccttaccttaagtgatccacccgccctggcctcccatagtgctgggattacaggcgtgagccaccgcgcctggcccctgcctgcttttgaaatctagtatgtatcttatactccacagcacagcacagcaccgcacatctccagtcggactggctacatttcaagggctcaaccatcacgcgttaccagtggctactgcatcagactgtgcagtgctagatggggagtcagaagagaaaccaagtgatttccatgtcaagtggtgaacaggctaagaagaaaagtaaattggggaaagagcatggggaatgtgggggttgctgtttgaaagaggatggttgggaaggctgaagagctgtcattcgcagagggacccaaaagaggtgagagcactgaacaaatagttacattcttcattgtctgccgcagtgctgtccagaagagcttcccacgataatgggcatgttccatatcagcaccgtccaattcagtagcccctggctccatggggttttctctctttgtttttttctgtttgtttttttttttaagacagagtctcactcttttgccaaggctggagtgcagtggtgtgatcttagctcacagcaacctctgcctcctgggtttaagcgattcttctgcctcagcctcctgagtagctggaactacaggcatgcaccaccacgcctggctaatgtttatatatatattttttgctttgttttgttttgttttgagatggagtcttgttctgtcgtccaggctggagtgcagtggtgtgatctcggctcactgcgagctccatctccctggttcacgccattctcctgcctcagcctcccgagtagctgggaatacaggcgcccaccacca

SEQ ID NO: 90720 - DNA, 1064 bp, Homo sapiens
tagtctctcctaaaaatacaaaaattagccagacatggtggtaggcgcctgtagtcccagctactcgggaggctgaggcaggagaatcgcttcaacccgggaggtggaggttgcagtaagccaagatcctgccactgcactccagcctgggcaacagagcaagactctgtctcgaaaaaaaaaaaaaaaagaggcagctgtgggtacaacaggagtccaggcctggcagacggggctcctggggtgtggattgctccctacaagactcgtgaccatgcagggcagtgggggcccatcagaagccaagagtctcatcagggacctggaggcaccagagttcaggagagctgcaggcagctggggtctgatatgcaaaagtgactacaggaggacccccacttctgcccatagtgttctcccagtgcccctgagcctttgccgatgacctcccagtcatctgctctatggcgcttccccattgggggactgtccttttcttcacagtatttaagaaataaaaattagattttcctggccaacaaaaaaagtaagtaacttggcttctctgaccctcaatctcctcctttgcacagttgggccaatggtgagcacccaggagcatccttcatcccactagaggtgcctgccactgggtagggcagatgtggtggtggctggtgcaggcttcccagaacatctcatcgcccctgcccaccacctggccactgcaaccaactgggcttgtctagaaagacacctgcctacccacccaaccctgcaggctctggggtattggtctctgaatttggctgagctacaggatggagaccaccctcaactgctcccatcatcagaggtgcagaacagaagtcggtgtggggggcacttgttccccccagctgtgctgatttcacactggcggagaagaggacccttgctgatagcggactgctcttttatttttttatgagatggagttttgctcttgttgcccaggctggagtgcaatggcaagatcttggctcactgcaacttccacttcctgggttcaagcaattctcctg

SEQ ID NO: 90721 - DNA, 2843 bp, Homo sapiens
aagccaccacagggcctctgtgacccttgtcctcatcaccccctccccagccccagctgtctctcctggccgcccagtgtggcctcacgctgcagcagacccagcgatggttccggagacgccggaaccaggatcgaccccagctgaccaagaagttctgtgaggccaggtaagcccaggatggggcttctggggtgcagggaagcgggccggggtggggcggggcgggtgtctgctattttcacagctccctccccatccacagctggaggtttctcttctacctgtcctccttcgtgggcggcctctcggtcctgtaccacgtgagtataccagagtatagctgactgctcacctgccccatccacctggcctagatctggcaggagtgggggtgtggagtggtgcagccagagaggaaaacatgcagctgaggagagagcgagctttgcaagatggtggtgaatgttcactcaacaggtatttggatttactatgcaccaaaagttggggttctgcagtgaatgagccccccagtcgagagtgagaagcaggaaaaagcagggctgggtgaaggtagcatctatgtgactgtggaaggagaaccaaagagaccgcagacccagggtgggaggttggattctcacctctgcacagcctgacacccatttccctgcaggagtcatggctgtgggcaccagtaatgtgctgggacaggtacccaaaccaggtgagtggcagagtgtgtgtgaatgcttggagggtgagggcgatgatcacagttgctgcagccatgggcatgggacccgaaccctgacactacactgtcattccccactgagtcccacgctctttgattcctctggggaatagagaggggccagaaaaccaagcaggagcttccaccaaaccactgcccttgattacctccagggatggggagctcactcattgggattcaagtatcctggttttgagcaaacggagtgggcccggagccatacccctgcccgattggagccttcgctccccacagctaaccttgtcctgtcctgctgcagactctgaagccatccctgtactggtggtacctcttggagctgggtttctacctctcactgctaatcaggctgccctttgatgtcaagcgcaaggtgaggccaaataagagtctggaagacccagtctctggccgggatgctggggtgctggggggtagggcagccttacaaccgcaccttgagagctccctggtgcctcctgcaggagatatagaggccatgggcccagaggccacaccaaccccctgaaaggacccacttcttggcccatagggtgggggaccttccagcatcaagcctcgtccccactatgacccaccgtctactgcaggatttcaaggagcaggtgatacaccacttcgtggcggtcatcctgatgaccttctcctacagtgccaacctgctgcgcattggctctctggtgctgctgttacacgattcctctgactacctgctggaggtgggcccgacccctgcctgacccttcccagctgctgtacccagccctcccaggtgccccagagatgaggtcccattcctcccaaccttcctgggagatggagccccacccctcctgtctttctcgggtgatgaggccctgccccctctgtcttccaggctgataaggccccaccccctctgtcttcctgggtgatgaagccccacccttcttggcttccttgggcagaggcccccgccttctcagcttccttgggagatgaggccctgccccccatcttcctgggagataaagccctgcccctctcagctccctccttggaggataaagctacacacatgtgcacacacgcatgtattcacatttttttttttgagacggagtctcactctcttgcccaggctagagtgcaatggcacacactgctcactgcaacctctgcctcccaggttcaagtaatctcctgcctcagcttcccaagaagctgggattacaggcacttgccaccatgccagctaacttttgtatttgtagtagagatggagtttcaccatgttggccaggctggtctcgaactcctgacctcaggtgatctgcctgcctcagcctcccaaagtgctgggattacaggcgtgagccaccatgcccagcctatattcacactctttacctttcctgaaaaggtaggtagttcctggaaacaaggccccaccccaactcacctggtcccatcctatagcaccttctctttgagaccagggccctggtcctgagcccatttctccctgctgccctttccaggcctgtaagatggtcaactacatgcagtatcagcaagtgtgcgacgctctcttcctcatcttctcctttgtcttcttctacacccgactggtcctctttcccacccagtgagtcagccctcccatgggggtcagggaggtgggagggcgtgtctgagattccaggactgcctcaccattggtaccctgccccaaggagctggggatcttggctgggagagttccaggaggaggcagggaagggtgtgccaggcacagggcacggcatatgcaaaggcgcagaggtgagacagagaattattattactcagcgtgcctggaccatgcagtgggaggaagggtcagggctgccagcgcaccaaagtctgcccagtaaatatttgtgggggcctcttgagtgtgctggtaacacagcagaggccacagttcaaagatcccggcccttgtgagcagacattgcatgggtgggagcagatggtaagtgaggcagccacgtgaactgcacagcatgcgaaggagaga

SEQ ID NO: 90722 - DNA, 1653 bp, Homo sapiens
tttactccttgggagatgaggccccgcccctcttaaactctgggagatggagccctgctccctgtgtcttcctgggagatgaggccccaccgcctgccttcctgacatgaagcccctcccctatgaggtgagtaggcagtcgcctgctgatgaaggggaggtgatgggggtctgaggagtagagagaagctgccagagtgccacccaggaaagcagctgagttcataagtacccgcttgggtggggttcatagtcatgaatggccagtcagggagctcgtgtgtgtgttctgctcatttagtacaagcgagagggggcctcgcgtgcccagctcaagagtgttaggtatcatggggtggggggcactagggagccataggtggttatggagcagggaaggccatgccagttagaaattcttaggactgggggctacagcggctggtcaaaccccagcctcctcctctccccctggctgtaggatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccaggtatggctggacctccccgggggccccagccctaagctcctccttcctccctgctctgagctccatccctctctctgttccccagatggagaaggacattcgtagtgatgtagaagaatcagactccagtgaggaggcggcggcggcccaggaacctctgcagctaaagaacggggcagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaattttctgcctgagaacttgggtccctatcaaagttccttcttcatccccagagacccccgagggagccaggcctctgcttacataccccacctacgggatactcactgccacccaaggatgcagggccccaggggccccagacagcaacagagctcagagaccacccgctccccacgctgttcccagatgagcccctgactcgccagccagtgactcaaacaagcccctccctccacccttagggtacccttgggtcagcctctcaaagacccccttgcagactagctctgaaaggtcaagtcctttgcccaagctcacaggtaggtcacagaccaggcctgtctctgcagtcctttcttaagtccggtagattgcccacctttgtggtccctggatccttccttgggacagtggagggagtgggctgaaatcccaca

SEQ ID NO: 90723 - DNA, 1049 bp, Homo sapiens
ggcgtgcactaccacgcccggctaatttttgtatttttaacagagacggggtttccatgtaggccaggctggtctcgaactcgtgacctcaagtgatccacctgcctcggcctgccaaagtgctgagattacaggcgtgagccactgcacccagcctctgccaccagctgtatggcctcctcttggttcctttctctgtaacctggggagtgcagtagcacctgcccagtggggctcttgagcccaggaactgctacactctgaaccccactcgtactaggggctcagtaacaagcagccgccagtgtggttcctatatcccgggacttcgcctgtctcctgcggatcacagccagtgactactgtgctcttggagaaaggtccagcctccagcttcccaggcttcatttgcatccatctcgcaggccccagctcaggctcgtgcccacccaccaagttccagtgccgcaccagtggcttatgcgtgcccctcacctggcgctgcgacagggacttggactgcagcgatggcagcgatgaggaggagtgcagtgagtggccacgccccttggcggggcttacagggggcggggcctgagggtggtttgtcaggggccaggcacgcggaggtggagcttgtgggaaaggcagggccgcagggatgggtgcgacttgggtctgtgggtcataagaagcggggtctaagatgggcttgggctgggcgcagtggctcacgcctgcaatcccagcactttgggaggctagggtgggaggatcgatcacttgatcctgggaggttgccgctgcagtgagctaggattgtgccagtgcactccagcctgggcaacagagtaagactgtctcaggaaaaaaaaagaaaaagaaaaaaaaaagaaaaatgaaagaaaggaaagaaaggaaggaaagagagagggagggagccaggtacggtggctcacacatgtaatcccagcactttgggaggccaaggcaggcggatcacttgaggtcaggcgttcgagaccagcctggccaacacagtgaaaccc

SEQ ID NO: 90724 - DNA, 1029 bp, Homo sapiens
caattctcatgcctcagcctcccgagtagcttgggactacaggcaccgtcaccatgcccggctaatttttgtatttttagtagagatggggtttcaccatgttggccagactggtctcgaactcctgacctcaagtgttctgtccgcctcagcctcccaaagtgctgggattacaggacaaaactctatacacagtctcttttttctcaggatgttgaggtagggattcccagcataccccgtttacaggtgaggaaactgaggccaggagagaaagtcactggtcactgtaactcctgtcaggcttacaccctatgaggcggggactgctgtgctctactgtccactttgcagagggatacacactcccgcagtccagcgaagggaggtcagaggtgtcagggctgtggaagtctgcgcctgggtggagagccacacctggaggctgccagatctcccgggggcggggaaggaagcaggcaccggtttgtccacagctcttctgggatccatagagctcagggaccctgtggcaagtaggtgcaattaggcctgaaggccgaggaggggctggcagtggggagtggggggttggaggctcatggctggtgggtaaaggtggaagaggttaaaggccttggcagagtgaagctaagccagggtggcggatttgccacctcccctggccgcacccaggaggaagccgtaaaggccactcccttcctctgtcccttggcccaggttgcgggcccctccgtgcccctccaggtcggcaagcagctgagcttccctgctcagaatctaggacagccgggatcttctctggacccagcttggacccttatgtgacctgtgtccacttataatcaggcactgccctgggtttaggcggccaggtcacagccctgacctccacagaatgtccagtctgtgggtggacaggcatgaccagggctttaaggacagttgttagacatgggaggcagtgcttcctaggtctccaagagggacatgagaaccctcccagga

SEQ ID NO: 90725 - DNA, 1066 bp, Homo sapiens
tctcatttcatcacggggttctgatggttccctttaacgatctgtattctggccccgacacgttctctgaattcatatctgcttcccactccgcggtgcctttccgcggcccgcccttacttcttcctccactccggtggggacccgtaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctggtgggtgcaaagaggacacccctttgatagacctttggttggtggtagggaggcttcgttaagcccagggtgagagggtttgggaggcagagtctacatacagagactgacaagagggaggcgggagtttgccaattgctgcggggcctgtcaacatctcatgtttgggtctgtttacagggtcttggatgtcgggttcgaccacttggccgatgggaatggtctgtcacagtctgctccttttttttgtccgccacacgtaactgagatgctcctttaaataaagcgtttgtgtttcaagttaactcaggttcttgtctgggttatacgactagggtttctccaggtttcttgagtggctcccaggcggtcaccgatcctccgcactctggaaatcctggccgtgcggtcttgccaaacgaagcttttcctttttgaggcggggggtcgtgtttgtcgattgcaccctctaccccaaacaaaacacaagcgtagtaggaatgttttattagcaaagaagtttcagagagtgggtggatcagggctctatcacttggtccccacctcaccttggtggggccagagtgagccccttcctgccacagtcaccccaactgaaattgcctttctcttcggccagtgttagcctctgagcaggggaccctggacccttctgtgcgccaaaggctgaggtgactgacgaggagatctccccacagctaggtgtagtgagccagacgaggcagcttactgaacctgggggttctctccattgtc

SEQ ID NO: 90726 - DNA, 1084 bp, Homo sapiens
gactcaggagagctcgcccggatccatggacggagacagggccgtggcgcccgcgggtgagtcccgaccccgtcgctgggccctggcttactcggcgccggactcgaactcagtgccctcatctcatccccgccaggcatcctcaaatccatcatgaagaagagagacggcacacctggtgcccaacccagctccggacccaagagcctgcagtttgttggggtcctcaacggagagtgagcgcctttcccctcctgtggcagcttctgccgggacatagactggggttggaaccccagctctgcccctctactggcagcgtggtctgggcaatcctcagtttcctcatcgttaaatgggaacggccacacccacatcgcaggactccagaacgagcccacaggggaggtttagcagacacctcccaccctgcccccaggtacgagagctcctccagcgaggacgccagcgacagcgatggcgacagcgagaacggtggcgccgagcccccgggtagctcctcgggctccggggatgacagcggcgggggatccgactcgggcacccctggccctcccagcggcggggacatccgggaccctgagcccgaggcggaggcagagcctcagcaggtggcacaggggaggtgagcggcgctcgctagttgtttggagaggaggcggctgccctcctcctggtcggcgctgtccccgatccatcctgagtctctcctggcctcctctgcaggtgcgagctgagcccgcgtctgagggaggcgtgcgtagcgctgcagcggcagctgagccggccccgcggagtagccagcgacggcgtgagtgccccgggagcgcagcaccagggagtggcgtgggagcctccaaggacctctgacgcccacttaggggagcacaccgggttccatcccttcccgccaggcacctcgcctgaccccaggctctccgaagggatctccttcccaggacagcgccgatctttccttggtttccccaaaaaggcccggccccagccccactcccggactccccaagggcaagcgttcattgcctttccccgttccatgttc

SEQ ID NO: 90727 - DNA, 1041 bp, Homo sapiens
ggaacggggaaaggcaatgaacgcttgcccttggggagtccgggagtggggctggggccgggcctttttggggaaaccaaggaaagatcggcgctgtcctgggaaggagatcccttcggagagcctggggtcaggcgaggtgcctggcgggaagggatggaacccggtgtgctcccctaagtgggcgtcagaggtccttggaggctcccacgccactccctggtgctgcgctcccggggcactcacgccgtcgctggctactccgcggggccggctcagctgccgctgcagcgctacgcacgcctccctcagacgcgggctcagctcgcacctgcagaggaggccaggagagactcaggatggatcggggacagcgccgaccaggaggagggcagccgcctcctctccaaacaactagcgagcgccgctcacctcccctgtgccacctgctgaggctctgcctccgcctcgggctcagggtcccggatgtccccgccgctgggagggccaggggtgcccgagtcggatcccccgccgctgtcatccccggagcccgaggagctacccgggggctcggcgccaccgttctcgctgtcgccatcgctgtcgctggcgtcctcgctggaggagctctcgtacctgggggcagggtgggaggtgtctgctaaacctcccctgtgggctcgttctggagtcctgcgatgtgggtgtggccgttcccatttaacgatgaggaaactgaggattgcccagaccacgctgccagtagaggggcagagctggggttccaaccccagtctatgtcccggcagaagctgccacaggaggggaaaggcgctcactctccgttgaggaccccaacaaactgcaggctcttgggtccggagctgggttgggcaccaggtgtgccgtctctcttcttcatgatggatttgaggatgcctggcggggatgagatgagggcactgagttcgagtccggcgccgagtaagccagggcccagcgacggggtcgggactcacccgcgggcgccacggccct

SEQ ID NO: 90728 - DNA, 1046 bp, Homo sapiens
gccttccggggggagggagaggaagtgcctctacaagggcctagagtcgtcctgtggcactgagggctctggcagctgcacacaggttgataatgtcactggtgggtgaggctctgtggtcagcaggtgcccggcccaaggtctcgcccctcgtggcaggaggaagctttggaagggttttggagactgggattctaaggggccgtctggagacagggggactaaactttgggtcctgctgatcgggtgccatctccactcagcccaccgtgaggcagctgctcccaggtcctggctgggcacccacccagacgtggcactgccagggcaggggtgttgctccccacatgccccatccaggtttctgtggttatcccctgcttgttatttttgcccttttgctgtgttaaatgacccagctccgagtgcttgctcaagtcatggttttgccctttagattatttccttgaagtgcgttcccagcagaacagttactgggtcaggagcaatggagaggctgtgtggttcccgggacttgtctgcagagactgcttcctggaaacactgatttagcttctgcggcatctggcatttggcgggcaggcggtgtggggtgggggggggcggtgcctgccctgctgccctccccacactggcctccttttactgagtctagcaggtgccctgctgaccttctcaagctagttggtagcaaaaatctaacccacaagttcagcttttcccaaactggtcatctgccgtctcaccttcacagctgtgcctcatcagaggacctcctctattctctttcaatatttttcttttcctttttcttttcttttttttttttttttttttttgagacagaattttactctagtcacccagcctggagtgcagtggcgcaatctcggctcactgcagcctccgtctcccgggttcaaacgattctcctgcctcagcctcccgagtagctgggattacaagcacccaccacacccggctaatttttgtattttagtagatacggggtttcaccatgttgg

SEQ ID NO: 90729 - DNA, 1616 bp, Homo sapiens
tttacatctgtccctggggcagccctgagaatgtggacagctgaggcctgcaaagcactggggacccagcctggccaaagtgcttgagggcaaaactgatggggctgggtgccatggctcacgcctggaatcctagtactttggaaggccgaggtgggtgaatcacttgaagtcaggagtttgagacagcctggccaacatggcaaaaccccacctctactaaaaatacaaaaattatctgggcgtcgtggtgcacgcctataatcccggctactcgggaggctgaggcaggaggatctcttgaactcaggaggcggagagtacagtgagctgagattgtgtcagtgcactccagcctgggcgagggagattccatctcaatacaaacaaacaaaaacaaacaaactgatggggctgaggagccactaaggctgtacagctggggcaaggctggaatggtgtgaaggtgtcgggaatgcctgggcagggcccgagtttcctgtcttatttcctgaggacgtgagaactgagcagacctccctggccttggccaggctcccgtagctgccgtggaaaggaggttaaggttggtggtgtagatgggggccctcacagtgagtccatcttggcccccagtggcctgggagccgattctcatccctactggcttggttgggaggtgctgggccacacgcctacattcactccacctctttccatctttcttttttttttttttttttttgagatggagtctcgctgtgtcgcccagcttggagtgcagtggcacgatcccggctcactgcaacctccgcctcccaggttcaaatgattctcttgcctcagcctccaccaccacacccggctaatttttgtatttttcatagagacggggtttcaccatgttagtcaggttggtctcaaactcctgacctcaaatgatccgcctgcctcggcctccccaagtgctgggattacaggattacaggcatgagccactgtacccggccatctttctgtctttctctgaagtccacttggtagccctgtgcggggcacccatggtgacgtgagagaatgccagccccgttgtcttaggtctttcacgccaggccaagcagtggtctttggggagaggagaggtctgagccgaggggtcttgaaggatgagtaggagtttgctggccgccccagggggacaggctgccctatgcggtgggagctggggtgcccagagcctcaatgcccaccccataaggcagaaccacgactcccgagccacgtgctggggtttggggtaggacagtgagtgtggcagtgagttgcgaaggaagaacttggactgtggatgcagaagacctgggttcaaatcctgcctggctcacttcccaggcggtggctccagacaagtcacttggggagcaccgttgggaggtgagggcgagcccacaaacatgcatagcttcagggtcctgctctgccccgcaccccgttccccatccaagcctcagtttcctcatctgtaaaaatgggctacaggaggcttctgcgaagtaacgcacatcaagagctttgttagcacaagctcatcgaatattctccttgttcttgttatt

SEQ ID NO: 90730 - DNA, 1562 bp, Homo sapiens
tgatgtgatgggggcgctgtgggggtctggagagggcctctggagtcctgcagggaggggttcccctcggcaggcagggcacgtgctggctcaccccacgtccccctgtaccccctttgcagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgcccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctccgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacagaaacctgccgctgcgcctctgtcttctttcttttccgccaggcgccagctcctaggctgaggcccctctcgctgcacgttccccaatgcaggccagaccccccgtctccccagcccaccccacaggaagcgagaggaccccagcacctgccaagggcagcgtggaagtcagccagcgcagttggggtgggccctggtcaagctgcccctgtggcagggagggatggaaggctgccgcttgtccttgactttaaactcctgggtcctaggacctcaggcctgcgggcgtcccctgatggggatgggagccaagagcagtggccagggttcatcactttgtctcctgccagggcctcccctcccctggggtcctgacgagggtgacttgcccagtggatgttggtgatgccagatgtctccac

SEQ ID NO: 90731 - DNA, 1044 bp, Homo sapiens
gagtttaaagtcaaggacaagcggcagccttccatccctccctgccacaggggcagcttgaccagggcccaccccaactgcgctggctgacttccacgctgcccttggcaggtgctggggtcctctcgcttcctgtggggtgggctggggagacggggggtctggcctgcattggggaacgtgcagcgagaggggcctcagcctaggagctggcgcctggcggaaaagaaagaagacagaggcgcagcggcaggtttctgtacaggaagtcagattatacatttcagtaacgggcggggtgacggggacggggcaacagcgcaggggccacagggagaagaagagatcgagagctggggtttggcgtaaatcttacaaagtgtataaagaatctgtgtttctctacattaacaaaaaccaaaggctacaagagcggttgtatatacaaaacacggagatattgcttcacttgcaaacaggttccagaccagatggggagacgagacagaggagggggacagggagggccgagagggcgcgttgcgtgcaggagaggggaggggagaggggagagggggggacgggcttctccctgcatcaatcaacaggcagaggtgggaggcctgtgcgagctgctgtgtgcggaggagcgggtgggcgctgagagcccggggggtccgcctgccccggcccccgctgcctggttcttcgggctttggcccagagcacggttctgggtggggacgacgggctggctgggccacccggtcacggagggagggaggcaatcgctccctagagtcggccaaggaaaaggggagaaggcggcgccgtccgcccgtcctcctcgcctctggccagccccgtccatcctgccgccctccccaccccgccaagacgctgtggggacccgagtttcatgggtgcagcaaaccggggcttctagcttttccccgggcaggacggggtagcactggctcctgtccttcctgggccccggcccggccgtgcagagctcactgggagggctggaacgagccggcc

SEQ ID NO: 90732 - DNA, 1569 bp, Homo sapiens
ttacgaatcgtgtgccggaccgcgggttgaacaagcttcatctaaaacttccaggaatctctagacaggatcattgcttcccctctgctccagctctggttacagaaagctgagagtgactaggtctaggtgtttgtgtggggtggggtggggagatgcctcctctatcggactcagaggacgcgcgccgggaacagccagtcggtgcctaacgcgagtgtatctcgagagagaagcgatcaacagctgccggtctgcgcctgcgcgcggcgggggcgtggcccggggcgagtggggccaaggaggcagccgggagcggcgggcgcaggtgttactggttgcgtcgggtcacgtgggcgcgcaggcgcagcgcggtgcagcccgttcgctcacacaaagcccagacgcggagaaaatggcggcaggggtcgaagcggcggcggaggtggcggcgacggagatcaaaatggaggaagagagcggcgcgcccggcgtgccgagcggcaacggggctccgggccctaaggggtgagtatcccacggtcctttgccacgggtaagggttcctctccgcggccgacgcgggcggcggctccgttaggtctgttggcggcctagccccggcgcggcctcggccccggctgttcccgtaccgcctgctcagggtagcggcgtctagggccgtgagcggggagccgggggagcctccagaatcgtcccctacaccgggcctcgagcctcgccaccctcagtccctccaggccggggccaaccccgtagtcgaggcctcaggcccagctgctgcgcatgggggttgatggcgcgggcccggaccggagagcctccgaggcctacccgaccgctccccgggagggtgacctcgggggccgggtttcagccccccgtcccctctcctcccggggtctgttttctgatccgtaacgtggggggaggagagagggtgcgcgcccgggaggcctcgcgcgcagtcagcccgagtcaacggtaaccgagcgagggaagcgtcaggaagggccgcgaagccgggtcggggggctcccctcctgccccgccccttagtccccgcgcgccgaccgcgctccgcgggaagtgcctccctcggaaccgcccctcgccccacgctctggccctggctcaagtccctcgccgtttcccgctcctcctccccgggtgcgccgcaggtattagtggagagatgggatctgctgcttagcgttcaccctcggaagcagacagatacgaagtcgggggaggaatcccctttttcccgtgtttcggggaagctgttctgtcaggaggcgggttcatttacttccagacttcatcagcttttcgagtcctgcttggggctctttgactccttggcttttaaaagtttctttaaaggaggaagcatcgacttgtgccccggtgaaactcattcattctgattacagacacttaagagagacagagaggttttggctccaagatcagcggccgggaaggaaggggaagcctgggtacacattgaatttcccagacatttatttcattgtggtaaaatag

SEQ ID NO: 90733 - DNA, 1079 bp, Homo sapiens
agttgagcgcttaggttaagaacgttccctaagtgctagctatattggtagataataaatccggagaaaattccagattctttccctccttaagtagggagaaataaaataccatggttactggcccttagaaatgagaaaaacttcctctattcccagcattttactattgaaaactctgggaaggaatgtgttaattttgactttttcagcgtctatctacggaagctggtaggatttctgagggtggtatttggagggctttaagataaatttatttaccgtatgcaggaaggagtgctggtagaaccttgctagatgatagggtaaattaatagattacaaattttcccttttcccctgtccattttcaaatagtcattttgtgactgagtcattttacaaatacatgtggactgttggaacctgaaaattgtagaataaaatagccgttgtgagaaagaggctcaaagtctcaaagtctagtactagcttcatagaggatagtttaggaagctggcaacacttggatatttttgatagggcctgtggaaaacttttttttttttttttcattacaagtcttaaggaaatctctttagaagcctatacttttgcactccatgcagagtggagaggccattaacatatttgtatgttatgtatgttatgtaattaccataacataaggtaattatgctgtgatagaagttagtggagttgcttggtagaaagaatggaggaggtgacctccgccacctgctgggggcagggacctgttcctccatgacaggaagacgtgtggaagtggaggagaagaagatggttggggaggggcagggaagagagtatccaaagagcagagatttgagtgtatgctttatcgagaactgaagttgtgctgggtgtagtggctcacacctgtaatcccagcactttgggaggctgaggtgagaggactatttgagctcaggagttcaagaccagcctgggcaacatggtgaaaccctgtctctaccaaaaaaaagaaaaaacaaaacaggctgggcccggcggctcacgcctgtaatctcagcact

SEQ ID NO: 90734 - DNA, 1072 bp, Homo sapiens
aattttgtgggtgaataagaaacagatggattggttatttataaaaataaaaatatatatttagggtagattcctgaggaggtactgttagagttgactccatttgacaatcaagaaaactttcgttttaaacacttaaacccaggttcaggaacctgacctaaagactccaggggaggccctcctgactcccaggcagcttgctgctttcatgatactaccttggtaaccactcagtaaacagccgtttgaattgttttatttaaatcagattctctatacaatgcatttgagtgtttgctgtactttaaagagtgattgtttattcaaaaaggattttggagacacgtcagattgtgagctcaagattagaagacagggttttggattatttgaatgcatgctgccaggcctttgctttcactcagctctttgattttattctggttagggaaagagatactagcctgcaaagattagcttgcttgtttttttgggagggggggttctccaatggacttccccattaccatattttgcagtcatagggttgaaagctaaattgtccctttgctagtctgtaatgattatgatgcctaggttttctcagccttggctctggtttgctagttttaaagcctgaacagtagaaggctaggagtgaatcagtccccctctctacccttctcaataaaattattggtagaaaaatacatcattgcctcactgtgtgctaagagtctcttttttttttttttttgagacggagtctcgctctgtcgcccaggctggagtgcagtggcgggatctcggctcgctgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaagagtctcttttaaagctgtaagcgtgta

SEQ ID NO: 90735 - DNA, 4019 bp, Homo sapiens
ttccttgggaatgctttctgccctgtggagccttgagtttgaatgtcttaattcaaaaccaacattagtcttgtctttgctttttttgagacagggtctcgctctgtcaccctaggctggagtgcagtagggtgatcatagtttgctggagcctcgaactcccgagtttaagtgatcctcccatctcaccctccctactagctagtactgcaagtgcaccaccacacctggctaagttttatatatatttttttgttgttttgacagggtcttgctatgttgcccaggctagtcttgaactcctggcctcaaatgatccccccttcttggcttcccaaagtgctaggattacaggtgtgagccaccgcatctgaccaatactagtcttgtgtcatatgtaactttgtgtggaattgtaaacctggcaaatcaaataattatctttcacattgtgctgacatataaaccctttacctttttttcctctctctcgaattcagtgaaggagaacgacctgctcagaatgagaagaggaaggagaaaaacataaaaagaggaggcaatcgctttgagccatatgccaatccaactaaaagatacagagccttcattacaaacataccttttgatgtgaaatggcagtcacttaaagacctggttaaagaaaaaggtaatggtactggtgattgagtagggtgagaaggttggtgtgtcatcttttctgtggctaattccttggttatttttggtcagtggaagcggctctgggtagagcatgttctttccaggcttaagagtgaagcccccttaccccacctcagttttttttttttgttttgtgttttttttttgttttgttttgttttgtggtcatacccctgtgtgtcaaacaggatggtttgtatggtcctttggcctacagatgattttactggcttagtatggttaataaggcttcgattaggcttccggggagccttttcgtgttgaaattttttgaattttgcacgttaggtgggagagatttttcctttctttccttttttttttttttttaagctttttaagtttcacaggaagatagcttgtttaaaattttgtggatgtcttcctgggatcaaaatgtggtagctggaccttatgcttctcagattccaaactataaaacattagcttgtattttaacttttaggctttttcccctctgggaaaaaatagagtagactggccattggagagctcaaaataaggtatctgctttgtaacgcggtgccttaggatgtggattgtcatagcctaggtgtccaccttccagccgagggcaggggaagcagccaagctctgctgccaccaggaggcccgaggaggcctgcctctgtgatcctcacccccgtgcacactgtggtgtcctctctctctccttcttccctcctgtgctgctatcgtcttcctttctttcctgattcttggccctgctggtggcacttaggactaaagagactgctcagccctgggttagacaacaccgtggtagagaacaatttgtatattgccttgaggcgccctccccgcaccccgacctagactcaaactacccttcatggagtctttgcatgactgaaaggtattggttttctggagcattcattatgaaaagagatgtgagcttgatttgtcaaatgatttaacatttcagtgacagagatgccccgtggataggccattttggtatgtgtactggtgctccctgcattggattttgaaattatgaatggcactgccatcattgtcccatcccttattttgaccatgacatgcaagaagcactaggcactgtgaacctctccgtacagtcacgcgtgctgctcccacgtggcatttctccagataacacagatggaaaaacgttttggtgtgagattgatgtgcctgccttgatcagccaaatcattcctgccaatgctcctagggcaagagtgcagtttcttctttttgtctgagggtgtgtcatgctgcatcccagatgcagtgttcttggtttttgggactgctgcttcaatagaagcttagaatttctgtacagtacagttgggcctcattcgaattagcttttggaataacctccaaatttgtgttctcgtgatttggttgaaccgctgaattgctatttccattgataataaggtatagtagttccaagaaccaggaatgtggctttgaaaatgcaattgttagaattttgtaagagattgcaggccaaattattttttcatttttaggagtgtgtgaaccagttttgggacatgctggatgaagtaggtgacatttttactgctttaccattcagtaattcggtttgggaaaccttaaagctggtagtagcagcagcagccatggtgtttctggatgtagaagcagttcacctcaattcactattttgcactcttaagtgtggagccagcctggtggttgattgggatacttccaaactggttctcatattcccctggcatactgctacgaatgcctgggctcagccctctcagtgtatttttggtggtgtaatttagaattacaggtgtgcagtaaatcagttatttttaatgagccttaaaatgttcttgtttagagctcccctgtactggttaaattaattactttgctgtttaattaaattattagcggtataggattgtgggtaaagtgactcagaaaggtaatctttttatgataatgcttatattcagtatgtgaggtctaaagaaatttactgtgtttacatacatatgacttcttaagaaatactcttcttattacgtgctttcaaaaagacgtttttattcccgttttggtgtacaaaaaatgtttaagtggttagtttaaatctgaaatatttacttgaaatttgttgcgcataagttttaagtgttttgaagactttatacataggaagaactggcagatagaggcacttacaaccctaaaagtattagtctcaattccaaaacacagagatctgggctgttgtaacctaagcactctttatcagtctgtgttttaaggtctgatgaatcttagccttgtttcaggaaatgagtagaacaagaactggaattagttgtcctcaactgaaattttctgtcattatagcactatctaattgcagcctctcagaactaaagtagctagctttgagaggcccaagaggggagctttttttctaaggatactccggggggagattgtctcacatgctcctccctcactcttgatcctcttccccatctttcataccagctgcatattctccagctttaattttagcatttagcagcattctagcatttcctattaaaaatccacataggaagtaaactggtcatttatgcctttgaaagtgacttaacaggccacagctccccaggttgtatcctgacaggtaaagggatacacatcttaaagtgattgaccataaggactgggtggaaaaaataaagatttctgtgagaaaaggcgatcttaggcttttaaacttagtgtcgtgctacatttgtttgagaccaagtcctgtatgagtggaggaagctccttgctgggctgcttctcttgacctcaccaggcagccggcagcacccaggtggggcagtgccaccagagcaggactgagctgcacctgcagtgagtaaatagagcccaggttgaggaagaaaggaaggtcagggatgtagtttaccctcagtcgatccgaagtttagcagcagtcagttcaacttgtgtaagcaaagatttcttttaagcacttaatccttctgttagtataatacaccactttaagtaaatttcaaattgcatctgacagaaaactaaggcccagagggcaagtgtagtccagtagaaaacctccatcttggctcctggagataatttgcattgtgggtctattaggcagaactgtattttcaatttaaatgatattcctacccagtctacttgcttcttcatattttcctctgttggaa

SEQ ID NO: 90736 - DNA, 4351 bp, Homo sapiens
ttcttagagcattttaaatagaggtagataacagttggtgttagattttttaatgtcttagttttttcaatattttgatgttttaagctgcagtagaatttgtcttagcagcctactcttgggattccatgaattccatccatgtttacacagggggaggagcaaccgtattttttattaataactgtgagtgccgtttctgtaagactgctgctactgccaagctgtcacctctacccctgagtcctgactgtgtgatctgctctggatggtttgctcgttaaacttcacttcatggaatgtgaccagactgtttacttgacaaattttgccctcacattcttgtcgatagttgtactgactacataaaataaatctttgctttgctattgtagaaccaaaagggaggtggtcttttaaaggctccattttcctataggaaagtatgaattagcagctattgcagatcccttaacacttaatggatggtctctcagggtagaggttggaattttatgagtttgtgaggaggatgggcattactgatgatctcagggacagcactactcatgctggacccccgggtgactgctaaatgatgataccacttgaggtaaaaagagggagaacgttttaagcaaatttttaatacaaaggattgagtcaggtgtgctatttctagactagactgttacgtggaaaaagtcctaatttctaaacctctctttttgttaaagtggttatggccatgggaaaaagtttggtttggatttgcttggtttctgggttgcaattacagctttttgatccaagcgtcttatggacacagactagaaacttcccatgcaactgggacttgaatttcggcaacatggttgcagctgttttgaattaattattgtgagtcttttattttttaaaggttattaggtggtagtcatagctggtaggaaatcaacttggggcctcttcagtcactattttgacactatgtggcattttcatcaaagtggagacaagggttggtggtccttgaatggctgctgctcttgaaacaaatggctttttaacatggcctcagggcggctgcatttttggaactgctttactttttaagggttaaataaagccgctttgtacaactgtcccttggctgtgatcatttttcagtttgccccacaggagtacatactctaaaagtaaattgtactgatccctcatatttccgttcttcatttctttgcactgatgattctcctgttttgtacaaagtgtcagtttcgttctgaaacatttcaggagaggacaaagagggtgaggctctagatgtaaactttggacacttggctttcttgccttcaaccaatgtgcagagccattaataaatatgtccttcagatctttaaattttttgtaaaataattttaccttgtttttcattaaaaatttttcttcctatagcctcataattttaatgtcctttaaacaaaagagttggaataggcatgacttgttgaggccgttaagcgggttatttttacccttgtactgctaaaccaaaccgatccagaggacaacaaaagcccattttttgcctttggagagtctggttagagatagttttctccagggtaacactttacatttgttttctgtgtgccatcttcaagttcagcagccattttggtggttgtcttgatggattctaacatctggtcatggtggtcatgaattggcaatccaaaccttgaggaaaatctgcagaaacttttgaaatgctttggttttttcccttttgtgtagattagaatcatatgagtctgtttaactgtttagatacaaaatctgagccctaaatttgaatttatttgtgtcctttaaatggggaggtttagaaagcggcaagaatgaagcctggcctaattcactgaagagaatccagatgctgctctggttttgtgatcttattatattcaaacattctgcctctacagatgtggagcctagtgctgtgtgcaggaccagctatagaatttgtggggcccaacacaaaacgaaaacaaggggcctcttgttaaaaaaaaaaactaagaatgtcatggcagcgataacagcattaaaccaagctcagggcccctgagtgcggggctctgtacaattgcacgagttgctcacctgtgaagctggccctgcggccgtgtgtgcctgtgagcttataccttcgcatacgtgcgtccttgtatttatagcatgtgagctcagcccgatggcatcgcaatttgtatgcatttcacctgcttgccaccaatgagagcgtatgtgtaaaacctcctcccttccccagaaaagtaaatcacgcagacttctttcctatagatttggattgcctctagtcatgaatgagtcttccagacagggaaattgatacggaaatctgtggaatagcttgtttgtggtgggaggaaaatcaaggacatattgttaacgtgttttcacctacttttactgcacacctgtaatgcctagttcggtggtttagagaatatggagtgtttctgggctttcttataaggcagaggctccatacaaggttgctgatgattgttctaaattcccattgttttcttggcttttctcccttggtttatgtgtcgtctggaaactgatttgtagttggtgaggtaacatacgtggagctcttaatggacgctgaaggaaagtcaagggtaagtgtctgagagaatttcttctgtggatttactacatgaaaaatgtaactgtatggtggcgtggaatcgaatgaaatcaggaaggcagtgagtgctcatgttacagtagctatgtttgattttgccaaacatttgagtggggtgggaggggatttgcaaatgggagtcccgcttttccaaatggctggccaaagagctttttggtattctgtttggatgcccaatttggataactggggaccaatagcagcattgtctctttgttaacagaggaattggctgtgtgtgaattatgcatggaattttagcggtggtataattaatgtaaaacgtgtgttcttgtctagaaaatgttactcttggttgtttgctgaatttgaaagttgtgtgaaccaaagattccgaaaagttgcctttgtgccagtaaattgtaaaccaaatattaaaaacctgaatgttcaaaattggcctagtttaaagagaacataaactattttctgtcgtgcaatagaatggcttagaataatcaaaaggatgagcttaacttacggaagggatggatttaggaggaatatggtaaggactcgattgagtacagagggaagcagatctaaagttggtgtgatttcttggagaccctgaatttaggtctgcttattaaatgtcagcagctctagtgcaatgctggtaacgcgtaggagaaggagatattaaggagcccagcttttaacaaggaaggcgaggcgaggcacttctgtcagcttccccttagaagggttcattttaaaagactaactttgtgacataaatcatatttttagtttgtttataactgtcattgatatttactatttttttcttttctttttccccttccttgctcttctgactggtctctggcttcctccaaagggatgtgcgtaagtatcgtctagttacttattggtatttgagccttctaacttgtaggactggtttcactcgactcgtttccttttgactctatagtgttgttgaattcaagatggaagagagcatgaaaaaagctgcggaagtcctaaacaagcatagtctgagcggaagaccactgaaagtcaaagaagtaagctcttgcttaacactgcggatactgtgtgtaattgttgagtgatcctactttggaattagggaaagacggtcatggtcccagacggcatttacaaagcaagtgccagcctgttgtttctaatgaagagtgtcggtcatagcctacagcagccattccctgcaaggactttggggtggtggccaagcagatcctgagtggctgctgaccaccttctaatatctgtgatttgtctgaggccttgttgtctcagggactctcaaaccatgagcccgtgggtttgtgccattaagttttactccatctgacccttcttcttggcccatcttttttctttttttaaaaagtgagtttgttccagcctgggcaacatggtgaaaccccctctctacaaaaggtacaaaaattagccaggcatggtggcgcatgcctgtagtcctagctacttgggaggctgaggcaggaggatcatttgagcccaggatgtggaggttgcagtgagctgagattgcaccat

SEQ ID NO: 90737 - DNA, 4462 bp, Homo sapiens
tgattaaatccctcttggctgggcgcagtggctcacgcctgtaatccccagcactttgggaggctgaggtgggtggatcaaggtcatgagttcaagaccagcttgaccaacatggtgaaaccctgtctactaaaaatacaaaaaattagctgggcgtagtggggggtgcctgtaatccatctactcgggaggctgaggcaggagaatcgctggaacccaggaggcggaggttgcagtgagccgagatcgcgccattgaactccagcctgggcagtaagagcaaagctctgtctcaaaaaaacatccctcttaacttcttttcacctcttctcttggggaggaagatgagtagattcagagtgaagcttggtagggtctaaggtctctcatgtgttatgatgtcttttttagtgctgatggtggtaattgacaggacagagagttgaagaagagagtcagtacagagcttcacagaccttcccagatgttgttttactgcgcagccctcacacacacgcctccaacacctgaaggacttgaaggatgggggcgcttgtgtggtctagaactgtttctcaaacttctggaagccattgacggggtttgcagaagttacaaaaccccattgatgaattagtaagattcagctataccaagcccatgaagctctaatttcagtctggcggttctacattatatcagctaatcatgtttccctccctaccctgcttttcttttttacttagtgcaattgagagctgtgtttttagtgctacacttcatgccttttcttcctttcctatttctttagctggactcttctaagctggtagttgagttcatttgactttcttgttaatagatttgagagatgctttccaaacaacctttcagtttctaagtcttgagaatatcatttactgtgcaagcatggtttgcgttgtactgggtcagttaaacgtaacaccttttgtgcttgttttaggatcctgatggtgaacatgccaggagagcaatgcaaaaggtgatggctacgactggtgggatgggtatgggaccaggtggcccaggaatgattactatcccacccagtatcctaaataatcccaacatcccaaatgagattatccatgcattacaggctggaagacttggaagcacagtatttgtagcaaatgtaagtaaacagaaccatcgtctaaagtagaaaatcagaactttatgaaatgaccttgtcaatatgttataaaagtaattctcacatttgagaagaaaaatgtaaagaagggttttgttcttgatttctttaaaaatcagccttataggcgggctttgtctgcattcctaagtcacaggcttgaccgtggtctcgttggggctgtgattcctgagtttcgcaggtgtttccgcaagcagtaaccgagtctgcattctccgttggtttattttatgcagttttggtgcagagtaagactgtacgagcagaagtgcactgacaccttcctcttgttgtgtctggggtgaatgataatacctccaccatctgcaaggggaaatatttttagaataaagtaggttgggtggggtggggagtggtaaagcttatcagggaaacaattttttaaaaatgttcagaaaatgagtattaatttgaagtatgaggtgacttaagtttctgagaaaagagacaatatatttactataggtacagtttatttacagtgaaggccaggctttataatcctattttaaaatttccattgcagttgattagtttttgtgacattatttcctaatacttttttccaaccaaagcatgtatcattcatgtagtaaaaatgttgtgtttcttaagatgtttacattgaggtttttaccccgttctctctcgattagctggattataaagttggctggaagaaactgaaggaagtatttagtatggctggtgtggtggtccgagcagacattcttgaagataaagatggaaaaagtcgtggaataggcactgttacttttgaacagtccattgaagctgtgcaagctatatgtatccttctgcaggaattcaacttatgaacagtttgacctaaattgctgtgttagtaatgtaggtttgtgtgaggaagaggtgactgtgtgtattcatgttttttatgtgactagggggagtgcattactgtggaattaagaggttctctgggccggaccggtcacggtggctcacgcctgtaatcccagcacttcgggaggccaaggcgggcggatcacttgaggtcagttcgagaccagcctggccaacatggtgaaaccccggctctactaaaaaatgcaaaaattagctgggcgcagtggtgggtgcctgtaatcccagctactcgggaggctgaggcacaagaatcgcttgaacccgggaggtggaggttgcagtgagccgagattgcgccactgcacaccaccagcctgggtgatagagtgagactcagtctcaaaaaaaaaaaaaaaaaaaaaaaaggttctctgggggtggaattgattcaatacagtgtggatagaggggatggttacaacatgggcatatgcccatgagtctttctactgttttcttttcagaagagtctaggtttgaaggaggaagtccaaagaatgtgctactagagagaaagtggggttgttgtttcatgtgtaatacatccttataggacctcactctttccagtgagtagacatcattttggaagaggccacttctccttgaccctaggcttagcctagagtttttaatcccttggagagtaccccacaggagcacattcatacaactcagacaagaccgtcactgcatgtcttacccagaaaacatggtccttcagtttagatagtggtagatgcctggcccattggtcacattcagagaaccttgatgccactgcttaagaggatggtttggtgaaattgtaaggttacgaatgaagcttcacacctaaggaataagcggaagttgtcttgtcctccccgccagctttatttattgttccttttatgtttattgttgaaagtataatgaagaattgaaattgctcataaattcatcacttagagggactggtagcagttggagtatttttctttctttttgtatttctcttgtgcacatttttagaattgcaagaaatagccttaattgtaataccagctatgttcaatggccagctgctatttgatagaccaatgcacgtcaagatggtaagtcagtaggatctttctctgtgatatactcaagtctagcaaaaacatggaattaataagagtgtacatatagccactatgaaatatttgtggattagtctaagttaaatagggtgcagtatgttgagcaaaattgtgagagaaataacattttgctggtcaggcgtggtggttcacgcctgtaatcccagcactttgggagtctgaggcaggcggatcatgaggtcagcagttcgacaccagcctgaccaacgtggtggaactcctccgtctctactaaaaatacaaaaattagccgggcgtggtggcacgcgcctgtagtccagctactcgggaggctgaggcaggagaatcacttgaacgtgggaggcagaggctgcagtgagccgagatcgtgccactgcactccagcctgggcaacagagtgagactctgtctcaagaaaaaaaaagaagaaaaaaaaacattttgctcatggcagctcttgactgcattagatatttttccttttgcacagttgactgttcatggcgcattcaggaagtcacctgggtatcctggttgagcaagtgatccgtttcaaagaatggttatatatgtggggttccagtttttcaaagtattacagtataatgtttggttagcatcaaatctgttgtgaacataattaagtcattgattcagacagcttttaaaggtctgttggagcacttcaatcttaataaacatttgctctgccgtaactgtgccaaagataataattactacaggcatgactggaacatgctgagggcagtctagttgggactcaaattcaggaaaaagataaactataaagcaattttttcattactctaaatagagtaggtaagttttttgaatagatgatagattcacgtgactcaaaagtcaaaaggcatgaaaaggtagtgtgaagatagtgtgagtcctacttggacttcttgcccaggtccccatcatcccccacaataatatccatgtgtcttttcccttgacataaaataggaagcatgctccgcatgcctttctacccttgcgtattactccatggcgtggataatgtgtttagctggtcctctcttgatggggggccatttcagtcttttgctgttgcaaacactgctgcactggatactgagatttgtttgttttctttctctttcaggatgagagggccttaccaaaaggagat

SEQ ID NO: 90738 - DNA, 2131 bp, Homo sapiens
agcttcattgttactaaaaccacccagattcagagagtagtggacacccaggatgttgattggctggtttgtaacgtgttttttcatgagaaacatcctttgggctactagggattgggcacatttgtgctgcttgccacctgatgtcttgagtcaccttttttgatcagacagttctcagtccatgggttagtgaaacaaataggctctcaagaatcttagtgtgggggttgttaactttcccgtgttggttttcagccgcctttgttgtatacacacatatcccaaacgccggaacaaggctctgtttccaagtgtgccgatgttgaattttgcattgggccctgaggtcactggtgggtgggggtgggtaggctgaagtggatagctgcaactcactaaacactcttttcctttgagggtcaaggtttgctaaataggggaaaactaagcttctttctcttttctttccagatggccttggtggtattggcatggggttaggaccaggagggcaacccattgatgccaatcacctgaataaaggcatcggaatgggaaacataggtcccgcaggtgagaatgacagtgcaccttgcttggtggtttggggaagtgaaaattattaattattgggacaactggactttgagtagtttaaatggaataaatatttaactgggacaaaattccctccttattcatctctgcctcattttgaataaaggcagtattttgtatttttatcaagttgagtcattttttaaaaagtcattatgctttttcattgtaacctgacaacaaccttctaagctgaaatagttgtgccatttgataagaggaggcaagccagagagttgatcttgctcaaggtcacactgtcagttactgacaggctgcaggtctcctgaccacgggaccatagcactgccgcagtgccctgaaaagtgtcttaccaagacccctttgggccctcctggtgtttgcacagctgctgctagagagctaggggcattgatagatgcaaaaaaggtggagaggccaggcacggtggctcacgcctgtaatcccagcactttgggaggccgaggtgggcggatcacaaggtcaggagtttgagaccatcctggccaacatggtgaaaccccatctctactaaaaataaaacaattagccgggcgtggtggcgcacgcctgtaatcccagttactcaagaggctgaggcaggagaattgcttgaacccgggaggcggaggttgcagtgagctgagatcacatgactgcacttcagcctggcaacagagcgagagtccgtctccagaaaaaaaaaaaaaaaaaaaacctgcatgaaagctttgatgtgtagaataaactcaggctttgctgtttagcattttcattgctgtgtaatgatgtattttgattctattaaggaatatgtcatttttatgaccttagactttggtctttgttggaatcctttgaaattggaatatggaagcccctctatcccaccattgtcagtgttgcatatccctagactctcttccagagtcaccctggggctgacttaaattctgggccacaacttcaaatggctgttaacgtttcccccgacccaaaacacacacaccccatgtctgacatctaaacagaaagactgggggttggggaggaagtcttggtgtttttaggaactggtttttattttgaagattttacctttaacagggattgatttattgagacggaattttgctcttgttgcccaggctggagtgcagtggctcaatctcagcttaccgcactcaatctctgcctcctgggttcaagtgattctcctgcctcagcctcccaagtagctgggattacaggcatgtgccaccacacccagctaattttttgtatttagtagagacagggtttcaccatgttggtcaggccgggctggaactcctgacctcaggtgatccacccgcctcggcttcctgaagtgctgggattacaggcgtgagtcaccacgcccacccttaacagggattcttaaaaaaaatctacttctgttccctaaaattttctaaaaagtttatgttccatagaatgtgtcttataattctatttcatgtttaat

SEQ ID NO: 90739 - DNA, 1075 bp, Homo sapiens
ctaggcgacatagactccatctctacaaaatataaaaaaaatcagccaggtgtggtggcgtagtcccagctacttgggaggctgaggcaagaggatcacttgagcctgggatgttgaggctgtagggagctgtgaccatgccactgcattccagccccagtgacagaaggagaccctgtctcaaaaacaaaaaaaacacaaaaaccctgcccgactgggtcattaaagtatgtagatccctcagaaaaagattagccaggcgtggtagcaggcgcctgtaatctcagctagtcgggaggctgaggcaggagaattgcttgaacccgggaggtggaggttgcagtgagccaagattgtgccattgcattccagcctgggtgacagagcaatactgtgtttaaaaaaaaaaaaaatagctatatgatatttgacagttgaaatggtaagggctttttttcttgctgattaaaatatataaaatatacttgtcatcagggattttcttttgagttcttttgctggtttggaattatgctttttaagttcaaacgttatttactgctttgacataattttagtttgcattgactttttctttttaaggaatgggaatggaaggcataggatttggaataaataaaatgggaggtaagaaatttaaaatgaagtacaagcataatcacttttaggcatagttttctctctttcctcttttctttcttgtttaaaccctgcatgaaattctctttggtttcagtttgagtctagaaatgacttcctcctgcctgtccatccttccagcgggtgtcttggcttttggttctggctgtctcactaactagctctgtgaccttgggcagaccactccatctctatgcctctttttgcttgtctattcattgagggggttggatcagaccagctttttgaagatgggtgatttttaaacaagggtgctagcattttttttgtttttcaaaagcctttaaacttggtaagttcttggcagaagataccccagttgaaacatgtgatagaatttttctttccctgcttagtctaagcagtcttgttg

SEQ ID NO: 90740 - DNA, 1145 bp, Homo sapiens
tggtggtgcatgctgtaatcccagctattcaggtggctgaggcagaattgcttgaacctgggaggtagaggttgcagtgagccgagatgacaccactgcactctagcctgggcgacagagtgagactctgtctcaaaattaaaaaaaaaaaaaaggcatctttacttctgtaggaactttttcttgctaagagccttcagcttcttgccactctgcagcacctctcgcctaattccgctttttggagtggcacatgagtggcacagagaggtggatgtgggcttcttgcctttgaggtcacttcatgtggccacaggaaactgttcctgtcctgaccggcagggcgccacctctcccgctgcggttacaccttctttctgattgggactgtgcgatctctgtcccggaattccctcctgccgctgtgatcagacctacatgagtaaggtgatctcgtcaggttctcagagtggttgggttggtttttcaagattcaattcttgacctctttcccgtgtcctttgccatgagaggtgaaccattgtggtgctcctttccatagtgctttcctactcggtgccccttcctgtgcctaggcagtagatctttgcactcctttgtgcaaacagctgtacttgctgcttcaaaaatttggataggcctgtggtctttggccttcaaggatgaggtgtagctgaggcgatactaagggtggcttgggacatcgccagaggtctgtgcatccaagtggcctagtgaggacgctggtggagacgttggttgccagatgctgctcagggcattggctctgctagggggctcagcaggcttggcacaggcagcaggtgtgcgcagatagagcggctggcggcggtgggtgcaggtctctgtgaggcaggggaggagcatgggcagaacaggctccagttgtggtctgtggggaggcctgtgaatgccgatgggagaattccgccattctctgcaaatcagtggcatgttggttgaaagcttttgcagctgtcttgcaggtgtgttagttggaagcttgatctagttcaggggtgtgcacgggagaatatagtcatgggttctcagttggtttctgtttgggtcagtaaagccccttatccctcttttccacttat

SEQ ID NO: 90741 - DNA, 1505 bp, Homo sapiens
aagcttggaaaggtaatgctatgatagcatcagacaaaccttaaagaggtgtgggtgcaccgtgggcaagtgagcagcagcactgtgtttgggatacttggtggggggtgcaatttaggtattttcctgaaaccttatctgttgcctagtcacagcacacccagctcatttcaggcaaggctggcatgctcaaggatttccgcgcagagctcatttgttagcgttgaggttgtccgtggagctgcagctttaatttgctctatgataatgagaggtgcctctgggtggataaatgtgggctccaagtgggtgatgctgggcggtcttctgaacaagaagttggctggggtgggggtgggggcttactttccagctcaggggaggcaaggaagcctcagtcctgagagcctggaccagctttagaaaactgccgctgagcgagacccgatggccctcttcttgctctggctctcagttcatgaatgcatatgactcctatctctgctgggcgcattcgcaggtgaccccgcacgctgggcctcagactctggagctacgtggggtcttggcatcgtgacccagcatcaaggactctcctagttctctgtaaaatgatcttgtctgtgcgtgtgtttctcaaacccctttccctttatcttgtcatttttattagtagtatttctactctggaatctgtaatgagcacatttctattgccatagaggaatttggctaatttttttttcttcctgatttccttagaaatcctaagtaatgcactgaagagaggagagatcattgcaaagcagggaggaggtaggaaccgcttagtttgatgttttgtttttttagaacaggctgttatcgctggggactgtagagcttagtggtgagaagtgcgggttctgacacagactgcccggggtgggagcagctctgcctttttctagctgtgtgacgtttggcaagtcactgaacctctctgtttctcatagcactcatttgtaaaatgggggtgtaatagtacctgcctcagggatgctgtggagagtgaatgcatgtgaaagagtgcttccgcacgtgctgtgcacaggccgaccatcttcattgttagagtacctctcttttgggggttttgttttccacattataaattcctaaaagtaaatatattttccttagacttgatgataagactgaaagcacaccacccaacaagtaataaatgcttgtaaaatagataaatgtactcattaggaaaatatgaagaaagtatggtctgaaaccccatcgcccagtgatgactgccggaaacattttgttctgaatctttcattcatacacagctttatggatactgagaacaaaatgtactttttgagcatttttggagacagtctcgctctgtctcccaggctggagtgccgtggtgcagtctctgctcactgcggcctcaacttcccaggcctaagcgattctcccactttagcctcccaagtagctgg

SEQ ID NO: 90742 - DNA, 2360 bp, Homo sapiens
atcttggcatctcacctcctgacttctgtgttgggctggctctggagctccacgctggtaccatttcctcccatttctttttttttttttttttttgagagacggagtctcactctgtcgcccaggctagagtgcagtggcacgatctcggctcactgtgacctccgtctcctgggttcaagcgattctcctgcctcagcctcccaagtagctgggactacgggcgcacgccaccatacccagctaatttttgcaattttagtagagatggggtttcaccatgttggccaggctggtcgcgaactcctgaccttgttccgcccgccttggcctcccaaagtactgggattacaggcatgagccaccacacccagctgccccacctcatttctgatgcctttgggcaaagtgcccattctcgctaggttccttatactgtggggaagttctgagacgtctcccctctgaaagtcacacattcttagagtcgggcctgctttggccgctcactgtgtgctgtgcagctagagaagcaggcgcggtgtggccagttacagagccagttagagaaactgcccagtttcctcttgaattggtatctttgactaggctgcttgggtcggtcacaggctggctctgggctgatggccactctcagaggcaagcgacagggtttcggggaggagccccaaactcggcatgtggaaaggggtggccttgctgacggagccagaccctgctttccagagttgcaagcaccacgggtgggggcgtcccttcgttctgctgactgacccccagccgctaccagagcccactctgcagtgccatcaacatcttctttccaaagccagcaagtcatttggtttccctgacaatagggtccccaaaagtggccagctgtgtgcatttgtacacagaggatctctcggtgtgtgtttttttgacctctgcttgatggtgtggccgaaaatcctttctctgtgccctgggagcgctgaggaaatgcagccagagtggcccccagcagagcatcctagagggacaggctgggaggggaaggtgggagtgactccgacttgtctccacataactcctgttcattaccctgggtggccccccgagtggggggtgtccatgcctccccctggagcatttctcagtgtctgctgatggagaaacctcagatgtctcaggaattgacgtccatggttcacaaagcttgtcacagacactagcacctcacagacacacatacaggggtgttctttagaagttgtgttatggaaatctcagctgtggcatagagcagagagaatgctgggaggcccccatgtgcccaccacacagctgtagctgttgtcaacatttgaggggtgtcttaatggtaaattatggtgggcctttacccctgatccatgcccatgagctgaagtggtctggcgtgttgtgcacacgcacactcaagttcttgacacccacctgtgttttgtgtccctgtttcaggtggaggtggaggaagcgtccctgggatcgagaggatgggtcctggcattgaccgcctcgggggtgccggcatggagcgcatgggcgcgggcctgggccacggcatggatcgcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggcctgagcatggagcgcatggtgcccgcaggtatgggagctggcctggagcgcatgggccccgtgatggatcgcatggccaccggcctggagcgcatgggcgccaacaatctggagcggatgggcctggagcgcatgggcgccaacagcctcgagcgcatgggcctggagcgcatgggtgccaacagcctcgagcgcatgggccctgccatgggcccggccctgggcgctggcattgagcgcatgggcctggccatgggtggcggtggcggtgccagctttgaccgtgccatcgagatggagcgtggcaacttcggaggaagcttcgcaggttcctttggtggagctggaggccatgctcctggggtggccaggaaggcctgccagatatttgtgagaaatgtaagtggctcttggggaacttcttggtggtggtgagcatgaggggacagg

SEQ ID NO: 90743 - DNA, 3051 bp, Homo sapiens
agtgggacaagtaaggaatgtgagaactgtgggttctggaagagcctgggcttctccactgtgctagaatatggagcagacgctgagctcagagactccagtttctgattggttggcttgaagaggcactatgtgttgcacgatggtccagggaaagaagtggctgtaacggaattattttccccagctcagccacccttagccactatttagtgactgtgggctgcgcaccgcaggcctgagtgtcccatcctgcacggtgctcccacaggcagagccccagggagggagctggctgtgccgcttcacagccttgtcccacatgtatctattagtttcctgctgatcgcctcagtctgaagggcagccagcttctcggtatagtgagaaatctagcatggccctcagagccagctgcaaggcatgccttaggatttggtttaatcacgcatcagtctcccttttcttctccccttcagctgccattcgatttcacatggaagatgctaaaggacaaattcaacgagtgcggtaagtgttgggaacggctttgtaggtgcttccctcgtgcttgttggtgacgcagccgagtcagcagcaaaacctccctcccagccccctccgtcggctcaggacccatggccttgccatgttctgcccacgccaatgctcaggcaggttgttgagtgtcctgtgatgtgtcacatgtttttcagctgtgttctcatttcatccttacttccttttttctttttgagtctttgaaacaaggtagtagtgtccccatttcacagatgagtcaggcagagtcttccttctgaggttacctggcttctaggtggcaaggctaaataaatacatcccagacgaggtcgctttcccctcagcacagctggtgtggggcctcggagagaacacagcccagcaggtgccatggggaggcggtgcaggctctgggcacacagcagctcctgtgagggtgaggctaaggtcttgtggtttcctggcacatcgggcaactcttctggagggctctgtctgtggctgaaagcaagttgtcttccttccctgccctccagggtgagcccccaccccgcatgcaccacctctgttctttttagctagaggggcctgagctagaggtctgggcagctgcttccgcactgtcctcccgcttcctgtttcagcagtggctccgatttcaccaccattgctgcttctccatggttcttggggcaagccgttgagtcatgatctgcctctttgctccattcttcacctctttccccactcctgagttcccatgttgtagctagatattctgaaaaggccagtgggatcacagcgcccccagcccccacttttgcaatgcctggagcggccctgtgccttcaagaggaagtccagactcacaagccccttgaagacctggtcctatcctcctccatctccctcctgtcccagaacctgagcggcaagtgctgcacgtgtcccgcaatgctctcgtgtgagccaattactggcaagtcttctttctggtgaatttctgtgtaagctcactcagaacttgcccctgaggacccctccaccctacctgccctgggccctctcttaggcactgagttcccacctctggcattgtggccctaccacctttggtactcctggagtagagcctttgccctctagggctctgtccacggcgttgacacatatctggatgcttaacgggtgctcaaatgaataagtgaaacctgctggctttcatttggacagtacagacgtgtccattggattgcggatggctttgtaaccaggggcggtggcatatcaaaaatgaagactttgtaaaatgtatgggaactttctgcctataaagctggctttacactgcgccttcttttttgaacttcctgaagcgtaaaggcgtgcattgaatccgccaggaaggcttttcatggggcaggggcaggctctgttagcagaagaatggcagtgtggctgagggggccgtagtcattggttctcgccattgtattctgagcctttgtgctctaggcttcagggcctctcctttttgactctgtccaccaaaatctaacaaaatcgggactgagtgtcgtctcttcttccctccctgtcctaggccacgtgctgtacgccgacatcaagatggagaatgggaagtccaaggggtgtggcgtggttaagttcgagtcgccagaggtggccgagagagcctgccggatgatgaatggcatgaagctgagtggccgagagattgacgttcgaattgatagaaacgcttaagcagttgccttttttaaacatcgatacgagacctctgaatttgtattttttcttgttaaccattttaatttgttggctggatgtataaagatgtttaaaaaattcagttgctttttggggtaatttgaattacttttttaatgactggggttccatttgactgtttgcattgagattgcaatgtgcgcaattttttttgtagttgtggcatcttgttgacatcgaatatgactttgataataaataccggttcctgaaaacggcctgcttgtgtgtgctgtgtgggcaaccacgcgaggtgtggggagctggggtcactcgagcttccagtccaagcagcagggatctcatcccctctcttgcttgtctgaggccccaggggtgggtgcctgcccacagatggggggagactcttccctggaaactgccttcctgtgggctgtaatcccccggcttacaatggagcgtttggctgtttagagccttctgaggccaggcgcggtggttcatggctgtagtcccagctactcaggaggctgaggcaggagaatcactcgaacccaggaggcggaggttgcagtgagtgagatcgcgccactgcactccagcctgggcaacagagcaagactccgtctcaaaaaaaaaaaaaaaaaagccccccgaaagccatcctgtctccctgttgtgaagttaacgccctggggcacaggccctgcctgagtcaggcttgttctctggctt

SEQ ID NO: 90744 - DNA, 1087 bp, Homo sapiens
ctggtgcccctggaggcccagcccagcccagccctctgcccacctccaggtgtgagaactgcctcctgcgcttccgcacgcaccgctcgctcttcaagcacctgcatgtttgcgcggagcatgcgcagagcccagccccgccgccacccccggccctggaccgagagccgcccgcgccggagcgccccccggaggttgaccccgcatcagcgccgggcctgccgttcccgctgctggaacccttcacgacccccgcccctgcccccaccggaccgttcctgccctacttgaaccctgcgccctttggcctaagccccccgcgcctgcgccccttcctggccgctgcacccgggccgccggcttccagcgccgccgtctggaaaaagagccaaggtgagtgtggggtcgggggcctccaggagggctggctgggctcgccctgactctgaacttgacccgcccctttaccgcaggtgctggcagcagcccccgaagaccccagggcggctccgacgcgccctcaggtgcgtgcaggtgaccaccagggaggggtggaggggctttctttcctgcgccctgcggggtctggtggataccaggaggcagcagtgctcatccccttcccagggggcacaaatgccaccgtcccgaaatacaggatttttgccttaaaaatgactggcacctgcgccttcatctgcgccggcgttcccgtataaaccttgcgcccctttcaccgttcacctcggagcgggcttctccccaacagtgaatctggggatgatagtaggggacgcggagaagccaagttgggtgcccccaactctaggggcagacagacccgggagaaactgaactaggcgcccggaagctgatggggggcgggaaaaagtcccacccaccctcgccggcgtcctccatccttggcgcacgggtcttctgggctgggggagcccgggactgacggggtcccgcctgcccgcagggcacgcggccccgagccgcatcgtgtgggagcacacacgcggccgctactcgtgcatgcagtgcgccttctccacggcctcgcggcccgccatgaccctgc

SEQ ID NO: 90745 - DNA, 1635 bp, Homo sapiens
tagatagcaagattgcaccagcgtccgacctgagctccagggtgactctgccctcaggccccgccccctctccgagcgccctgcgcaggccccgcccccagtctcgcgagagctgagaggtggaaaatggcgctgacgtgagcgcgaactcgcactgcccagagggtggccgccgcctaagctgcagccgccggagccgcagaaacaagaggccgagccgtgtcgaagatggtgagcgcggcaccggggtcgcgggcgcggcggagctgcggggactggcggggagcggccctgtcgcgcctacagcctccggccgaccccgcccccacatccgggcacccgtccgccgctggctgtcactcggagagcgccctacttccgggcccggcccggaatggaccacgcccgtcaggctaggactccgcccctaaacttcttacatccgggcccccagcacctccaagattgtccacactgctcgaggccggccggtctcggtcctcagacaatccatgtctagctcctctagcatcttcccagtccatgcctgcccatagccccgcctccgtagccttggccccgcccactccctctaggccacgcttgtgtgcatactggggctcccacctatcctagttgaggagagcagatgtttctcccgtatgcataaggagctcaatccgggccagtgcagtggctgacgactctaatcccagcactttgggaggctgaggcaggaggatcacttgagaccaggggttcaagaccagtgagggcaacatggcgagaccccatctttataaaaagaaaaaaagagcttagtccacccttacgtattcccctatcctctcctgctggtgattccttaggatgggggccgactgggttgacccagagcccagaagggttctctccgcctcttccttccaccaggaggagaaaccctcagggcccatcccagacatgctggccactgcagagcccagctccagtgagaccgacaaggaggtgttgtccccggctgtgccagctgcagccccttcctcctccatgtcggaggagccaggccctgagcaggcagccacaccgccagtgtgggaacgtggaggggctggagggatgcagcagggctcctccccagccccagacagctgccagcctggccccggacccagccctggcctgaccagcatagtctccgggaccagcgaggacctgcggcctcccagacgacgcccacctccaggtgatctgtgatggggtcttctggggaatcacagtccctgaaacaatagaagcgagacgtagagaatctctaacctcagggcctttctagagggatgccactcatcattttacggagcagccggtggatgccaggctgtggctccaatggtgagcctggccagtccagcccctgcactgtggcagaccagtctgttgtggtaggcagagagtaaaggccccagcacatcatatttgcttctctggggcagaaccctggggtcagggacagcactagtgaggaagggaccagtgaccactgttctgtgcgtcctgcagggaagcaaatcccttgctccagccctggctgctgcctcagttttcccagcgtccgtgacctggcacagcatc

SEQ ID NO: 90746 - DNA, 1067 bp, Homo sapiens
gattctgtctcaaaaaagaaaaaaaatgcaagcaagcaagaaagattccatagcctggaaccagaaacccaggtgtgtcctgcccagctcaccctcagacctctaatgagggatccagtcctatcccagatgtgtctacacgcccagcccaggctaccttccaggcctagtctcacgcagaccaccacagcctcctccctggcctccctgcctctagcctccctcctccagcccatctttctctgagcaccccttttctgactccatccccccaagcctggcctccctccatctctcctctcctgcccccaggactgtccccctggctcccaggacttcagagaagtgcagtgttctgaatttgacagcatccctttccgtgggaaattctacaagtggaaaacgtaccggggaggtgagtgtgggactccaaaggctgtggggccgtgaagggcagccgtgggagtgtccagcagcaggtggatgaatgcagcatcccggggtctgccctgagccctgtccccacccggggagacagagtacctgggatacggtaccatgggggttcaacgtgacgctgggagcccccactccctctgcccaagctgcccttcctcttgggtctggggtctgtccctcttggcctcactcccccagggagcaagcaaagagttccggggtggcctggcccgtggtgtgacggggccgtgccccccagggggcgtgaaggcctgctcgctcacgtgcctagcggaaggcttcaacttctacacggagagggcggcagccgtggtggacgggacaccctgccgtccagacacggtggacatttgcgtcagtggcgaatgcaaggtggaggggactcccagggaggtggagaggggatggggagcgggggtgggttagggggtcgcctcactcacgccttctccacgcagcacgtgggctgcgaccgagtcctgggctccgacctgcgggaggacaagtgccgagtgtgtggcggtgacggcagtgcctgcgagaccatcgagggcgtcttcagcccagcctcacctggggccggtgag

SEQ ID NO: 90747 - DNA, 1024 bp, Homo sapiens
agcccgcggcccaggccgggcggcggcaggcgggcggggtttctggccgcgcgcagtttgggggtttttttataaccctggcaggcggctcaggaagtgccttccccgcgccccctcccctggccacgccgccgcgctcgctcgctccctcccttcctgcgcgcgcggggcggcgagacagcggcggcgacggcgcggaggccccgggcgcggcgcaggtagcggcgcgggcggggggcccgggggtgcgtgattcagtgggactttgtgtgtccgcatcgggctgtgagggcgtggggctgtggtgccctggatgggggagggcatcccgctgtgcgactccggtcggtgcctgaggtccgcaagtgcgcgcgccactgatcacgcccggggttgccgtgggtttgtttgcgctgtgtgtgtgtgtgtgtgtgtgtgtgtgtgtccgtccacgtaggggcagagtggttgtgcattacatgtgtgtgtcagtgcctggggatgagtctcttgtgtgtctgtgtgtttggacagtgtgtgcgcataggggtttgctatgtgcgcgcagatctggaggcgagtgtgtgtgtgtctgggtttgtgtgtgtgtccccaagcatgtgtgcgtttgtctctgaccgtgatgagtgtgtaaatacctgtgtgtgtgtgtctggtgtgggggggtgtctaggtctgtgggacttgtgagtttgtctctggtttggtgtgagcatgcaaatgagtgtgtatgtgtcagcgtgtaggcctgtgtgtctgtctccttgggttgtctgtgtatgtatgtgtgtgtttctgtttgtgtaggccccgggtgcgtgtatttgtgtgtccgcgtgtttctctgtcttgtcccgtgtgtgcgcgtgtaaatgagtgtgtgtttacacatgtctgggagtgtgtggttgtgtgtctccatgtgtttgtctccgggtgtgtgagtgtgcactgagcctgtcggcgtgtgtgtctgcggtggaggcgtcctgcgtcttttgtg

SEQ ID NO: 90748 - DNA, 1114 bp, Homo sapiens
ctgcccaatcagcctcgccctccaggcctggtacggcctcagccggttccccgccttcagccccgccccggaactgatctccgcccacaaccagccccgcccccaggcctcgtgcggctcacagcctggccccgcccccagggccaaccttacccccgctactgccccaggccagggcccaactttgtgcccactaagcaaactagaacacctctgcccaaggctggggttcgcggccgccgctcccgcccgccgcgcctgtcgcctaagcgccgaacccccaacacgctcgactctgcgaggctgcccgcgcgagccggaaggggacgtgcagcgcacctctccccagaccggaagcggaagcgcggggcggtaccgtgggaggggccgcgcgtggggcagcggggagcgagtccctccgtccccgcgagtcggcgcttttggccccgcgggaggggccgggctcggtgagcgactggcgggggctcgggtccgagtccagggggcgacgtgggccgcggacaccgccagccacgggccctgcgtccctccagggagccgtgtttcggttcatgaggcctcgggctgtgagcttaggtcagcacgaagctgctgcttgctcctgggtcggggccccgcgccgctgttgcctcctcagggaaccccagtcgccctcacccggggcgattccgcaccccaggggacttttggctgtagctggagacgactgtggttttcacaaattgtggggaggggaggctgctactgtcacctagagggtggaggccggggaagagggacgctgcttgctcttaaagatcctacgttgtacaggacagtcccccacaacaaagaattatcagtagtgccaggttgggaaaccctgctctagggccttaaaaaaaaaatctctgcagttctgaataaactacataaattgttaaaaattcagtttagtcacttaatagggcctctaagtgacaagatatttttaaagcctgtggagtcaccatagaatctctctccagcgtagtaagttgagcaagtcaaatgcacacagcgttaagctgctttctcccctcttacggagcagatggccagatgggaatcaggt

SEQ ID NO: 90749 - DNA, 1051 bp, Homo sapiens
taatgagtgagggggtttaacagagttgtacttggtggaaaatcacttaggaagagtaattctgaacccacttatagcagatcaggggctgtccccccaccacatcaccacattgctgagagagtttacctaagtaagataaaagtccaggatcaggcagatcttgctgctcaaaagaggaaatgccaaaaaacaaaactcagagttttctttggtgagcaggagagacagatagcctttcactactcccgatgttctttcatttgctacagatgccagcttggagagtcacgtgagagcaagagagtagctttctggttgtcctggtgccctgctcaggcaaactgactgccattctctgaggatggcagctctgtcccccacatttggtaagttcttgggtcagtgcgtgccctgagaaagtgagtgcaagtggcccctgccacttgatggggtgaaagatacgtacaccatagagggctgctgggagaggatgggcaagtggaaaaggggtgggaacagagccccagcagccaccccagtgactgtgtctgctgagggtcttggtgggtctgggagcaggccagtgtccttatcattcatgcatgaagagggtgcaggtaatgggtaaccctgagttatctcatttattattttgatcactttcagcaaggtcacaactctagctctcagaacttgcatttcttcactcctaggttggaactatgtcacttcttatgagtatgtagcccaccaccctctttatgtttttggtggaacagggctgctctgacttgttatgaaactgatgtgtgcaagagaggtggggggaggaagagagagagaggattgaggatgtgaacactcagaatcagtgtggagcagtttcctggtttacaagtgttgtattatgagacagggcaggctctgattctcatgaaccctgttttctcctccagccacgtccacccaggattccacctgtctccaggactcagaatttcctgtttcttcaaaagaccattcctgtccccagaatttggacctgttc

SEQ ID NO: 90750 - DNA, 1007 bp, Homo sapiens
cctcccagagtgctgggattacaggcgtgagccactgcaccaggcctgaattgacttaaatttctacccctggcattgccaaatatctcacatgaccagattttttaacaattgcttttgcaccacttttccttacatagccttaggatctgccaagaaatccacctgtcattgtcaccatcatcccaccattttccttttccaacaattaatacttttccaatttgtttcagattgggagactccatctaaaaccaagtggtcacttcttatggaagatatttttgggaaggaaacgcccagtggtgtgacgatggtaagatttccgtgggataattctggatcttccttccacgtctgaggagactggggcagcctaggttagaaaagcagttcaacaccagggcaagcagcttccctcagaggagactgtgtttcagagacactgggtattaccaagatggagacaaccctaaagctaacctcaagctactttacctagagtgtctctgagtgaagatttttatagctgtgtctcagatattgagtgttggggctcaatgcagtttttgttttattttatatttatgctgtacacttacttatcaatttagttttggtggtgtttattttttggggggcagacagtcttgctcttgttgcccagtgcagtgggcaacatcttggctcactgcaacctctgcctcccaggctcaagccatcctcccacctcagcctcctgagcagctgggactataggcgtgtgccaccacacttggctgatttttctattttttgcagagacaggatttcaccatgttgcccaggctggtcttgaactcctggagatccatcagcctcggtctcccaaagtgctgggattataggcttgagccaccatgcccagcctcaattcagtggtttttgtttgtttgtttttgttgttgtttttgttttttgtttttttttttgaggcacagtcttgctcttgtcacccaggctggagt

SEQ ID NO: 90751 - DNA, 1569 bp, Homo sapiens
tgatggagctcaaatggggcagggacagcacgtttgcacggcagatggttacagctctagtcatagtaatgtgcttctatctgttcatagcagtgtatgtggggatgacgcttagggttgcaatgaatatgagaattgcctttgtcagcacttacgtcttaaccaacaggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcg

SEQ ID NO: 90752 - DNA, 1138 bp, Homo sapiens
gcaggcagatcatgaggtcaggagttccagaccagcctgaacagtatggtggaaccctgtctctactaaaaatacaaaaattagctggctgtggtggcacacacctgtaatctcagctacttgagaggctgaggcaggagaaccgcttcaacctgggaggtagaggttgcagtgagccaagattgcaccactgcactctagcctgggcgacagagccagactctgtctcaaaaacaataacaataacaacaacaaacaacccaataacaacaaccaaaaatcccacatcaagcacattttttaaaagagaaaaagagccggatatttaaacccacaacatttgccttaggggtacgcagtgtgtcctcttagttctgaggccctgatttgtcatggacaagagtcggccctgctgaggagtctttccagggcccccttcacatccttgttcctcaggctgtagatgaaggggttcagcatgggggtgaccatggcgtacatcactgaggcggtggagctgctctgggaagaatgggtcacagcagaactcagatagaccccaagtcctgttccatagaacaaggagaccacacagaggtgagatccacaggtggaaaaggctttgtacttgcccttggtggaggacattcccattaaggaggagacaatctgagagtaggagaagaggatcccagctacaggaaacacacccagcagtgccgtggccacatacaagacaatgttattgaggagggtgttagagcaggccaccttgaggacctgagccggttcacagaagaaatgcggaatctcagtgcctgtggagaaggtcaacctcttcatcagtagaatatgaaccagggagaaccagaaaatgatgaaccaagatgccagaaccaggaggccacagaggcaggggttcatgatgaccgtgtagtgcagtgggtggcagatggccacaaaccggtcataggccatcacggccagtaggaaagtatccattccagcaaacatcattaaaaaatacacctgagtgaggcaccccatgtaggagatgtctttgctccgtgcctggatgctcactagcatcttggggactgtggtggagatgaaacagatgtcaacaaaggacaggttg

SEQ ID NO: 90753 - DNA, 1028 bp, Homo sapiens
atcgcttgaccccgagaggcggaggttgcagtgagccaagctcatgccactgcactctagcctgggatacagagtgaaacttgtcttaaaaaaaaaaagcccatgcgcgttcctcaggtcttgcaggcagcaggcgtgggtgaacgcttggcacttggtggagacagagaggccggcgggatatcagcagcgcagccggggtaccggaggtggtctcgggcgaggcgctccgggtctgaagggctccagccaaacggagctcgcagccaaacagtgctggtggctcctgagctgagtgaggcctaggcttggaggctgtgctcggagtaacgcaaaagagaatgaaagacgtagataatctcgaaagtataaaagactgggtttgtgaaacaggacctgacaatcaaggtcttggtgataatcaataaacaaattgtgaatagtttgttgatagcctttttgaggaagctcagaaggttggttccaaatgcttgtctcccacttaacaaaagaaacaggtagacgtaaacataaaattatggaaaaatggattcaccgtcaacaattatttcagaagttattcaaatggtgcaagtcagcagtttctgaactccatcaaaaagggggaattaccttcagaattacagggaatttttgataaagaggtgggtgttaaagttgaagacaagaaaaatgaaacatatatgtctacgaagcctgtcttccagctcttttcaggacagggtcaccaagtaggaagggtaagccatatcaaagacttcattgaaaactaccaaggatctcaaaagaagtcctcccctgtccctggcaacagtttgtcctatcctcagattgttagatgagacactcacactggaagaagcagatttacagagttttgttgtcagagactccaaaaaactgctgcaccattgatttttgatagactaagtggaaaatctgcagagaaatgatggttgtaagcagacatgcaaaccaaattggggactgggtaagtcagattcact

SEQ ID NO: 90754 - DNA, 1080 bp, Homo sapiens
atctacttggtgattctcaaaatgtggtgtcagatgaagagcatcaccagcactgttggagatgtatgttctcagtctccacctttgacatactcagtgagaaactgcaacagggcccctgtcatctgtgttttaacaagctctcatgaatctgatgtgctataatgttgaagaatgagatgtatagttgtttcccatgagaatgaagatctctttgtttcacttaacttcctatttggataaaagtcttagtgctttgtaagtgtgtacatcagcctggatttgggcttcagggatcagagatcaccaatcttttgggggcacagacagacgatatttgcatttttagcccttttaaaataatttcactgcttccattggaactatatctcctgagttgtggaaagatttatcatctcttgcatgagcctcttctggtaatgtatctttctttgtgcacaggatatcagctcttcaaacccagtctgatctcttggctggaacaagaagagtctaggacagtgcagagaggtgatttccaaggtgagtgttcacaaaggaccgccctggtcaataagttcagtatgtttataagtataatgaggaaacttttttttttttttgagatggagtctcactctgtcacccaggctggagtgccgtggcacagtctcagctcactgcaacctccgcctcgcaggtgcaagcgattctcctgcctcagccttctgatctcctgcctcagccccctgagtagctgggattacaggctcacgccaccatgcctggctaatttttgtatttttagtagaggcggggtttgaccgtgttggtcagtgtggtctcaaactcctgatctcatgatctgcccacctcggcctcccaaagtgctgggattacaggcgtgagccaccacgcttagccataatgaggaaactttttaagatgtgcttcatctcacagtgttgaggccattattttttttatttttatttttttctgagacacagtttcactgtcacccaggctgtagtgcagtggtgcgatctcggcttactgcaacttcagcctcccgggttc

SEQ ID NO: 90755 - DNA, 1798 bp, Homo sapiens
tcggctcactgcaacctccgcctcctgggttcaagcgattctcctgcctcagcctcccgagtagctgggattataggcacacaccactgcacctggctgattttttgtatttttagtagagacggggtttcaacattttggccaagctggtcttgaagtcctgacctcaggtaatctgcccgccttggcctcccaaagtggtagaattacaggtgtgagccatcgcgcctggccaagaaacccattttatgtaaggaatgaggaaaatccttttggaagtccatatgccttaatagtcacattgtaattcacactggtgagaaaacaatgtaagcactgtgtcaaagtgctcatttgtccctgttcacttcaaagataggaaagaacttacactctgatgatgctccataaagttaaaggcatgtgggagaaccgttggaatctgctgacaatacactgtgtaagagttcatcctgaagctgtacaatgttagaaacatagagagctggccaggcgcagtggctcatgcctataatctcagcactttggaaggctgaggcaggtggatcacgaggtcaagagatcgagactatccaggccatccaggccaacatggtgaaaccctgtctctactaaaaatacaaaaattagctgggcatggtggtacacccctgtaatcccagctactcaagagcctgaggcaggagagtcgcttcaaccagggaggcagaggttacagttagccaagatcatgccactgcactccagcctggcgactgagcgagactccatctcaaaaaaaaaaaaaaaaaaaatcaatagctttcactgtttccttgggttcttggaatggagataaaccctttttatgtaagatgtttgatgtaagatatgttcagaagttttattcttgccaaatactttggtgtttacctgtaattttatagtggagaaaaacttcatgaaggtaataaatgttggaaagtaattttttatattcttcgtcctttagtgaatatgaggggcattcacacttatgagaaactgggcatgtatggaatatcaggattgcttctctgaaacctgtcaaagcctggctttctgggtggttctatagaactattttggaagtttcttacaccccgctgctcattcctggcatggtatgtctttctcctatagcaacaccactctagttgctatacatcctctgggttacaactgacctaaagtgggccttcaggattcagacaatcctgttttaacagtgtagattctctttttggtttgtcatatttttagacatggtccacctgtagtggctcacactggccaaggtaaaagttataatacagctttaaaatgtaaaaatactcttgttcctcttttcaaacctgatcttttcagataaatggtcagggttgaagaagggtctgagtggagaaagggtgcactaacagatagtaacttaagataccgtgatttcatggccgtggagggacacccataacccttcacctggagaggtgggaactcttgtactatcaggcagtgcagagaggtggtgggaaccacgaatgttgtctttgatgccactgtttggcaaagcagtcatatatgcctgactcagttaactgctatgattggcagtatgacctatttctggggtttcattttgcccatgtgctatgaaaacagaaaaactcctgtgaacatggatgatcatgatattctgctgtgcttgacaccatcactagcacttcctgaacatggccctggaatacacacacacgcacaa

SEQ ID NO: 90756 - DNA, 1050 bp, Homo sapiens
acctcttctgcctgtcttcgtattcacatgcgaactcacacagaagagagactctatcaatgtaagaaatgtggtaaagctttcactaagtgctcatatcttaccaaacatttacgaacacacgctggagagaaaccctatgaatgtatgaaatgtgggaaagccttcactgagcgctcataccttactaaacatttacgaagacacagtggagagaagccatatgaatgtaagaaatgtggaaaagccttcacagaacgctcagatcttactaaacatttacgaagacacactggagataagccctatgaatataaggactgtgggaaagcctttgttgtctcctccagtctagttgatcatttaagaactcacactggatataaaccctataaatgtaatgcatgtgaaaaagcttacagtaggtcttgtgtactaactcaacacttaaaaactcatgcagcagagaagacctctgaatgtaacgcatgtggaaattcctttcgaaattccatgtgctttcatgatcgcttaaaaactctcaccaaaataaaaccctataaatgtaaggactgtgggaaagccttcacttgtcattcagatcttactaatcatgtgcgaattcacactggagagaagccctataaatgtaaggaatgtgggaaggccttccgtacatcctcaggacgtattcaacatttaagaactcatatgggagagaaaccctttgaatgtgaccagtgtgggaaagcctttgcttctttctcagctcgtattgcacatttgaaaacacactagagagaagccctgtggatgtgaagaatgtggaaaaacctttgctgtttcctcaagcctaactgaacatgtaaaaattcacaggagaaagtaacactatcaatgtaaggaatgtgagaaagcctgaacagttgaatctttctagatatgtacaaactcacactgtagagaaaccctgtaaatgtaagggatgtaggaaaacactagttcttctctctctctttttttttttttgatgagtctcactctgtcacc

SEQ ID NO: 90757 - DNA, 1043 bp, Homo sapiens
ttggctggaggaagaggaagagttgagcacactgccaagagttctccaaggtgagtgtttgtgaagaacaaccctggtccatgagaagttctcagtacgtttggaagcacaatgaagttttataagatgccctttgaatcagaaggctgtccactggacttggatgttttgggatatcttaacttttcatcctccattgctttgcatctatccagacttccctattacctaacaaatgaccttctttatgtttatggatttattgtatgcttttgttccaatttttccgacttttccttccctggtagtattgcttctgttaaccatcatgtttaattttcatagaataagttgttttaaaaattactaaaacttgaccccatatgattgccaaattttagacatatataaattgttcaaatctatctgctttttatttaacctaccatttcatgtgtaaactctcatgtatatttttctcttttatttcagaatggaaaatgtgcctgaaaaccaaagggccagccctttggcaagataatttttgtttaaaaacattaaatgggatacagttggtaagattaacaaaagaactttcttatttttcacattcagagaagactggtattgcattatagaaatcagcagaaatggccaggcacggtggctcatgcctctaatcccagcactttgggaggctgaggcaggcggatcatgaggtcaggagttcgagaccagcctggccaatatggtgaaaccccatctctactaaaaatacaaaaattagctgggcatagtggtgtgtacctgtagtcccagctacttgtgaggctgaggcagaagaattgtttgaacccaggaggtggaggttgcagtgagctgagatcgtgccactgcacactacagcctgggcaacagagcgtaaccccatctcaaaaaaaaaaaaaaaaaaaagaaatcagcagaaatgatagatatttgagagaagtggcattcacccaattcacccaaggggagaaatatctggagagagatcccatacc

SEQ ID NO: 90758 - DNA, 1034 bp, Homo sapiens
aggcatggtggtgcatggctgtagtcctagctactcaggaggctgaggcaggacgatcacttgagcccagtaagtcaaggctgcagtgagccatgatcacaccactgcagtccagcctacgtgacagagcaagaccctgcttcccaaaaaaaaaggctaatcattcatcgctgtttatcaagtatatgatgcagtgtactctgggatatcttttagtagagggaaataagttgagaaagcactcacagtctgcttgtgatgagaagttcatgattgagatgtgccattaaagccatacaactggaattgttaagtagtgaaagagcaaggatagagagaggaatacctgagatttacctgggattattaagctttgggtagataatgagagacctcacaactctttataggcattggggtctgttaactgattcttcagtgaacactggttaatctgttacttggctcaaatcaacatgtatgtgatggtttagtactccgtgacctttgaggatacagctgtggacttcacccaggaggagtggattttactggacccagttcagagaaacttatacagagatgtgatgctggagaattatgagaacgtggccaaagtaggtaagactgccatcattttatgcagcctcttagggaagagatatacattgtgtacttgctgtgttccagaattggtttgttcaacactgaattcaccagagacgttgtccctgccataataggtcttaattactgtggtcgttttcaaagtgtggtccagtttcgacagcatcactgttactcccttagaaatgtacagtcttagtctctgcctttgacctactgaatcagaaactctccacttggattgtcatctgtgtgttaactatccttccacatcaatttgatgcactataatattaagaatcactggtgtagttgtattctccaagtatacaagggtctctttgtttcactttttttcttttttttcttcattcaggagtttgacaacataccttatttctgtgact

SEQ ID NO: 90759 - DNA, 1310 bp, Homo sapiens
gaggcaggagaatggcatgaacctgggaggcacaggttgcagtgagccgagatcgcagccactgcattccagcctggacaacagagcgagactctgtctcaaaaacaaaactaaaaaaccctattttcacatacagtcacattgggatttggagcttcaacatatgaattttcagggttatcattcagtccaaagtacttaatatgattcttttccgtttccacatagacaatcacataatctgtaaataatgactcttacttttccactttagtcgttaggttatacctatatatatattttcttgctttactggactaatttcaacctccagcacaccaccaatgaatagcagtaataccagcataattgtctgcagttctgctgagatacgtgctctattttattggcttggctgtaggtttttattttattttttgaagaggctaatctcttacaggaaaggtttctttttatatccagtttttacatgatgaatgatttcccagtatttcataattcatgaggctgaattcctcttgaatttattaaatgcttcctgtgcatcctctgtgatgatcatgtttatttactgctagaactcaagtacctagaactgttcctggccaatgatggtatgtaataaatacttcaatgaaatgatgtggtgatgcatgtctatagttctagctacttgggaggatggcctgaacccaggggttctagaccagcttagacaacatagcaagaccacatctcaaaaaacaaaaaacaaaacgaatgaatgaatgcatggaaggactcatctctaaaataaatgtggtcaggttgggtgtggtggctcatgcctgtaataccagcactttgggaggcagggatgggcagatcacttgaggtcaggagttcgagaccagcctggccaacatggtgaagccccatctctactaaaaatacagaaattagctgggtgtggttgtgtgcacctggaattccagctacgcaggaggctgaagcaggagaatcgcttgaacctgggaggtggaggttgcattaagtgtagattgtgccactgcactccagccttggtgacagagtgagactccatcagaaataaaataaaataaatgtgtttttgtatttattacatttctagtgttacatcaaccttgcattcctggataagcccaactgagacataatggatcattttaaaagactatttgattacctttactaatatgttatggagctatgtttgaataactgcaatttttttttcttcttgtccctgaatgatttttttttttttt

SEQ ID NO: 90760 - DNA, 2907 bp, Homo sapiens
cagccaggagtttgaggttacagagagccatgatcacaccagtgcactatagtccaggcaatggagcaaaaccccaactctgaaaaaagtgaaacatactgggtgtggtgggtcatgcctgtaatatcaccactttgggaggccgaggcaggcagatcacctgagcttaggagtttgagaccagcctgggtaacttggcaaaaccttgtttctacaaaacagaaaaattagccaggtgcagtggtgcacacctgtattcctagctactcgggaggctgaggcaggagaatcagttgagcctgggaggtggaggttgccgttagctgagagtgtgccatgcactccagacagggagatagaacaagactttctctcaaaaagaaaaaaaaattaaatattaaaaagtaaaatcataattgtcatcaaaatgcttctgtgttcagatgggtgaaatctcttaatatgtctgaaaatgttttaaaacctttatctcgtcatcaacagacaagaggctacagtggatggaaactctgtgactgtaagaattgtggagaggtcttcagggaacagttttgccttaagacacacatgagagttcagaatggagggaatacttctgagggtaattgttatggaaaagacaccctcagtgtgcacaaggaagcctctactggacaggaactttccaaatttaatccatgtggaaaagtctttactctaactccaggtcttgctgtacatcttgaagttctcaatgcaagacaaccctacaaatgtaaggaatgtggaaaaggctttaagtattttgcaagccttgataatcatatgggaatccacactgatgagaaactctgtgaatttcaggaatatgggagagctgtcacagcttcttcacacctaaagcagtgtgtagcagttcatacaggaaagaaatccaaaaagactaagaaatgtgggaaatccttcactaatttttctcaactttatgcacctgtgaaaactcataaaggagagaagtcctttgaatgtaaagaatgtggaagatcctttagaaattcctcatgccttaatgatcacattcaaattcacactggaataaaaccacacaagtgtacttactgtgggaaagccttcactagatcaactcaacttactgaacatgtaagaactcacactggaataaaaccctatgaatgtaaggaatgtggccaagcctttgctcagtactcgggcctttctatacacatacgaagtcacagtggaaagaaaccctatcagtgtaaggaatgtgggaaagccttcactacatccacaagtcttattcagcatacaagaattcacacaggagagaagccttatgaatgtgttgaatgtgggaagaccttcattacttcttcccgtcgtagtaaacatttgaaaactcatagtggagaaaagccctttgtatgcaagatatgtgggaaagcatttctatattcctcacgccttaatgttcacctgcgaactcataccggagagaaacccttcgtatgtaaagaatgtgggaaagcatttgctgtttcctcacgcctaagtagacatgaaagaattcacactggggagaaaccctatgaatgcaaggatatgagtgttaccatttagcccatcggttgccatctttaattattggcaatgacaccaaagattatcagatttgtcctaaatgccttttggaggttgtaatgactcatggattggccttagataccatcctgagggtctgaaattaaacctacaggttctgaatacaacatcatggttgcctgagtctgggcatctgtgaagaagggtcatggatggtgaggtcagtactgcaggctgcctcaccttggtgattagattcctaagatcatagcattaacaagttgtgtatgagataaatcatgcagattgaccccagcccctgttggttagtggctgccagtgtggcacatttatgtcaaaatttaccagaagccaagatgatgtaggaccccaaaggtgggttgttaagagatgctcctccaagggtctcttctgatcccacggatcctgcagagcgtgtcaggaatgaaaccatccataactgccagtgccctttcacagctgattatttctgtgtccccttgtaaaatctaagaagtgtgacagccttgcctgttctgccttgtatgtctattttagatggcacaatgtaagtggcaatgtctcttctagtataatccagtctctcttctcacttctgtcaaggtggctgatatagtccatgaatcccactcatgatctctttatcagatgatcgttcagccacactttgaggattctcttcagtacaagttttctaatttttgcattatggataggctgagaattttccaaatctccaagttctggttcctttttccttaacaattttttctgcaattcaggtctccttttgcatttttgctgagaccagctgggtcatggagaccctgacccagcagctctagaggaattaagacaaagacacagaaatagagtgcagagtgggaatcggggctcacagccttcagagctgagagccttgaacagagtttgacccacatatttattgacagtaagcctgtgataaacattatttctatagattatagattagctaaaagtattccttacaagaaagaaagggacaggctctggcttgttatctgcaacaggaacatgtccttaaggcacaaatcactcatggtattgtttgtggtttaggaatgcctgagcagttttccagttttccaccgtgggtgggccaggtgttccttgccctcattcgggtaaaccagcaacctccagcatgggtgtcatagccatcacgagcatgtcacagtgccgcagagattttgtttatgg

SEQ ID NO: 90761 - DNA, 1027 bp, Homo sapiens
taataataataatgagtgatgatacgcacctatggtcccagctattcaggaggctgaagtgggaggatcacttgagcccgggaagtctaggctacagagagttgtgttagtgccattggatttcaacctgggcaacagagtgagaccctgtctcgatagatagatagatagatagataggatagatatagatagatagatatagatagatatatagatagatagatatagatagataaatatagatagatatagatagatagaggtaatgatagctactgggaaggatggctatgataattaactgagcatgtatatataaagctactagagctacttctgacatatcagtcctcagtaaatgtcagttactgttattaatacttttgttactgagtgacggtactgagtgggcaatttttggtggccttcacatctgtcacctgcagagacaaagctcaggcataatgtttgatgactgatgtttcatgcttgttgtttgatgattgatatgaacaggaccgcaaataaccctgtacaaagaggaatggagattgcctctatccacctagattcataagctggcctgaggtgatcttggcatcaaggaagggatgcacatcatcacaccatcagcttcagagaatggcagccatttatttgtcccgtggtaagtctttgttgatgctctttttcagagattctgctttaggtcaccctccacaacacaagcgtccagtgagctgagcctgagcaggcatgcagctggttcttttaggaggaattgaagtgaaccacagaacagaatgctgttttattatttatttatttatttatttatttttgagacagaatcttgttccgtcacccaggctggagtgcagtggtgcaatcttagctcactgcaaccttcacctcccaggttcaagtgattctcttgcctcagcctcccaagtatctgggaccacaagcacatactgccagacctggctaatttttgtttgtttgtttgtttttgtttttgagac

SEQ ID NO: 90762 - DNA, 1032 bp, Homo sapiens
ggtttcgcctttatggtggtggagtctgcccaggctgtggtgagttccacctccttggcggtcccggggatagcagggggcggcaaaggaatgattgcgcgctgtcgcctaggagcctctcagatccgcttcacttcactcgcttctccagggactatcagtcctccctgtgcgtccagttcggagaggctgcgcgctctctcggctcactgcaacctctgcaacctctgcctccagggtcaagcagttctcctgcctcagccttccgagtacctgggattacaggcaagtgccaccacgcccggctactttttctatctttagtagagatggttttgccatgttggccaggctggtcttgaactcctgaccttaggtgatctgtctgcctcggtcccccaaagtgctgggattataggtgtgagccactgcacccggccgacttttgaaaattttagattttgttcttaagtcatcttaggtacgtaatgaagttatcaataacacacgtggctggtgactactgaattgttctgtgcaggtctgcactgtcttctggtcatatggcgggggggtaacaccatatacaggagatcaggctctagggacaagtatcagaccgactactagggttgtttgagtgtaggtttttttcagtattaaatagaagtaatgggccaggcatcgtggcttatgcttattatcccagcactttgggaggccaagtcaggaggattgtttgagcccaggagtttgagactagcctaggcaatctggtgaaaacttgtctctactaaaactacaaaaaattagccggacccagtggtgtgcacctgtagtcccagctagttggggggctgaagtgggagaatcacttaaggccaggagttcaagaccagcctggccaatatggcgaaactgcgtctctactaaaaatgcaaaaattagccaggcatggtagtgcatacctgaaatcccagctactcgggaggctgaggcctgataatcgcttgcacctgggaggcagaggtt

SEQ ID NO: 90763 - DNA, 1358 bp, Homo sapiens
cgggcgcctgtaatcccagccgcttgggaggctgaggcaggagaattgcttgaatctgggaggcgaaggttgcagtgagttgagttcttgccactgcactccagcctgggtgacaagagcaaaactccatctcataaaaaaaaaaaaaaaaagacaactaaggcttgcataagtattttgagaatattcttctaggcatgtttttatttccaaatgtgtagcaaaaatttatactttttatatttttcatttttgctggttgtataacttcagtctccttttgcattctggaataacttattaattgtgcattctttccctttgcttgtgttaatcttggtagagagtacccaggtttatgaattctttcagatatttcgcttgaaaaatctacactatttcttgcatgttttctgttccactaattctgttagatatttatatagttacatcagcttgattttcctctacttcttagtctttctgtatgctttttaaaaaaatgtgtctttttatacatactttagctggagttttaaaaaatctgtataccgctgggcatagtggctgatgtctgtaatcacagcactttgggaggccaaggcaggtgatcacctgaggtcgggagttcgagaccagcctgaccaacactgagaaaccccatctctactaaaaatacaaaattagctgtgcctagtggtgcatgcctgtaatgccagctacttgggaggctgaggcaggagaatcatttgaacccgggaggcagaggttgcagtgagccgagatcacgccattgcactgcagcctgggcaacaagagtgaaactctgtcacaaaaaaaaaaaaaaaaagaaaaaatacttgaataataccaattaacaatccttttatgttgcacatttagtgcctgacatttaattagtaataatttggattaatttctagcatctaattttttttgtttgtttcattgtgttcccctctttgtactgatgtgtattgatcatacctttaatttattttattcttgatgtttgaaatttgtatgttacttttcgttgttaccataaataacaattttaaatataagtcttccttaataccttttctttctaactaagtgcactacactgtttgaataaagtgattcccatatacacttactacacttggagagagacccagaaggaagtgcattgtcacacaagctattagacagatctggtggcagaaagaataggctccttgacagaggcccagtgacaccctgtggtagattacagatgtcttgagattactctctgaaggtgcaatctctctcctttttatgtgagccagtccttgctttgaccagtagaa

SEQ ID NO: 90764 - DNA, 1019 bp, Homo sapiens
caaataaatgtttcattacaatttttttttttaaattgagacagagtctccctctgttgcccaggctggagtgcagttgtgccatctctgctcactgcaacctccgcctctcagattcaagcaagtctcatgtctcagcctcccaagtagctgagattacaggcatgcgccaccacgcctggctagagatgggggtttcatcctgttggcctggctggtcttgaactcctgacctcaggtgatccacctgcctcagcctcccaaagtgctgggattacaagggtgagccactgcgcttgacttattattacaaattgatgagagttttggaagtagaggacagtattgttttctatgtgtatatatgggaatagatgaatgtaagaaaagtgagttctatttaaggtgagaccaaaaagatggtgtctaaataagccatattgaaaggaaagggagtaggagttaaggaaagcatcatataaattggctgattacatatctacggagagaggtgagtacatcaagggtttttcttaggtttgatagaattttctttggggattaaaatgagggatgaatctaatctacaacattataactacagaaaaaatgatgtctaatcatcactttattctactcatgaaaaactaattttcttaagtaggaaattaattgaaagaatcagaatcagtggctggctgagcacttgaaaataagttctacatgaaaattcacttaattaccaatcttagcaaatatgtgttcatatatggaggggcaaggctctccgtggtattcagttcaactttgggttcttcctacccaaagtaggactccatttcccagaagaaatgtacagagttaccagtcccgtgtgagactcctatgtcaccgacacatctactcactccatgggtaaatgaaatcagaagactctcttgctgacatgggctgccagaaagctctgaaggaaacatgaggcttaaaaatacccacattgggccgggcacggtggctca

SEQ ID NO: 90765 - DNA, 1015 bp, Homo sapiens
tgccccaaagagtctatggactggtggatgtaactactccacctgcccttgggacccatcccagttttcatcattgagccccagaccctctgagcagcaccttgaagagggcagataatcagacttgaggaaactgaaagccccaggttgagagaacagaggcctagggacctccagaccattggaatcactgtttgccagctgtgtggccttggtcatatcatcagcctctgggaagcctagttcccacatctggaaataaggatgatcatagctacctcacggttacattgcaaagccttactctaaaagctcccagcctccagaggctctcaatgaagagtcaccttcatggtcgtcttcaggaacaggacggatgaagaaggggtggggttaagactcaggggcacctgagggtctgagcccccttatgagtacccaagaaggactgtctatgcatgcacacccacaagcctatacaccatttatatacctacacgcacgcaagagacgcggagagataggcgatgcagactcgcgattcaatgatcgatatgctcataaaagtgctcaattatattttctgtattttgtatgctgtattttccaagacgtatattattttactattaaagaaaaaaatcatttttttttcccgagaagtattcagtttattcattcaaccaatctttcttgagcttctgctattttgcaggcactgttctaggttctgggaaactgggccaccacagtgaacaaaactgacaagaccctgccctcgtagatctcatagaggagaagacaggacaacaaacaggtaagccagtccatgctttagtttttttgtgtggggacagagtctcactctgtcacccaggctggagtgcagtggtgcgatcttggctcactgcaacctccgtctcccgggttcaagtgattctcctgcctcagcctcccaagtagctgggattacaggcacccgccaccacgcccagctaatttttgtatctttagt

SEQ ID NO: 90766 - DNA, 1050 bp, Homo sapiens
tcaatcgcatgctccttgttctgcagcttggtgcggatggacatgataacttggccaatgtcaaccctggccacagtgccctggggctttccaaaggcacctcacatgcctgtttggagcctacattgtggtagtgcaaggttagaaacatgaacatccatcggaaaggcctgtctccaaggtcccttagagcaacccatacaaccaacaggctgcgtacactaccaaggaagctgctgtgtgcagccattgcacacacacatttttatagtttcttggtggacttgccaattcagaaaatatctgtagtatcaatgaaagtgaaaaattcaacaggtcctttggccacgatattccagtaatacaaatttatccttgtgcatagacatcaagaagcatcattaagtaaaaaaatagagttctctgactctctaccaagccattcgctcggggccagacccacaggcctcgccccgcctcaaccacgccttcatggcgtagtcttctccctgtctccgtcccccgctccccaccttccgagcgtctccatcgctccccagccacgcccttggcgcctggtcctgctgcagcctggtttccgtccagaccacgacctctcggctaggtcctcgtcgtcaaccccgcccccaaggtctcgccccgccccagccccgccttccagcggttgtccgagcctctacccgccctagccacgcctccaaggcgtggttctcgtctgcagccccacctaggcctcgccccgctccagccgcgccttccgggcttgatcctcgccccaccccagccacgccttctggacttggtcctcgtctctagccccgccccctagccgcgccccagccccgccttctggacttggttccgttctctggctccgcccctgagcctcgcccaactccagcgacgccttccgggcttgggcctcgcctctagccccgtccccgggtctcgcccctccccagccacgccttccggacttggtccccgtctctagccccgcctccgatcctcgccccaccccagccacgc

SEQ ID NO: 90767 - DNA, 1045 bp, Homo sapiens
ccccggggttcgcggccctgggacaggggacttggggcctgggagtattcgagtccggggggttgggggcagaacggaaggctcagtaacctggaattttagggcctgggactgggagacttgtaggctggggcttctgggcctgggagacgcctgaagctctgactttgctgcctcccacccaccccccgctttgtgtagctccagctaggatgatcgaggttgtttgcaacgaccgtctggggaagaaggtccgcgttaaatgcaagtatccactggcagccgagaggcagtggtacccgcaggggtgcttggcgtgaggcaggcaactcaatctgtgttgtcggatggttttagttaaacccgggagagggggcggatggggtcctggcagatggtattctgccctagaatgtcctcttcctcgttctaccgcttccatttgccttaactgctctgcgcccagcacggatgataccatcggggaccttaagaagctgattgcagcccaaactggtacccgttggaacaagattgtcctgaagaagtggtgagtgcagcggtagagccactgggtggactggactaggccggaaggttttggttgggggagcgctgcaggcagccctttgcttaggcttggctacctcatttggcctacagactgaagagcctccttagccttatctctgaaatgtctctttttcttaggtacacgatttttaaggaccacgtgtctctgggggactgtatcctttgtgtgactttttgaggaagcatctacatacccagcctcggttatctgttcaaaactaaagtctgcatgagcttatgcatattaagtgtttaacttaatacgtggcacatggtgagcacttagaaaatgggagctaggtaattatttggttggggaggagagtggttggtgaaatagtttgacttcaagttcaaaatatttattactgacctccacctgagtgctggacagtaggtcagggtggggtgagactcaggcatatctattgtgcaaaaggagcagaaactt

SEQ ID NO: 90768 - DNA, 1057 bp, Homo sapiens
cagacgatggcccctgtgcttaggcccgatttaagggttagccacaatgataatattgccagtaacagggcatgtttttctctgtgtcaagcgctttaagttctctctgaattgccgcaactctgggagccaggtagttattacttccaccttaccagcaaggaaactgaggtcagaaaactgaaggaactcgtccaagatcattcatttcaggggccgggggttggattaggacctaggcagtttgcctacaaatccccctccccgtgtcactgcaaactcctgaggagcaggcccagcatctgtgggcaggtcccgagtcactctgctgcctctagagcccatagcaatcgcatttgcaataataattctccttggttgagtgccaggttctggtgaactgtttggatacatggactctcctcattaaccccatgaggtttgatctccttattctctattccccatttttcagatgagaaaactgaggtgcagggagattagagcccattgccaaggttttagagtgagtcagtagctcagctgcatttgcacctggaacccgcgctctcgcccaccctgctctagccctggcctgtggctgggacctccagcataaaccggatgctctgcccagctctgggcccatttctgctgtttctgctcagttcaaccctgatggcttcctttatgggtgacactccatgtcacccaggcgaactgtcagcctttggagtggcacccagtagggtctttacttccagtttcttgttcacagtcttcactccttcatacccctcactccctgggtaacatcgggccaccagtaatgctggttcctagctctgcaacaccatgcacggtgtagtagctaagagcagagctttcgggtgtgaagtacctgagtacagttcctgccttcccctgtgtgtgcctggaacagagtaaacactcaggaagcgttacccactgctgccattcccagagatgcaaaaggtgaggtctccgttttgccatctatacaatagagataataaaggctatcccactcttaatg

SEQ ID NO: 90769 - DNA, 1563 bp, Homo sapiens
cccaggtgctggaggcagactcgagggccgaattgtttctagttaggccacgctcctctgttcagtcgcaaaggtgaacactcatgcggcccagccatgggccctctgagcaactgtgcagcaccctttcacccccaattaaacccagaaccactgctctgctctcctgtgtctcatttctcctcagggaagcatagtggggaagatgtcgtggggaggggatcatagcccccccatcctaagggtcccagctgcaagttctcccccgaggcttccccttgccctgggccagggggagtcacagcagctggctcttggggacatgggcactgtccagctgcccagcaccctgagatctgcttccctgccatctcaggggcttccagaaggttcgtgggtccaacccggcacctggcccagcacccattgcagctgcagttaccatgacaacagggccctcccggactggagggggctcctgcagggagggggatgggagcagacatggcttttagtgcctgaaggtggagcagagggaatcctggggtgggtggcggggagatggggtcccccgccagtgtgggggctgtggatgtggcatgcctgacccccatcccctgttcagtcggggggctgtgggtctgatggagaagtggttattcctgcatgccctgttccccctccacttgatggggaccagcccagattgcgggggtgcctggctggcagagcttagggacctgagcaactaaagcccggccccaggggacctcccctcccccaagcgctgagtttctaataaaggccaagcctcataaacaatcacctgtgcccgctcccatctggctggcttcgggagcaatcgctcattcgcctgctgcctgcctgccggagcatttgtcattaggaaggtttaatgggtttcctctcagctccagagggctggggagagccggctgcatggatacaccgccaggcagaatgttctcccatcgcctggtggaggggggttgggagtgaggcagccatgccaccattcacaccaacagttggatgtggggttggggaagtgactgcacccctcctggaacagtagaggccctgggtctggaaggatcggaaattagtggctggggcccagagggtttgctgagttccactccagggtgaagaatgggctttgtgtcctgaccatcagcagcagggcccagggaaggctgtgcatcgttctgtgtgggagccgctgcccccacccgtgtgtatgtgtgtctgcgtttgcccaagaatgtgtggggccatgtgactggtcgtctctctgtcctgtgcattttgggagtcctccggttctgagagtcctccggttctgagtgtgaccacctgcccctccaggtacccccttcccttgtctgtctgtgcagtggccaaaacccaaatgagaatgtcgctgttaggtaaacatgcctccagagcccacttcggggccggtgattcattattaagcagctgcgcattccctcacctcccacccaccccctcaccccctcctgtctagaaccagggcat

SEQ ID NO: 90770 - DNA, 1039 bp, Homo sapiens
ggccatcacccgttgctgcaggtcctcatacccgtaggcacccatctcctcctgaatggccgccagactgccggagagattcctcacctcctcccgcaagcgtacaatggtccgcgtgtctgccttgtactgctccaggaccgagctcaggggcaacagttccgtcatcctgtccttcagctcctgtgcatcaagatggaaccatggccaagcctgacccctggcctttgacccagacatgactccaacctctgactcataacttcaccctttgtctttgatgcacacctggcccttgacatgtggctcatattggaccctagattcttcccagacatgactccattgtaggaactaatggataccaaatcccagtcatttgtttgacctctggtctggacacaggaggacccacctggaagctcttggccgagagggacccatcagctgcccggagccgcgcatccaggctccgcatgagggtctccatgccgcgtacatactggaggtcgcgatacgtccgcaactcaaggacctccatggactgggagacgttctggacctaggaatggggacaactgaagggaccagacctccttccccaaatcccaacccagagatgccacagacaagagctggcaggaacagaggctgtacaaacaccacaccgacgaggccaccttctcctcccctgagcttaccagcagcctcccaattgcgtgcccaatccatccatccatcgctccctccctactacccactggctcccatctggtccacctaccaccacctctcacctcctccctagtctcccagttccaccttcatcccctgtagtcaattctctacacagcagacagaaggaactttcaaaacagagattagatcaccttcctcctccacagatcctgtgctggctggtcctgcccaccccccccgcccaacccacttcctctctctttgttctcacagactctaagctccttccttctgcagggtctttgcacttgctggtctctctacctggagtgctgttccc

SEQ ID NO: 90771 - DNA, 1021 bp, Homo sapiens
cttccaggcaaaaccccagttctcaggctgagggaggccccaggcggttcccaggcttccagcatggcgcgggtgaactaatatttttttttttttcttttgagacagggtctcgctctgtcacccaggttggagtgcagtggcgtgatctcggctcactgcaacctctgcctcccaggctcaggcgatcctcccacctcagccttctgagtagctgggaccacaggctcgtgccaccatgcctggctaaattattttgtatttttggtagagacagggtcttaccatattgcccaggctggtcccgaactcctaagctcaagccatctgcctgccttggcctcccgaagtgctgggaatgcaagcatgagccacagcgcctggctgatatcttctttaaggcctgtcaagcttatcactcaggggatatttgcccaatacctcaaggtttgacaagagcaggctgctattatctcaagctttccaaagggacgtggccccctgtcacggctcagacatagcagacaggcacattctccatcattcatcacggccctcctgccattctcgcagtcagagagaagccacagcctctgcctagcctactgggcacctgtctgcagcctaatctcaggtgatccttccctaggacgaacaacagaagcaagctccgtggcagaaaggagaaattcacggtagacctgtgaaggtgtttgctctctgtcccactggttcatcagcatcctcattcaacaaacataccttgtgccaggttctgaggatcacggatgaattgtttgcacagcaaacaaaactccccgctcccctgtggtttcctttcccagggtagaggcaggcctggagccagcattcccacccgtgaggccctcctaatggcgactgtgatcagggcttggaggaggacaggagaggtgccgcaagccagtgtagactgtgtaaccagatggcctgtgttcgaattccagctacatcacttacaggcagtgatgctttggcaaag

SEQ ID NO: 90772 - DNA, 1003 bp, Homo sapiens
cagggtttcacaatattgttcaggctggtctcgaactcctgacctcaagtgatccgcctcagcctcccaaggtgctgggattacaggcatgagtcactgcacccggcccacattgtttctgttcctaatttctctagtaatttctatgagaaagacactgatagaggcactcactcactcaggagggacgtgacacagtccgctctgaatggctgtcagttgccaaatttgggagacagatgcagccgacacatggtacaaagtgccagatgtcaagagtcaagtgggcttcctgggggaggtggcatttgagatgggccttgaaggatgagcgagtgaagactggagggtggacacagaagaaagtcattggtcatgctgacaagacctggtgggtttacccttattttacatgattctaaccatgtttaaaagaggggaagtttctggaaatgggaactagggtaagtgtgtggttgatgcctatggtgggtgcagataggagaagggaagtgagcttgaaaaggttgtgatctgactgtaaaggcttcgaaagctgggttaaggattttagaatttatttattcatttatttatttatatttttttcgagacagagcctcgctctgtcgcccaggctggagtgcagtggtgcgatctcagctcactgcaaccctcccctcccaggttcaagcaattctcctacctcagcctcccaaggaactgggttaacaggcgcgtgctaccacgcctggctaatttttgtatttttagtagagacaggatttcaccatgttggccaggctggtctcaaactcctgacctcgtgatctgcctgcctcggcctcctaaagtgctgggattacaggcgtcagccaccgtgctggaccttatttatttatttttagagatagagtcttgctctgttgcccaggctggagtgcagtgacgcgatcacagctcactgcagcctcaaactcctgtgctcaggcaatcctcccac

SEQ ID NO: 90773 - DNA, 1065 bp, Homo sapiens
tctcagaaaaaaaaaaaaaagaaagaaagaaagaagaaaaaataaaaagaaatcttctccaggactatcgcaggggttgaaatgagccccctgctgggcctggcttggggcagaccactctgccttagaacggctgtggttctgagccaagttccggccgcatggccttagatcagggccctgctccttcctgctttggtaaggctgggaagcgttcctgggtctccttgtcccgccagctcatgcctcaattcccaggcccctaataggaaccacatgcgctggatgcctgccctcctcccccttccctcctcctcccccagagaggcctcctgagtcatcctctccacctcactccctccttgcagcctcattcccacgctgccctggcctggcgtcctcgtgtcagagggctgtgtcgtgggtccccgcgggtctgtttgtgtgtgaactctgcctctactgtgcctttgtgggcgtgactccgtgtctgagttatggatcagacactgtgagcgtgctctgtacaaattccatgcttctgtttgcgtgtctgtgcaagagtgtgttggcatgtgaactgtctgcctgttttatgtgattgtattgtgagtgtttgagtaaacggatgtataaatatgtctatgctggagacctgtgtgtgagctgtgtgtctgaattgtgggttttgtggagttgtgtgtgtgtctattttctttctctctctctctttccttccttccttccttccttccttccctccctccctcccttccttccttccttctttccttcctcccttccttcctctttttctgctgctttctttccttccttccttccttcttgctttcttctttctttctttctttctttctttctttctttctttctttctttctttctttctctctctctctctctctctttctttctttccctctctctttctctctttcgtcttattctgtcacccaggctggagtgcagtgatctcagcttactgcaacctccatctctcggtttcaagcaattctcctgcctcagcctcccgagtagctggga

SEQ ID NO: 90774 - DNA, 1052 bp, Homo sapiens
gttctcctacgtggacgccgacgggtccccagtgaatgtcgtgcagctgaacttcctgaaactgctgagtgccacagctcgccagaacttcacctactcctgccagaatgcagctgcctggctggacgaagccacgggtgactacagccactccgcccgcttccttggcaccaatggagaggagctgtctttcaaccagacgacagcagccactgtcagcgtcccccaggatggctgccgggtaagagggtggggcagtggccagctagagaggggaggcaagatgtcggccaccttcccggtaactcaccgtctctgtcttctctggggacagctccggaaaggacagacgaagacccttttcgaattcagctcttctcgagcgggatttctgcccctgtgggatgtggcggccactgactttggccagacgaaccaaaagtttgggtttgaactgggccccgtctgcttcagcagctgagagtgtccggggtgggagggaccatgagggagccccagaatggggtgcatttggtgctgaggctttgaagccaccgtatttttcgttacctgtgactatggagccaatgggatgtgacttcgctcatcacggacagtcattccttctcctttccagggtgctgggggctggggttccctggcccaagggtccagcctcctctcaccccattccaggtggcatactgcagtctggctctttctcccctccctccccacccaagcctcacctccccaccccttgaacccccatgcaatgagcttctaactcagagctgatgaacaaaagcccccccacccccaatgcctgcctcctcactcctccgtcgctgcccttcacaccttttggtgctacccctccccagagttaagcactggatgtctcctgatcccaggctgggacccctacccccaccccctttgatcctttctacttccacggtgaaaggactgaggtcggactacagagggaagagggacttcccttgactgggttgtgtttcttttcctgcctcagcccagctctgcaaatc

SEQ ID NO: 90775 - DNA, 1687 bp, Homo sapiens
gggttcattctccaagtgacttctccctacaggggtccatgggcccccgtggagacactggacctgcaggcccaccaggccccccggtgagttccccggggggcgggggaatggacaccaaaacctggggggagagcaaggactatgtctgggtgtccccagagggtccttccgtgcgcagcactgggccaggcacacactaggtgttcagaggatgtaggtgaagagggtagttccctgtaaaaccccaaggaaggtctggcctgggaggggggacttggggggacacccatgggggctctgacctgggtcttgtctcttggaccccatctctccctccctgtctctgtccatctcccttatctgtctctgtctatactggcgccactatttcatcttctgtctctctccctgctctctctccctgtctctgctattcttgcgctttctcttttgtcctcttacaacttggcttctccccatctctgaatctgtctctctctttcctgtgtgtctctccctgtctgcttatctctcctttctctatctctgccccttgtttatctctctccctcctctttctcatttgtgtctgtctgcctcttcatctctgcctgtctctctttctccctctctctccctcccccatctcccctctcttctccgtccccatcccctacgcccagggtgcccctgccgagctgcatgggctgcgcaggcgccggcgcttcgtcccagtcccgcttccagtcgtggagggcggcctggaggaggtgctggcctcgctcacatcgctgagcttggagctggagcagctgcggcgtcctcccggcactgcggagcgcccgggcctcgtgtgccacgagctgcaccgcaaccacccgcacctgcctgatggtgaggtccggtccccccgccacttggatgggcggagtgggggtgtggggggggttggggtccgtcgggtcccatccggactcacccaccctgcctggctctgcggcaggggaatactggattgaccccaaccagggctgcgcgcgggactcgttcagggttttttgcaacttcacggcgggaggagagacctgcctctatcccgacaagaagtttgagatcgtgagtaacccaaacctctcatcgcctcccccaggaagtgctgtcccctgctccccacacccacaaccaccttgtctgggacgttatccttccttcaaccggcatttattgagcacttactgtatgccaagtcctgcctcaagagctgggactacagcagaggatcaaaaagaaaaaaaatcaggccagcctggtggcacatgcctataatctcagcattttgggaggctgaggcgggaggatcgcttgaggtcaggagttcgagaccagcctgagcaacatagcaaaaccccatttctacaagaattaaaaaactggcgggcatggtggtgcgagcctgtagtcccagctactctggagactgaggcgggaggatcctttgagccctagaggcagaggttagtgtgagccgagattgtgccactgcactccagcctgggagacagagcaagtctccttctcagaaaaaagaaaggaaagaaaacaaactatctctgcttttatggaactcataccttccatgggaagacagacaaggaaaactccaaaagaaatcaataggctggat

SEQ ID NO: 90776 - DNA, 1046 bp, Homo sapiens
gggctctgatgaggaaattcggcagcgaccacacgggagtggggcgctccatcgtgtacggtgaggctgcaggggtcccgggcctggtgcggggaccgcgcgtgggagcgccgagggggcgtggtctagggagaggcgttgagatcacctcccccggaggtcccagccttggggaggctctgcgtcgcggctctgggtggcctggaactcccacagacccttcaagggcccttcccttatatgcactctcccccgcaggggtaaagcaaaaagatggccaagaactaagtaacgatctggatgcccaggtaacctatcccctcccctcgcaaaggaccgggtcacgggagggagagcaagaggggggacccgacccgttcatggtgactgacccccctctgaaacaggagggaccaggcattgtcggtccataactcatcacccaatctcactttttcacctctccatcatttgtccggccagggagcctgcaaacagtaggcgctcattatgtgctgattgtattcaatgggggagagagccatgaaactaagcaatgaaaggagccaggattattgccatcatagcgggggcgcagaggtcagagaaggcttactggaggaggaggtaccaagtcttaaaggatggggaggagtgagccctgggaggggaaagggaaagaaaggcaggggtcttggggtgggggagggaatggcataagcaaaggctgggaggtggggaagggttgttagtggcagtctctagaaaggctaggatgagcagaggattggggaggagagagaggcaggggaatggaacccttgtgttgaatgaatgaatgaatgaatgaatgaatgaatgaatgaatggctttgaagcacaggtgcatcatggctactttgcttctttgacagctttggtgatgggaacgctgtggatttagcctgcctgaaaggcttagtgtagggctgttaaagagtataataggccaggcgcggtggctcacgcctgcaatcccaacattttgggaggccgaggcgggcgga

SEQ ID NO: 90777 - DNA, 1010 bp, Homo sapiens
caggcatgagccactgtgcctggcaaaaaaaaatttttttaattagctgggagtggtggtgtgtgcctgtggtcccaactactcaggaggctgaggtgggaggatcgtttgagcctgggaggtcgaggctgcagtaagccatgatcacaacactgcattccagcctgggtgacagagcaagactctgtctctaaaaaaaaaaagaaagaaagaaaagaaaccaaatctgacctcaaaaacacagccccaaatctggcttctgaacctcctgactagtagttcacttctggtcaatgcttaactagttcttgcaaaagaggcaggaagccaagatgtgtagtgtttgccaatttctgtggtgtaaatattcccaccatggtcaatatcaggctacccacgtgaagtcactgattgagttgggttgctcaagctgaggccagccgctgcagcacactgctagccctgaccccaacctcagacacctctgacaatccttggtcccctctctgtaccttcctgcccaccaccaccaggtatcccggtgccggaaatgccggaagcgctacgagccagtgccagctgacaagatgtggggcctggctgagttccactgcccgaagtgtcggcacaacttccggtgagggcgctgacccccagctccccctcagccctgccctaccccagccctgcccctccctgccctggccccaccctggcccagcctcgccctcggaccctcacagccctgcccgcccccaggggctgggcacagatggggtccccgtccccctgctacgggtgcggcttccccgtgtatccaacacggatcctccccccgcgctgggaccgggacccggatcgccgcagcacccacactcactcctgctcagctgccgactgctacaaccggcgaggtgaggctcttctcccccaacagcctggacagtctttgtccccttctgtgcctttaagtccccaaatctccactcagtccactttgtctcccacag

SEQ ID NO: 90778 - DNA, 1278 bp, Homo sapiens
atggcctctgcccccatggtctctgggtttggggcccctgttttgtcccctgtaatctcaggtgacccccatgtccccaggtctcctgtatcttcaacacccctgaatgtccagttgtgctggtccccgtatctggtggtctcagctcctccctagagccccgcgtggcctaagtcccctcctccccagactctcatgggacctccagccccatgtctgcagcacctctccctccctagagccccacgtgcctgggacatcctgtgctcaccccaagagccggaagcagaaccacctgcccaaagtgctccaccccagcaaccctcacattagcagtggctccactgtggccacctgcttgagccagggtggcctcctggaagacctggacaacctcatcctggaggacctgaaggaggaggaggaggaagaggaggaggtggaggacgaggagggcgggcccagggagtgacccctgccaggtgcagatacaaaccagacacggtctgtggctactttgtgttattataagatatgagctcaaaccgagatatgaatgaccttggggagccatctgaggccaagatattgacgggggggattcctgggtcccattttcagcgcccagggtcacagatccacagtgggaagttctgtgggacacattggcactgagccacaaagaaggtgtggccagaacaacttgggctcctgctgaccaatgtcctctagggcctaggggacagaggaacacagagtcacagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaaataggagccctggccccccaactttcttcagagtaatagccttaattccttccctatctccttaccaaagtacaagtcacatctttcccaccttttctgcaaactaggagtctaccgttcattcctttatcaaagaaaagtatctacttcctttctagaataagagtactagctctcaccct

SEQ ID NO: 90779 - DNA, 1473 bp, Homo sapiens
ctttacaaaaaatagaaaaattagtcggatatggtgttgcgtgcctgtagtcccggctactcgggaggctgaggtgggaggattccttgagcccaggaaattaaggctgtagtgaatcgggatcgtgccacttcactccagtctgggcgaccggaggagaccgtgttagaaaaaaaaagactagaatctggaggcagcaaagcagggttggaaactgacttctccccagtatctgatgcaagttacttaacctctctgggcctgagttcgctcatttgtcaatgggaagatgcgctgtgagcaagagacagagttagaactcaaatctgcgtccgactgactctaaaggctaagatccttttgctcctctgggcttgttgaaagggtcagatgcaagacagaccataacaggatctgcaccgtcagcttatagttgtcacaacaagggataagctatgttttctttttttctttttgtcatttccaggttcgtaagaagaactcgctgaaggactgcgtggcagtggctgggcccctcggggtcacacactttctgatcctgagcaaaacagagaccaatgtctactttgtgagtagacgccctcacccttcatctcccccagacccccccttcccctatctctcatgatgaacacatatgcctctgagctgctgtgatttctggcttcaaagtaaacgctctgaagaagagatggggcaaaggtgcctactccgggcacctctgctagacccctccagagtcactgatcttttcttctcctgcagaagctgatgcgcctcccaggaggccccaccttgaccttccaggtcaagaaggtgagaggggtggaggtggtacaaagccatgtggggtgggagctggacttggggttgtccgcagccatgtgtggttggtggtcaccccctcctctctcctgtcctacagtactcgctggtgcgtgatgtggtctcctcactgcgccggcaccgcatgcacgagcagcagtttgcccacccacccctcctggtactcaacagctttggcccccatggtatgcatgtgaagctcatggccaccatgttccagaacctgttcccctccatcaacgtgcacaaggtgggtctggcctggcgaggtggcaggtatgggggggtgcagcggatagaggtgccacaggccctcagatggattgctcactcctcccagcgctgagactgggagctcctgggtctgctgagtcctgaggtcaaatcccactcctgtgtctgatgatgctgggcaaaagtgtccagagattcccccagcggtccacaccccgtgagctgcaccttttccagccggtggaaagaaatactgatggagctctgtttcccacgtgtgttgagtgctgggctgagcaggatcgtagcatctcttcttagggccctgttttacagagggaagctgcgggcccagtgctatggcttcggcct

SEQ ID NO: 90780 - DNA, 2529 bp, Homo sapiens
ctaattttttgtatttttagtagagacaggatttcaccgtgttagccagggtggtcttgatctgacctcgtgagctgcccgcctcggcctcccaaagtgctgggattacaggcgtgagccaccgtgcccggccttctttactttttttttaagagacggggtctccgtacgttggtcttgaactcctgggcacaagcaatcctgcagcctccgcttcccgagtagctgagactacaggcgtgcaccaccacatccaactcatttttccatctactttttgtagacatggagactcgccgtgttgcccaggctggttttgaactcctgggctcaggcagtcccaccacttcagcctctggagtagctaaaactgcaggtgcgagctggaagcagcatttctagccagtgccacagtccacgaacagtgtgtgtatcccccaaagcccccacttccccaaactttgccatgagtctactggactatgctctcttcctccccttccaggtgaacctgaacaccatcaagcgctgcctcctcatcgactacaaccccgactcccaggagctggacttccgccactagtgagtgtcccagcaggatgggagacgagggggtgccgggtgggggcctccacatgcggctgatgacagcacttctgctgagacgctgtgattgctctgtccaaagtaaacgccctgacgcactgtgggaagggtgagatgggcaccgccagccccatcacgtgccccctgaccacccccttgccgtccactcatgttcctgcagtagcatcaaagttgttcctgtgggcgcgagtcgcgggatgaagaagctgctccaggagaagttccccaacatgagccgcctgcaggacatcagcgagctgctggccacgtgaggagggcatagggcgggaggccactgcggcccggggaccccagaacaggaccgggagcctgagctcccccactgagccctgttatgtcctacacacaggggcgcggggctgtcggagagcgaggcagagcctgacggcgaccacaacatcacagagctgcctcaggctgtcgctggccgtggcaacatgcgggcccagcagagtgcagtgcggctcaccgaggtgaggcccagggcagggggacccccgggctccaccagtcccaacggtgggctgacgcttcttcctcgtcccctcagatcggcccgcggatgacactgcagctcatcaaggtccaggagggcgtcggggagggcaaagtgatgttccacagttttggtgaggccggggccgccgggggtggggggtcatgggtgtggagctgcacccggatcttggtgacccgcgtctcttggctcagtgagcaagacggaggaggagctgcaggccatcctggaagccaaggagaagaagctgcggctgaaggcgcagaggcaggcccagcaggcccagaatgtgcagcgcaagcaggagcagcgggaggcccacaggtccaggcagagctgggaagggcagggccaagggggggtccctgggatgggcggctatgttgacccccacgccctcctccagaaagaagagcctggagggcatgaagaaggcacgggtcgggggtagtgatgaagaggcctctgggatcccttcaaggacggcgagcctggagttgggtgaggacgatgatgaacaggaagatgatgacatcgagtatttctgccaggcggtgggcgaggcgcccagtgagggtatggagtggggtctgcagcagggcacccagagcctgtccttgtctctgggggccctgacactgtctctccccacagacctgttccccgaggccaagcagaaacggcttgccaagtctccagggcggaagcggaagcggtgggaaatggatcgaggcaggggtcgcctttgtgaccagaagtttcccaagaccaaggacaagtcccagggagcccaggccaggcgggggcccagaggggcttcccgggatggtgggcgaggccggggccggggccgcccagggaagagagtggcctgagcccaagccgcaccggagcagcggctggattgaacgccccagattggggcccgagatgtggccctcggtttcctttcataaaggagttgtgtccccagcccttccactccagtaaagaactgaattggccaggggtccacgtcagcgtttgggatgggggattctggagccatacaaagcaacccagagagtcctgggccggccacacccgagagtccctcccacctggtttcttcctggaagctgggtctctcccctaccctgcacggggttggtttcattggtggcagcagcagccatgagtggcccctccccccagtcccaccaaagagccgtgcaagcagacaggtcacactttcagcagatgagcttgaacctcaggagggttgtggcacaatgaggaaggaaacgtgggtggaaaggcacgctggcctgctctgctggctgggccagtaactggggatggggctggggcagggcccactaagc

SEQ ID NO: 90781 - DNA, 1618 bp, Homo sapiens
tctactggcgagaaggagaagctgccgggaggtgtgggggtgggagggtcctgctgtcagtgcacgggttctgtccccactgctgccttcgtgctgtcatctcccgcacgacagtgcagcgggtttgatggtgccagactctcctcggggcgtctgtgccttcctaattggctgtacctcctatggttgggagacgggcgtctcccatatatgtgcgacttggcagctgtgactttgctggtggccctgtgactgtcctgatgagctgctgtctgtcggccccagggtgctgaccaccccacatcgtgtgtgcgcactgtgtgtatagtgtctccgttgcatgcctgtggctgtaccgtccgaattctttggtgggatttgctggtggcgagtgtgagagtgcagacgtgcacttgtcgcctgccacgcgagggggacctgggcgctgttcctgttgtgtgtcccatgtctgccgttgctgtgcatgtgaggctgctgcccctgttgtcctcccgccctctctggggtggggtcggggctcctcctcctcctcctccaccagtgtcgctggctgggagctcaaatggtgtcagcttctcaggtgtcaccttggtgtcctcgtggccaactggctgcctgtggtttggcacacagtgcctgcgctggctcaacactgaagcccgagcttcctggggcggctctgtccccacgcctgcgccacagtgaggttgaacttgactgtcttttggtccccagagctagagccggtgcaggccacgcagaacaagacagggaagtatgtgccgccgagcctgcgcgacggggccagccgccgcggggagtccatgcagcccaaccgcagaggtgaggggcaccccgacgccaggctggtgggtgggcacctcccggcacctcgtaattatccccgaagcgtgcacacgagggctgggcagcacacgagggctgggcagtgtcctccccctcacagccacctcccctctcccacacagccgacgacaacgccaccatccgtgtcaccaacttgtcagaggacacgcgtgagaccgacctgcaggagctcttccggcctttcggctccatctcccgcatctacctggctaaggacaagaccactggccaatccaaggtgggcaggcaggcaggcacggtggggctgtgtgagggtcacttgtcctagggtcgcctgtcctagctcgtgcccgaccccatcccgcccctccacagggctttgccttcatcagcttccaccgccgcgaggatgctgcgcgtgccattgccggggtgtccggctttggctacgaccacctcatcctcaacgtcgagtgggccaagtaagactccatccctgccccagcccctgctccctgccttgtcccagcaccttcacggagtgttgggccaaccaatagccctgagccaatttaacagtcccccggctggttttgaggggacagtcctttattgtttttttccaaaaccgggcagaggggtggcagctcttgtgcctggggtccctgccagtccgtggaccaggcctggagactggccatctggctccgtgcccgcttcgtcctcacattaccccgtcctctgccca

SEQ ID NO: 90782 - DNA, 1051 bp, Homo sapiens
tctcctgtttctctactggcgcctggttggcttcatggcctggcacccaccttcctacgagggatctcccatccttgccactccgagtccccacagggccatcccagtgcgttgcctggccagccctctgcccttggcctgcctttctccgcttttgctgtaggcgtcatcccaaaagcccttccatcgcagctggggagctcctgcccctggagctgactcctccttcctacgctgccttttgcagacaaatgtgtcaccagcgagctcctcaaggggatccctctggccacaggtgacaccagcccagagccagagctactgccgggaggtgagtgaggactgccgggaggtgagtgaggactgccactcggtgtccgggctgcctctccctccagccctgccgctcctgatccccatgacccagggctcagtctttctctgtttttccccttctgccagctccactgccgcctcccaaggaggtcatcaacggaaacataaagacagtgacagagtacaagatagatgaggatggcaagaagttcaaggtgagggtggggggtgcagggagtggggacccttgtgcttgggggcccatagaccggaatggggtggggtgtgttgaggaggttgataaaggagatcccttggtcccaggagcctgacccttctcccctcccatcctcagattgtccgcaccttcaggattgagacccggaaggcttcaaaggctgtcgcaaggaggaaggtgaggctcttcttccccagggctaacctagaggaattggaaaaccgtgctcccggactttgtgtttagagatggggcttaactcttttttttttttttttttgagacagagtgttgctctgtcccccaggctgaagtgcagtggcacgatctcgactcactgcaacctccgcctcctgggttcaagtgattctcctgcctcagcctcccgagtagctggggttacaggcatgtgccaccacgccagctaatttttgtacttttagtagagacggggttttgccatgttggccaggctgg

SEQ ID NO: 90783 - DNA, 1250 bp, Homo sapiens
ctgcacacagcaggcctttggtcaggttggctgctgggctggccctggggccgtttccctcactcctgctcggtgaatttggctcagcaggcacctgcctcagctgctcacttgagcctctgggtctagaaccctctggggaccgtttgaggagtgttcagtctccgtgaacgttcccttagcactctgccacttattgggtcagctgttaacatcagtacgttaatgtttcctgatggtccatgtctgttactcgcctgtcaagtggcgtgacaccgggcgtgttccccagagtgacttttccttttatttcccttcagctaaaataaaggaggaggaagctgctaaggactagttctgccctcccgtcacccctgtttctggcaccaggaatccccaacatgcactgatgttgtgtttttaacatgtcaatctgtccgttcacatgtgtggtacatggtgtttgtggccttggctgacatgaagctgttgtgtgaggttcgcttatcaactaatgatttagtgatcaaattgtgcagtactttgtgcattctggattttaaaagttttttattatgcattatatcaaatctaccactgtatgagtggaaattaagactttatgtagtttttatatgttgtaatatttcttcaaataaatctctcctataaaccaccctgggtgggtattcgtgatttgcacgggacttctggctgaggtcagacaggaacaagctcttccatgctgaaggcgacccacgtggagtttgaagctagcacgtttgaagctagacactccgtgtgtctgtctgtgtttgttcagaactgagtcacgtgagttgatccccatgacatgcaaatggaacttgctagtgtagcttccaggaaagccttttaaaggaagtcttggctggccttccccgtggctggtaggccttctttggtctgaagtgggttgtgatgcctggcagtggagcagccatcctgtgaccatgaggcagagctctgtgctgcaactggtggaataaggagagagaagtcaccactgagctgcccttggagccccggccaccccatccccaagcaaaacctctttagttgggttttttttctttccaaagaatttttttttttttttgagacagtcttgctctgttgctcaggctgtagtgcagtggggcagtctccgttcaatgcagcctctgcctcctgggttcaagaaattctgcctcagcctcccgagtagctgg

SEQ ID NO: 90784 - DNA, 1021 bp, Homo sapiens
agcactttgggaggccaaggcaggcagatcacttgagatcaggagctcgagatcagcctgcccaacatggtgaaaccccatctctattaaaactacaaaaattagccgggcgtggtgtcgcacgcctataatcccagctatttgggaggctgaggcaggagaatcgcttgaaccccataggcagaggttgcagtgagccaagatcatgccattgcactccagcctgggcaacagagcgagacatataatactaataataaaaacagtgcccagagaacgaggattgttggctgctccaccccagggggccccttgcacaggaggtgccatctctgcctcccaaagctctaagagccactgtcccaagcctataccccatcccacaactgcagcctcatcactgtcctgtcttccagccggcaaagcctgcgaccccgcagccaggcagttcaacaccctcatcccctggtgcctgccccacaccgggaaccggcacaaccactgggctggcctctatggaaggctcgagtgggacggcttcttcagcacaaccgtcaccaaccccgagcccatgggcaagcaggtaggtggggagggggcatccgagggcctgggtcaggccctgtacttggcggcctaactaggtggaagtgtgggtttagccaagtgggggacagcaccccaggaccccaggcacctggcctctgcctcctgcccctccacgtccacgggacaagctcataggccaaggccatggccgtatgctgtcacagtgccatttccctccctgtccccgacggtgacccggcctgggtgctactgccctcgcccaccgcgcctctttcccccagggccgcgtgctccacccagagcagcaccgtgtggtgagcgtgcgggagtgtgcccgctcccagggcttccctgacacctaccggctcttcggcaacatcctggacaagcaccggcaggtcagtggggcggcgcccgctgggtctggacaggaaggaggcttctgtgcctg

SEQ ID NO: 90785 - DNA, 1387 bp, Homo sapiens
gccagctgagcgtggtggtggatgacaagaagtttgtgagcaacataaccaggtaggtggcccccgtcgctcctccacacactgccgagcaggcctcagtagctcatggggcccgtgagtactccctggtgaggcttggggaggagaggatggtacagcatctgccctgccacacggtgctctgccacatggcactctgccacctgtggtctccagttctgaccctgcatcatctgcttccctagtagatagcatgtgcagagcggccagccgcatgcttggctgtggtcatccacaaagcccacgccatagccccatccccccttccagatggcatccaggcacactgccacccatgtgacctcgggcagtgctgtgatctcgggagaaggccatctgagcaggcagggggtggcacctgtgatgaggggacagctgctgcgtgcatctccagaggtgttgacctcctcctctgttgcaggttgagctcgggtcctttccggaccatcacggtgcgagacacgatgtccgacctgccggaggtgcggaatggagcctcggcactggagatctcctacaacggggagcctcagtcctggttccagaggcagctccggggcgcacagtaccagcccatcctcagggaccacatctgtaaggtaatggcaccctgacagagcggctcctcctcgaggcccagcccagcagcctcgtgggaacagtcagcctgcccaagactcaggggagacatggaatctgatcccaggctcctcctcccgagtcctcagcctttgtgtgacccctggtctctcttgcatggtcatgggaagtgtcagagctcccgcagtcctggacttggtctggaatggtgtcaagccactgcccacccaccactgccttcccccttgctgcctctccccgcatgttttcccaggatgccaagaccagccctttcaccatcccctggcaccactccccttcccccaccctaaaggctcagcttagattcccacgctctcctacacctgcgctgcctcaggtccctgccgtggcctcgagccaagtgcgatatccctgactgtctctttcccgatgggcgtgagccccagggggcttcctggtcaccatggtgttcccagctcccagcccaccatggatgctcggatgctgctcacatgaggtgacagctgggccccccacactctttcaggacatgagtgcattggtggctgcccgcatgcggcacatccccttggccccagggtcagactggcgcgatctgcccaacatcgaggtgcggctctcagacggcaccatggccaggaagctgcggtatacccaccatgacaggaagaacggccgcagcagctctggggccctccgtggg

SEQ ID NO: 90786 - DNA, 1050 bp, Homo sapiens
gccaggcacggtggcgcacgcctgtaatcccagcactttgggaggccgaggtgggtggatcatgaggtcaggagtttgagaccatcctggccaacatggtgaaaccccgtctctaataagaatacaaaaattagctgggcgtggtggtgtgtgcctgtagtcccagctactcaggaggctgaggtgggagaatcgcttgaacctgggaggcagagcttgcagtgagccaagatcacaccactgcactccagcctgggtgacagagcgagactccatctcaaaaaaaaaaaaaaatcttctggagagttgaaagcatggcttcgtgcttgatctgccaggcatctctgacacgctgtgggccatcgagatgtgggaccctgcggcccaggcgttccggctgaacaaccccggctccacagtgttcacagaggactgcaacatcctgctgaagctggtcatggctggggagaccaccaactcccgcggccagcggctgccccagaagggagacgtggagatgctgtgcggcgggccgccctgccagggcttcagcggcatgaaccgcttcaattcgcgcacctactccaagttcaaaaactctctggtggtttccttcctcaggtaaacgggtagaagccccccagtgttgccagacggcccggggctgtgccgcatgtcagcagtggtcattttcgccctgcactgaggcctctgccccccggaagctcacagctcagctctcaccagggagagactttgataacattcgtgaggggcttccggcacagtgggtcgtttcttccctctgtctgtggaggtgactcctgcagtctctcctgccccctacagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcaggtgggccctggggctggggcgggcagacagatgtggccagcacgtgacccggccagcag

SEQ ID NO: 90787 - DNA, 1136 bp, Homo sapiens
gtcttgctctgtcacacaggctggagtgcagtggcacaatctcagctcactgcaacctctgcctcctgggttcaagcaattctcctgcctcagcctcccaagtagctggaattataggcatgtaccaccacacccggctaatttttgtatttttagtagagacagggttttaccgtgttggccagggtggtctcgaacttctgaccttgtggtccacctgccttggtctcccaaagtgctgggattacaggcgtgagccacaatgcccagcctaaatcatttcttagggtacacacctaccttaattcatcaggtgcttgactttaaatggttattttcactggtcagtcatgcctgactgaccactgcaaggtggaaggttcattgatgtcaagtgggtgcttctctgcagcatcaagctgtccagtcccgtgaaacgcccacggaaggagcccgtggatgaggacctgtacccagagcactaccggaaatactccgactacatcaaaggcagcaacctggatgcccctgagccctaccgaattggccggatcaaagagatcttctgtcccaagaagagcaacggcaggcccaatgagactgacatcaaaatccgggtcaacaagttctacaggtcagcagaggcctctgttcttccacgaggccacagactcttctagaaggctctgcctgaaacaaggttgtggcatagcacccacagttgttctaagagttaggttgaagtagctgtttttccaagtgtttctgattatcggtgggcactgataatgactagaattctagttcccagccctcacttttaggtccttattttaatgttgcagagccctttttccaaaagaaatccttaagctggctgggcactgtagctcacgcctctaatcctagcactttgggaggctgaggcaggaagatcacttgagtctaggagttcaagaccagcttgaggaaacgtagtgagaccccggccctaccaaaaaaaaaaaaaaaaaaagactagctgggcgtggtggcacacgcctgtaatcccagctacttgggaggctgaggctgaagggatcactgaaacccaggaatttgaggctgtagtgagccatgatcccaccactgcactc

SEQ ID NO: 90788 - DNA, 1023 bp, Homo sapiens
ctgacgtgcgttctgttttgttttgatttgtatttttttttaatttggttttttttttgtttttttttttgttttgagactgagtttcgctcttgttgcccaggctggagtgcaatggcatgatctcagctcactgcaacctccacctcctgggttcaagtgattctcctgcctcagcctcccgagtagttgggattacaggcacccaccatcacgtccagctaattttttgtatttttagtagagacggggtttcaccatgttggccaggctggtctcgaactcctgaccttaggtgatccacccgcctcggcctcccatagtgctgggaatacaggcatgagccactgcgcctggcctgacacgcattcttatctcccaagggaggcatggatcccgagtccctgctggagggggacgacgggaagacctacttctaccagctgtggtatgatcaagactacgcgagattcgagtcccctccaaaaacccagccaacagaggacaacaagttcaagtgagcactggggctggactcggggtcagcaggcactttcagcccacatcactcccttttcccgtgtgcttccgtctggttggcttccgccaacggccccccagtttgtgtctcttgctcgtcaaaggccagcctgactatgaatgatgctcaagtgtgtagatggcctggagttgctttaagtgtgtggatgacctggcgttgtctttgtaagagggttccctacccaggaacagggttcgtcttgccatttcaagacttcccgtgtgttcttcagtgtgtgcccagctcttgcatgtttttggctgtttcttagatattttctcctgtaaatgagacctcttatttgattcttttctttcctttttttttttctttttttttttttgagacggagtctcgctctgttgcccaggctggagtgcagtggtgcgatcttggcttactgcaaactcagcttcctgggttcatgccattctcctgcctcagcctcctgagttgctggg

SEQ ID NO: 90789 - DNA, 1022 bp, Homo sapiens
ccttgcagaggtgacacctgggctgagatggagaaggtcaggtaggacctagccacacgacctgggggagagctgcactgaggtggcagtcagcttactttgttggagaaaaggaaggaggcccctgcagctggagtggcttgagccaggggatgatgggcaggacaggggtcagggttcaggctgtggccttacagaccatggtgaggtattgtgggctgtgctgttaaaatcaaatcctgggacccgagtggcagagcagaagtgggagggacatggatgcccttggccacagcatctggccaaggaaggtggatgttcttcttttttcttattattgaagcccttgtagaacaggatgttctctttagcagcaactcttcattgacttcttaatgaaatcgagtcatgtcttactttaagtaacagaggaccatgcaagtcaaggccagcaaagaccctcagaatgatcctccatgaacttatgctctcattttcagactgatgggaagaagagttactataagaaggtgtgcattgatgcggaaaccctggaagtgggggactgtgtctctgttattccagatgattcctcaaaaccgctgtatctagcaaggtttgcatctttctttttgcttgacttctgcatgcactttctcatcaagtaggagatgcctgttttgccaaaatagcaccagcagctttttgccctagatgaaaactgaaaaggacgagtgctcctgcatagacttggtcacatatctgctggccaagtcagaactttctccccatgcccgtcttctgattccagggtcacggcgctgtgggaggacagcagcaacgggcagatgtttcacgcccactggttctgcgctgggacagacacagtcctcggggccacgtcggaccctctggagctgttcttggtggatgaatgtgaggacatgcagctttcatatatccacagcaaagtgaaagtcatctacaaagccccctccgaaaactgggccatggaggtgagt

SEQ ID NO: 90790 - DNA, 1449 bp, Homo sapiens
ccagcctaaaagtcttaattcaccgtttgtttcattgttgctaagggctgtgtgactcactttttttttttttttttaattttttgagacctaaaagtcttaatgcatcatttgtctcattgttagtaagggctgtgtgatttgccctttttttttcctttttttttttttttttttttttttttttgagatggagttttactcttgtcgtccaggctggaatatggtggtgtgatcttggctaactgtaatctccacctcccaggttcaggcaattctcctgcctcagcctcccaagtagctgggattacaggcacaccctaccatgcctggctaatctttgtatttttagtagagatggggtttcaccacgttggccaggctggtctgcaattcctgaccttaagtgatctgcctgcctcggccttctgaaatactgggattacaggcatgaaccactgtgcccagccctgatttgcctttttaatgccattttttaggtgtgtcagcagcctgagtgtgggaaatgtaaagcctgcaaggacatggttaaatttggtggcagtggacggagcaagcaggcttgccaagagcggaggtaggtcaggccgagtcttcctcctgtggcagaggacttgccagctggtggcagatgcactgtggagaagggcctgcatgtgtgggacagcaccaggattccttcgttaggcattgtctcaggacctgtccctgttatgaagaaaacagccccggttggtcttacttagaaaaggggccttaggtataaccagtgacattgcaggtgtcccaatatggccatgaaggaggcagatgacgatgaggaagtcgatgataacatcccagagatgccgtcacccaaaaaaatgcaccaggggaagaagaagaaacagaacaagaatcgcatctcttgggtcggagaagccgtcaaggtaacccttggagccccttggtcagctcactgccatgttcccaataagcaggttgccctctagtatctcgccaacctgacctctcaggcagcctgagccccggcactaagaaacctgtctgtttgcccctgagaagagcgggactggccaagagaccatgttccatggctcagtaccagcaaggcatttttgtgtggccacaaggctcagttctcctaatgtcccaaaatgggcatttgacacagttctaggggcatcaggcaggtgagccctcatagcttgtttttctgttttgttttgtttaagatggaatcttgctctgtcacccaggctggagtgcagtggcacgatctcagctcgctgcaacctctgcctcccaggttcaagcgattctcctgccccaccctcctgaatagctgagattacaggcgtgcaccaccatgccaggctaactttttttgtatttttagtagagacggggtttcatcatgttgcccag

SEQ ID NO: 90791 - DNA, 3223 bp, Homo sapiens
acatacacttgatgcttaggtgggagaataaggtagaaactctgggtgatagaacgctgtcttaatccagtgttcccgcaaccaaaaaatgagtgtcggggccaggcatggtggttcagcctgtaatcccagcactttgggaggctgaggtgggtagatcactggagataaagagtttgagaccagcctgctacacatagtgaaaccccgtccctactaaaaatacaacaattagccgggcatggtggttcaggcctgtaatcccagctactcgggaggctgaggcaggagaattacttgaacccgggaggtggaggctgcagtgagccaagattatgccatcgcgctccagcctgagggatagagcaagactctgtctcaaaaacaaacaaaaaaagagtgtcagacttgtacattctctcattgcctcgtgcctgatctgaagtctgcacgaagacccgccttcacggcttagctggtaagcatgtgctttgtttcctgtctagtgtgtactgtaagcacggtcacctgtgtcccatcgacaccggcctcatcgagaagaatatcgaactcttcttttctggttcagcaaaaccaatctatgatgatgacccatctcttgaaggtaaggaatagtccgggattatgtttggggcacactttaaaaacagccaggcagggtggctcacatctgtaatcctagcactttgggggtctgaggccagaggatcacttgagcccgggagtttgagacgagcctggacaacatagcaagagcctgcctctattaaaaaaaaatatatagcatatatatatagtatacatatatacttatatatatgtataaataaaaaacatacttatgaagcaatagtcagctggagttgctgctgcctcttaaagttagggtgtgagactttgtgccaggagcagctgtaggccaagtcattgtgatgactgaggagcacccgacctggctgatgggatgtctgctgagtgggcgcttagagcgcctcctgggtttgggatgtgagtcagagcctttagtccatttcctttttctgctctaggtggtgttaatggcaaaaatcttggccccataaatgaatggtggatcactggctttgatggaggtgaaaaggccctcatcggcttcagcacctgtaagtgtgtggcccatcataggctggccggggtctgaaaggggccttcatgttctccttcctgggggctgacggggctctggtgggaattctcagcaggcttgcagaaggccatgtgactgggaaccttagcaggttcagttggggtagcctcttgtgttagttatgactggctctggaactgactctccagttgtaagagcaggtcttggccggatatggtggctcacacctgtaatcccagcactttgggaggccgagttggggggatcatttgaggccaggaattcgagaccagcctagcctggccaacatggtgaaaccccctctctaccaaaaatacaaaaattagccacgcatggtggtgcatacctgtaatcccagctacttgggaggctatggcaggagaatcacgtgaacccagcagacagaggttgcagtgagccgagatcacgccactgccctccagcctgggtgacggagcaagactctgtcctcccctgaaaaaaaaaaaagagcaggtcttattcttgcaacccaaacccagactgaattccaaacaccagagatgagctcaatgaaggcctactcagctagtcttcgctctctggctggctcagacaggcttcttcagaacaagccagctatgatgtgttgtgccctatgtttctgacatttgggtacgggatgacttttagactgttgggtgagtttggtagactcctccatgccctgtggccactgtaggcgccatcagattccagccccttttccacacctcctctgttcaccccagcatttgccgaatacattctgatggatcccagtcccgagtatgcgcccatatttgggctgatgcaggagaagatctacatcagcaagattgtggtggagttcctgcagagcaattccgactcgacctatgaggacctgatcaacaagatcgaggtaagagatcgagggtcctcagcatccgggattcccactggaaacttgccttcagaaccagcagacactgttcttcagttggatttaggccagtttggcttaagcatgagagaaacctgttctctttcaagaccacggttcctccttctggcctcaacttgaaccgcttcacagaggactccctcctgcgacacgcgcagtttgtggtggagcaggtggagagttatgacgaggccggggacagtgatgagcagcccatcttcctgacaccctgcatgcgggacctgatcaagctggctggggtcacgctgggacagaggtaaggatgcggcagggaccagagtgaagactggagaccggggagggtagagcatggcccacatcctctgtcccagtcctctgagatgctggaacctctcccgtaggcgagcccaggcgaggcggcagaccatcaggcattctaccagggagaaggacaggggacccacgaaagccaccaccaccaagctggtctaccagatcttcgatactttcttcgcagagcaaattgaaaaggatgacagagaagacaaggagaacgcctttaagcgccggcgatgtggcgtctgtgaggtaacctcacctgtgggtgctcccgctcccctaaggtggcccagcctctggcctgatctgaggactgctccatctttctctctgtggcttgagactctggctgctcaaatgtgacccctgagacagaaattagttagtggtctgggaggaccctgcatacttcattgaacgtcaataggacagatgtccacagaggcatgcttgggtgctttgctgataatgccactgtccttaattgaagagcctggcttctgggtggctctgctgtgcctgcatctcacagtctgaaggcccctgttggactgctaaaggggtattcacatctaagtgggcactttgtccagcttagatttgaggccctcaggaggcgtccctttctgtgagtttttaaaatatatgtttacttcactcaggaggaactaacttcctagtcctatgacccaaagaccaggactattttgatacctattacctgactttcttttggataaagactggct

SEQ ID NO: 90792 - DNA, 1019 bp, Homo sapiens
cgtaagaatttattcttgacattatcgaaagcagatggtaatgttaaaatgatggttctagaacaaaagggaaggggtttcagtaattgccagagcaaccttaggctcattttggatcgggttggtgaacataggaccaaggtgcgtcaggcaggatgcccctgcggtgaagagccactgtgaccacgcgcctgggcctcactgccacagccggtgcctccctgtgccacaggcacctcaggcagaaacctcacaggggcgattttgatattttctgaaacaattaaacaaacgatcttgtgatttttttttttcccccagaacggagaaaaaaatggctcgcgccaaaacagtcatgaactccaaggtaaacatctgccgggaataaagccggtggcggcgctcacgaggcggctgggagctgctctctgagtgccatcatctgtgttcctgctcccacagacccaccctcccaagtgcattcagtgcgggcagtacctggacgaccctgacctcaaatatgggcagcacccaccagacgcggtacgtacagctctcttcccagccttcctctgcctgtcccttgtcccactgctcaccagccccgtgtccttcaggtggatgagccacagatgctgacaaatgagaagctgtccatctttgatgccaacgagtctggctttgagagttatgaggcgcttccccagcacaaactgacctgcttcaggtaagtgcactttcgtgtgcatgtttgcttcgtggaaggaggcacatccccagaggtgcctgcgggctcacgattctggtgatgttttttagtgcctgacctgcaacatgtcttaagctaacacttcgtggataagagccaccgtggagggctgggcgcggtggctcatgcctgtaatcctagcactttgggaggccgaggtgagcagatcacttcaggtcaggagttcgagaccagcctggccaacatggcgaaacctaccgaaaatacaaaaagtagccaggtgtggtgg

SEQ ID NO: 90793 - DNA, 1077 bp, Homo sapiens
agatggggtattgatggtgttcctgaagaccttgagtcctggagtagtaaatgccctctgggcttcctgcagtgaagacaggagaggcagcctgtcctctgaacctggggaggagcttgtgtcagcccttaggagctgttggccccggtgcagggccccccgagctgaccagcctgtgtcatatatatatatagtatattttgcagagatggggtctcagcatgttgcccaggctggcctcgaactcctggcatcaagcaatcctcctgccttagcttcccaaagtgctgggtttacaggcacatgccactgcacacagcctgtaaataaagttttattggaacagagccacactttctcatttacattttgcctgtgggtgcttttgtgctaccatagcagagatgatcatcctgacacagaccacgtggtcagcaaagctgaaaatactgatcctctggctcttacaaaaacagtttgccaagccctggtctaggaggttctttagtgccctcttgttagtttcaggtggggaattaagtgagggaaagtgaagcctcgtgtctacccggtagatctgcccaggcctgcctgtcttccagctccacagtgctgggatccctaacctgtaacttcagtgtttgcattttatctcactctggctcagaaactaattttttcccttctttatctctctacctcccccttatttttctgtcaggatgagaagaagcacagaagtcaacccaaagatctgtaagtgtttaaaatgcttgtgcttttgtgtcatctggatcagtagaaagcctgttctaggccaggtgtggtggcttgcacctgtaatcccagcactttgggaggctgaggtgggtgaatcacctgaggtcaggagttcgagaccagcctagcctggccaacatggtggaaccctgtctgtactaaaaatacaaaaattagctgggtgtggtggcgggtgcctataatcccagctactcggaaggctgaggcagaactgctagaagccaggaggtggaggttgcagtgagccaagattgcgccactgcactccagcctgga

SEQ ID NO: 90794 - DNA, 1086 bp, Homo sapiens
ttagctgaagcaaattttgagactgagcctgaatccagaggtgggcagaataccccacctgagcggcagggccctggcagagtgggaggtgaagactcggacccctgtgtgcagtcagctgtccacggtcactgactgacgctgatcgcacatcagcccagctctcaacctaggcaggccagacatgggtcttcctccaccgcaggctggattcccatcaggccacggaaatcatgacatccctttgtctgctttttgtattaaaccactggcatctctgaccaacattcagatggggtattgatggtgttcctgaagaccttgagtcctggagtagtaaatgccctctgggcttcctgcagtgaagacaggagaggcagcctgtcctctgaacctggggaggagcttgtgtcagcccttaggagctgttggccccggtgcagggccccccccgagctgaccagcctgtgtgtgtgttgtcttctgtgacagaacacccaaacagaaactgaaggaggagccggacagagaagccagggcaggcgtgcaggctgacgaggacgaagatggagacgagaaagtaaaggcgggttatttgtttctgaactccccctcattcttctgctcctgtttgcttgggcgggagtgcgcagggtggggctctgggttcaagtccagccccatccacccaggctccatggggccatccagactctgggaaggtcaccttttcctccttttgggggccgggatttgtggctggatgcctgtgctggatgcctagtgaacactcagttgtcctctgtctttcacactagagagggtctgtgtgagcctgggctgagatgtgcatgaagcatcctctcctgaggcctcactgctgagaagccttgacacacagtcagctctgacgcacatgtcagccacacctttgattctttcccagcctcctacgttctgagtctagctctccccctgccagcctccccagtctagtttagccaagtgcatgcgtttaaaccctaaagcatcatgtggaacactgctgggcctctgtcaaagtacaggatggccaggttgcctgca

SEQ ID NO: 90795 - DNA, 1568 bp, Homo sapiens
gagtgcagtggcacaattttggctcactgcaaccttcgcctcccaggctcaagtgattttcccactcagcctcctgagtagctctaactacaggctcaagccaccatgcccagctaatttttaaatattttttgtaaagatgggattttgtcatgttgccccaggctggtcttgaactctggggctcaaagcaatccacttgcctcggcctcccaaagtgctgggattataggtgtgagccactgtgcctggccgacactttacagaagcacagtattattcttataaaccatgatatgtctccatctcacctccagctttcccatttttcaccactttggagacaggagtgaagtgatcctaatggaaattccctgaacacatttcatgactgtttagtgttttgactgagacagcattgcctgccattcactcattgtgatgtgatcaggcagctcaataatttgtgtattagtccactagtgaatagcttgggaatgtgggtactgctaaacctatatccttcccttaggaatgtgtgaaggagaaattgaatctcttgcacgaatttctgcaaacagaaataaagaatcagttatgtgacttggaaaccaaattacgtaaagaagaattatccgaggtaagtcagttctcagcatcctagcctctagaaaaatgtctcctcctagtaacttgtctgtgaccagggaggcagcaagatccccagctgtcctcattgcctgatgatgatgatgatgatgatgatgatgaaggaaacacatgtgtttccttgttctctgacacttgtttacattcactgctacttaaattatcctttcctgctgtaggagggctacctggctaaagtcaaatcccttttaaataaagatttgtccttggagaacggtgctcatgcttacaaccgggaagtgaatggacgtctagaaaacgggaaccaagcaagaagtgaagcccgtagagtgggaatggcagatgccaacagcccccccaaacccctttccaaacctcgcacgcccaggaggagcaagtccgatggagaggctaagcgtaagagcagatgattccttttatttttaattgtttttgagatggagtctcactgtgttgcccagtctggagcacagtggtgtaacctcggctcactgtaacctctgcctcccaggttcaagagaccctcctgcctcagcctcccaagtaactgggattagaggtatgtgccaccacacccagctaatttttgtatttagtagagatggggtcttaccatgttggccaggctggtccagaactcctgacctcaagtaatccacctgccttggcctcccaaagtgctgggattacaggcataagccaccacgcctggccctgcttaactctctttctttctttcttttttttttttttttaatgacagagtcttgctctatcgcccaggatagagtgcaatggcgcgatctcggctcactgcaacctccgcctcccagtttcaagcgattctcctgcctcagcctcccaagtagctagtattacaggcgggcaccaccatg

SEQ ID NO: 90796 - DNA, 1052 bp, Homo sapiens
ggctggtcttgaattcctgggctctagtgatcctcccgcctcagcctcctgagtagctaagactataggtgcatgccaccacacccagctaattactattttttgtagagacaggttctcgctgtgttgcccaggctggtctcaaattcctgggctctagtgatccttccgcctcggcctcctgagcagctaggagtacaggtgcgtgctgtcatacccagctaattactgttttctcgtagagacagggtctcactgtattgcccaggctggtcacaaattcctgagctctagtgatcctcccgcctctgcctcccgagtagctaagactataggtgcatgctaccacagccagctaattattctttcttgtagagacagggtctcgctctgttgcccaggctagtctcgaattcctgggctcaagtgatcttcctgtcctggcttcccgagtgtagagattacaggcatgagccactgcgcccagccatggtctgctgtatttcagacgagcatttctggcgtagaggtgttagagtaatctaacattttataatttcttcctatccaatctatactagatacctctgctgggttagttttcttaacacggctctgatgtcattggttctacttccccttgactgctttggtgtttgttaactatggaacaagatggataagtgtgatgcttttgccctccctccgactgtccccagccacctctctggaggtgcctttccctccctgtatgtggccagtctcacgtttgtttcttgtgtgtttccagaaccagccacttctcaatggtgcccctgtttgagcagcttcctgtgcccggttcacacagagctgtcaacttcttcctgaggctgttataccctttctcttgggaatcccgcaggcgtgagctgtatttgccttattcctctgtggttgtttatatatatctttttttttttttttttttttgagacggagtttcactcttgttgtccaggctggagtgcaatgacgtgaccttggctcaccgcagcctccacctcccgggt

SEQ ID NO: 90797 - DNA, 1742 bp, Homo sapiens
ggaggatcacttgagcccaggagttcaaggctgcagggagctatgattgcgccactgcactccagcctgaatgacagagcaagaccttgtctttaaaatatagataaataaaataaataagaaagagcgtagcctagggcttatagaggccgcagagccagtctctctggccctgccgctggttaaatttgagactttaggaaagtgaattaatctctctgggtttcccgtctgtaagtggggatgatgatgattctgaattcatgtggcccttcctcgaagagtaacagagcaggaaattgaatctcagcccatccgaggccagagcccaggtagcagccacagctctgacctattgtctgtctgtctgtctgtcttctctgcagttctgaaagccccatggccccagcaggcctctgagccccaccatgggcagcttgtactcggagtacctgaaccccaacaaggtccaggaacactataattataccaaggagacgctggaaacgcaggagacgacctcccgccaggtggcctcggccttcatcgtcatcctctgttgcgccattgtggtggaaaaccttctggtgctcattgcggtggcccgaaacagcaagttccactcggcaatgtacctgtttctgggcaacctggccgcctccgatctactggcaggcgtggccttcgtagccaataccttgctctctggctctgtcacgctgaggctgacgcctgtgcagtggtttgcccgggagggctctgccttcatcacgctctcggcctctgtcttcagcctcctggccatcgccattgagcgccacgtggccattgccaaggtcaagctgtatggcagcgacaagagctgccgcatgcttctgctcatcggggcctcgtggctcatctcgctggtcctcggtggcctgcccatccttggctggaactgcctgggccacctcgaggcctgctccactgtcctgcctctctacgccaagcattatgtgctgtgcgtggtgaccatcttctccatcatcctgttggccatcgtggccctgtacgtgcgcatctactgcgtggtccgctcaagccacgctgacatggccgccccgcagacgctagccctgctcaagacggtcaccatcgtgctaggcgtctttatcgtctgctggctgcccgccttcagcatcctccttctggactatgcctgtcccgtccactcctgcccgatcctctacaaagcccactactttttcgccgtctccaccctgaattccctgctcaaccccgtcatctacacgtggcgcagccgggacctgcggcgggaggtgcttcggccgctgcagtgctggaggccgggggtgggggtgcaaggacggaggcggggcgggaccccgggccaccacctcctgccactccgcagctccagctccctggagaggggcatgcacatgcccacgtcacccacgtttctggagggcaacacggtggtctgagggtgggggtggaccaacaaccaggccagggcagaggggttcatggagaggccactgggtgaccccagatagagacttggggctactgagccagatgcccccgccccacagacctgggtgatgttgcaaatatttcacacctggaaaggccagataaggcactgactagtcacatagcagtgttgcagtgcggtcctgagggccagtccagtggctagtgtgacccctttagaactggatcctggggaggcc

SEQ ID NO: 90798 - DNA, 1030 bp, Homo sapiens
cccttcacggctcacatgacttcagcaaagctgccccatcctcccagccaggacctcccagatggggtctctcccatcctgactccccctacatcccgccttcctcacaccggatgtgactgcagagtgaggactccaccctgtttgttccaggggcctcacatctggatttcatcctggctggggagggggtgccagcgccctgcccatcccggcaggaccttctgtcccagggcagagctagatggtgctgatgagaacaggctgttggagatctcgtctggttggcttacatcccttcccttcccaaaggactggaggaaagaggggagctaataacatttggcagtatttgttgagtgcttactatgagctaaacgtgcctcatgcgtcatttaaaaggattttcccatcacccccatgaagtgggctttcttctctctattgcacagataaggaggttcaggctgagacagcgtctagggacttgcccagtgtttcagaggtggaatgggagcaaattctggattgccttcaaggtctgtgtccttgaagatggtgtgacctctgggatgtttgaatctcagggccgccctggtgtctccccaagaccttatcttgggagcacccgtggcctcaaggcttagacccagcctgaaatccagcgttagtgggtggtaatgaatgagcagggcacggagctatcagtggtgagactctccctgacccaggtcagcatgagggcgcaggcgcctgtgtgttccagaaaagagacaaaccctccaggacctgcctagggcttgctctctgggtaggtgggcaaggtttctggaagtccacattatatttttcatgccatttgggggagcttctttccctttgaaagcgtgtagctactcaggagactgaggcaggaggatcacttgagcccaggagtagagacaactgtgagctatgatcatgccactgcactccagcctgggtgacagagcaagaccctatctctagaaaataataatgaaaattaaaa

SEQ ID NO: 90799 - DNA, 1014 bp, Homo sapiens
tgctgggattacaggcatgagccactgcgcccggcctaaacacatttcttatttatccaggaagccacagcaaatctcttggtgagcagcagagggggcggctgcactgcacagcgtgctccccaggcctggaaagggaccttgattctcacttatgaaccccaggaggggcccagcaggccagggcagcctgggggtgtctggtcggggtgacccagaggtcaggctgcggttcaaactccccctagggacgtccacatagcattaactctatcctcagaaagcctgagctcccgtcgcctataaaggaccccatcggtagggctggccgtagagcgcccccaactggaccaatcagaggcagaagatggaaagcccgggccaataggcaaattgctcagtgcccttggattgaaaatgagccaatcagagcatgggctgtttccggcccatcagctgtgtctgatccagccgcagcctgggcccaagcctgcctgggactggctgcagcgtgcagagggcatcaagatgcccggggctgcgtccagcaagggaacaaggggcctctgtgtggctatctgggaggggcagcagtccccggggacgtgcacaagcccttgtctgttcccaaactaggacggatgtccctccgccctgggggagcagctgcctctatccagccaggggccaggatgccccttggagggggcggccagggactgagatggctgggtgactccggaaacctccatcactcctgggctcaggagaactggcctaaccagacttttctggaacggtgcacacagtccttgccagacgtgtttctagggacctgaggaggactccccctactctcccccctccctcccatttagctaaggctggaacttcctctcccttcatgaaaggcatacactgcactggcgcctctgacaacccctaaccctacccccaagctgggggaaggccatggtgtctgcctctcatcctctctgccgaggagcgcctctc

SEQ ID NO: 90800 - DNA, 1159 bp, Homo sapiens
gctccaaagtcacctctgtcaaagccacagtctgttccttccacagccacaagatggcgacatgagcctaagtcaagtcctgtccctcaacccacgcccctcgctggcttccccacctctctcaggatgaaagcccaagtcatcagggtggcacgtcaggccctgcacgatgtgccccgtcacctccctgccctcccgtcatttgccctgggtctcccccaccagaatgggagccaggagtcccagccaggcacaggaccgagcctggctctcggtcagcaggtgatgagctgggagcagctccttggccagaggcttacaggcaacaagcggccaggcagggtctggccccgggctgctgggctcacaaagtcacactagaccacagtgacgatctctgtaagcacaaagggactccgatgtgggtggggtgaggagagaggcagccccggcctgaccggccccccgccccgcccccaccccgcccccaggcctaaatgtgcacagcatgctcaagcaccagacgctggtcctgacgctgcccaccgtcgccttcctggaggacaagctgctctggcaggactcacgttacagacccctctaccccttcagcctgccctacagcgacttcccccgacccctaccccacgctacccagggcccagcggccaccccgtaccactgttgatgtgaagcacctcttctgagccaggccgagcccctggccgacttgggagcctcaggcccacgcccacccttcgaggaaggtgtcacctggaccccttcattccacggaggaagctgaggccacagggagcggccatcgccattgggaaggggcgactccacggaaagcccagacgggcttctgcatccattccctctttttgtttttaaaataaattgtatttttgaatcaaggaggataaagataacttctcagtgtcatttttgataattgcattgagaacgatgagctccttcccaggttctgggcactgttggggatccgccgtctcaagaggctcacggtctggtttaggggaaccccagggctgtttgtggaaattacaagaattcacttacccggtgagtcagactccaggagctcacaggtgcgtgggcgctggcacttcctaggagctgactcctgccacat

SEQ ID NO: 90801 - DNA, 1077 bp, Homo sapiens
tcaagtgggaggatcacttgaacccaggaatttttttgtttttgtttttgtttttttgagatggagtctcactctgtggcccaggctggagtgcagtggtgccatcttggctcactgcagcctcctccacctcctgggttcaaccgattctgctgcctgagcctcccgagttgctgggattaaggtgcccaccatcatgcccagctaatttttttgtatttttagtagagatagggtttaccatgttagccaggctggtcttgaacgcctgaccgcaagagatcctcctgcctcagtttcccaaagtgctgggattataggtgtgagccactgagcctggtcaagcccaggaatttgaggttacagtcagctatgattgcaccactgcattccagcccaggtgacagagagagacactgcccctaaaaaaaaaaaaaaaattgattgatgggaggaagggtgaggttggcagagccttgaatgccaggtggaggagctgggactttccttcttggggtgatagggagtcatggagggtttctgagcaggccagggattagatagctgaaggctggatttactggaagccaatgagcagttggctatggtccttgtccacgcggcccatgttgtgggcagtgaccgtattcaagaagggaaggacagacaagtatttgaatacttcagtgaccaggatttggtaaaggactgcaggtcagggtcaagaagaggtgagagcaggacagacttcctccccgctgcaccaggcagctgagctgggtttcctctaggggctgaggtttgagggtacctcaagttctgcaagagtctataggaggtggtaagagagaagagctggaggtcagagttttcttgactatatatatatatatttttttgtttttgtttttaacagcttaacagctttctgttttatttttagagacagggtctcagggtctcactttgtcacccaggctggagtgcagtggtacaatcgtagctgactgcagcctcaaactcccaggctcaagaaatcctcctcccacccttagcctcctgagtagcagggactac

SEQ ID NO: 90802 - DNA, 1053 bp, Homo sapiens
tcgagatcttgagggcacctacctctgtcgggccaggagcactcaaggggaggtcacccgcaaggtgaccgtgaatgtgctctgtgagtgagccggcgggcagagctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccaga

SEQ ID NO: 90803 - DNA, 1018 bp, Homo sapiens
gaggtctactcctctacgccattcgcatagcagccccttcctgactctgccactcacctgcgcccccttcacttcccacccctaggggcctgtgaagcctccctggcctgctccacctgccatgtgtatgtgagtgaagaccacctggatctcctgcctcctcccgaggagaggtgagtgggtcagccctgtctagctggcagcttcaccctggagcattcagcagcccccaccatcctccccacttccagttcctggaatgggagctgcctcccccaccactaccccctgcgctcagtcagcttcctccctcccccacctctggccccccacccacccagctagcttgccctcggctaacactgcccgtgtcaccaccctagggaagacgacatgctagacatggcccccctcctccaggagaactcgcggctgggctgccagattgtgctgacaccggagctggaaggagcggaattcaccctgcccaagatcaccaggaacttctacgtggatggccatgtccccaagccccactgacatgaacacctggaccattccacattgccatggccccagggcccagattgagggaatagccaggtgccagccctgcccagagtgcggacaggcccgggagagacgtggaagcccctgtgaaggacaacacccctgcttgggagagagtcccatgtccaggctctggtggggacagggcccctagtggggtggccttccccaggcccctgagaatcagggtttgagtaggagtggactcatattggagctgcaataaatcgataacacaggccccagcatgttgagtgtccttgggggacagatctggggtctacaggtggctcacacctgtaatcctagcactttgggaagccaagatgggaggatcacttgaggccaggagcttaagaccatcctgggcaacatggcgagacctcgtctctataaaaacagtaaaaattagcgtggagtggtggtaagtgcctgtagtcccagctac

SEQ ID NO: 90804 - DNA, 1855 bp, Homo sapiens
tttgggaggccgaggtgggcggatcacctgaggtcgtgagtgtgagaccagtctgaccaacatggagaaaccccgtctctactaaaaatacaaaaaattagctgggcatggtggcgcatgcctgtaatcccagctactcgggaggctgaggcaggagaatcgcttgaacctgggaggcagagggaagattgtatacaaagggctgggtactacaattgtctgcttcactccaccggcccttcttctacagatgtcccccccgcccagtggcttcggcgaacggagcagcggtgggagtggcgggggccccctgtctcacttctattcaggctcgcccacttcctacttcaccagcggcctgcaggctggcctcaagcagagccacctcagtaaggtgaggaacctctctggccaagcacaggccccctgggacagctaggatttgggggtgcctgccaccggggctctgtaaccctcggtgcccaggccaaagctggggtggtggcaggggttggtcttgctcagggtggagtagcaacagcctattgtcctccatccactctgcatcaagcacctagcactgccagcattccgggctttctgtcacttcctctctctacagcccaggctgtgggtgctactggccccatctgacagatgagaaaaccgaggctcaaataaaatggagcaattggccctaggtcttatagctagaaagtagcagaagcaagatttgaacctgaaactgttcgctttccctcagggctggggggcagtggcaggggggcggggtgggtgcttcctctggcccccagggagtgacctgttccacctctccatttctcccaggcaatcggctcttccccgctggggtccggagaagggctcctgggcctcagccccgggcctaatggtcacagccacctgctgaaggtacgggcagggggtggggacatgcagggctgggaagccccggccccccagcggcccctgacccgccccgccctgccctctgtctccagaccccactgggcggccagaaacgcagctttgcccacctgctgccctcgcccgagcccagcccagaaggcagctatgtgggccagcactcccagggcctcggcggccactacgcggactcctacctgaagcggaagaggattttctaagtggctggcaccagagataactcaagggcctgcaccaaatcgcttttgggttttctgatgttttgttttgtgttttttttaaaccattttctctctttcggtaatagaaaaatctctgaaagactttactgaccaatcagccggagccccaggagcccaaggggtgtgggggagtctggaggcctcattatgtctctggcttgctccccacgctgaaaccctgcagccttaagagagaggggccccggcctgctctccctccctccccccatctcctcctccgctgtgcccgtctctccggagccctcctgcctcattgctcctgtaattttggcctttcgagtgccttggaggtttccctgacctcccgtgaagatacagagactgtctcctttttttttaactttgacaactgacttctgtttccttttctaagttttatttttcaaaccaccccggacagcccccagctctgattccttcaaggcccggcctgtccgggccaccattccacaccttgcggtttgaaacagctgtttttcccacatttgctgcaggcatggctgtctcctgcccctgcctgcccatctggcctataccccagccgtggggcccggggtccctgccgcagccccctccccttctgatgccttaaaagctgggccccaggccctgctggccagagc

SEQ ID NO: 90805 - DNA, 1658 bp, Homo sapiens
aaagatgcaaatatacacacagagacatagacacacaaagacataagacaaagacacacacatagacacagacacacatatagacacaagacagactcatgcacacagaaacaaagacacagatatacacgcacacacacacacagacacacacacacatagacatacacccatgctccgtcctgtctggtgtggttccctggattctaagtcaggtgtgtctgtctggtggtaactgacagaatatgtgagcctgtgggtctggccttctgtgactaaaagtggctgaaacactgtgtggctgtcccattccatgtggctgcagttgatactgtgctgcaatcattggccagggaactggggcctggagctcaggagaccctcggtcaccatggctgatgggacagtgatagagttggagtgtggcgggcactggggaaccctgtgcctgtctgcccaggatcggccgtgccctggagttggggtgtgtctgccaagactctgggccacacctgtctgcttccctgggccaccctgcccccatctgcaactgtctgtgctctgtccctagaagcccggcatcctgggagactcacccctgggcgccctccagcctggggcccagccagccaaccccctcctcggggagctgcctgcaggtaacgcagaccctgcccacacggtgtcccccagccacttccccttccttccctgctacgtggcctcgggtgagtgacccaacctctgggtcccagcgcccttgtccatcagttgggtgccctccactcagggcccagggatgagctctgctcagtggccagcatggatttgtctcttgacccctgggccctggtccaggtgggagctggagggccctggggagaggggtcctgtgagcctgggcccctgaaatcctccttccctccctaggagggggcctgcccccggagctgccgccccggcgagggaagccaccacccctgctgccatccgtgcttggccctgctgggggtgaccgggaggccctgggcttgggtcccccagcggcccagctcactcctccccccgcccctgtggggctccgaggctctggcctcagaggcctccagaaagacagtgggcctctgccgacgccccctggggtaaggccctgccctgcgcgcggcaccacaccagcctcctgttccgcagggttccctctcccgggggccctctcgaatcctgccttcccgccacaggtctcactgctgggggagccccccaaggactaccggattcccctgaatccctacctgaacctacacagcctgctcccggccagcaacctggcgggtaaggaggcccggggctggggaggcgccgggagaagccgccgcccagctgagggccccccaactaaccccccagcccctggaggtggcagcagcagcagcaaagccttccagctcaagtcccgcctgctcagccccctcagcagcgcccgcctgccccccgaaccaggactgtctgacagctacagcttcgactacccctcggtgagtgcctggctgcagctctctgtcccctaaggccaaatcattctccaaactgatatttctctaggattgactatgccaggccatgtgctagggaggcggcagggaacgtgccagatatgg

SEQ ID NO: 90806 - DNA, 1032 bp, Homo sapiens
ggtgagacttcctttgtctttccctgaccccactatcctgctgtggagagggcagcccccaccagccctggtttttccttctaggtctatcatctcatgaagaactgctgggagacagaggcgtcctttcgcccaaccttcgagaacctcatacccattctgaagacagtccatgagaagtaccaaggccaggccccttcagtgttcagcgtgtgctgaggcacaatggcagccctgcctgggaggactggaccaggcagtggctgcagagggagcctcctgctccctgctccaggatgaaaccaagagggggatgtcagcctcacccacaccgtgtgccttactcctgtctagagaccccacctctgtgaacttatttttctttcttggccgtgagcctaaccatgatcttgagggacccaacatttgtaggggcactaatccagcccttaaatcccccagcttccaaacttgaggcccaccatctccaccatctggtaataaactcatgttttctctgctggagcctgtgatttttggagccctcttcaagaaagctgggttagctgggagtctggtctcctgtggacagcagctagcatgagacagcgcagaggtggctggattcaactgtttaacttttttttttttttctttttgagacagagtcttgctctgtcgcccaggctggagtgcagtggcgtgatctaggctcactgcaagctccgcctcctgggttcacaccattctcctgcctcagcctcccgagtagctgggactacaggtgaccgcctccatgcctggctaattttttgtatttttagtagagttgaggtttcaccttattggccaggctggtcttgaactcctgacctcaggtgatccacctgcctccgcctcccaaagtgctgggattacaggtgtgagccattgcgcctggccaataactacttgttgaatacacaaagtatttggtcggggcggtcacaagccacatagattagactgccagtttcaccctttcacatttgt

SEQ ID NO: 90807 - DNA, 1156 bp, Homo sapiens
gggaccacgcacagccggctcggcccctcccaactcgccctcctgcccagctttgctcgtctagccccgtccctgctttctggctcagcctccttttgcttggtgccacgtgccatccggccctctccagcggccgggtagccaccggcctgacctgactgtcccccagccctcctggctgctcaggtcctgccgccgcccccggccgaaccccgccccactgaaactcacgagccctgccccgtccccagggcatggcctatctgcacgcgcagcactacatccaccgagacctagccgcgcgcaacgtgctgctggacaacgacaggctggtcaagatcggggactttggcctagccaaggccgtgcccgaaggccacgagtactaccgcgtgcgcgaggatggggacagccccgtgttctggtgaccaggcggggtgcagtctgagggggtgctggggtcacttggaacaggcagggtggagtagacggatgctgggtatcatgatagggcatgatcccagtgaagcgcggcggggcctagcggtgcgggggtggggcctatggaggcaaggggcggtgtatagagtgcggcttggcctggtgggcggggttaacccggcctagccaatgagcggcctagccaatgagcatatcaccccgctcaggctgcgctcttaagggtgggtcccaactgagcccagagggtccttcagtctcaggtgagggcttcagcctggtctgatccccaagccctcagtgcagccccccgtggcctgagtgcccccctccccctaggtatgccccagagtgcctgaaggagtataagttctactatgcgtcagatgtctggtccttcggggtgaccctgtatgagctgctgacgcactgtgactccagccagagcccccccacggtgagagccaggcccgcagccccaccgggagtttgctagagcaattagaaaggcataggctgggccaggcgcggtggctcaagcctgtaatcccagcactttgggaggccgaggcgggcggatcacgaggtcaggagatcgagaccaacctggctaacacggtgaaacccgtctctactaaaaatacaaaaaaaattagccaggcgtggtggcgggcgcctgtagtcccagctactcagg

SEQ ID NO: 90808 - DNA, 1062 bp, Homo sapiens
tcaccatattgaccaggctggtctcgaactcctgaacttgtgatccgcccgcctcagcctcccaaagtgctgggattacaggcgtgagccaccgcgcccggctgtatttttttttttagtagtgatggagtttcatcatgttgggcaggctgcccttgaactcctgacctcaggtgatccacctgcctcagcctcccaaagtgctgggattacaggcgtgagccactacgcccagcccacctttctctcttgaacttcaacttcttccgtgccccatcccacttggaccccaatgccctcatccaccgctgcctctgctgcattccgcatttcttctctccccaaactcactttcaacccagaccaaactccacccacacctctgccctgacacctccccagccacatgccaagtccctccctggcgtctcccccaattccccgccatccagagggcagaagcaggcaggttgccccagagcagctgtgtctttacagatatcatggtgacagagtacgtggagcacggacccctggatgtgtggctgcggagggagcggggccatgtgcccatggcttggaagatggtggtggcccagcagctggccagcgccctcagctacctggtgtgtggcctgtgtgtggggcctgggtcggtcagggagggccaggagcccaggagttcgagaccagcctgggcaacagggcgagaccccatcttttttgtttgttttgttttaggtggagtttcgccctgtcacccaggctggagtgcaatggcatgatctcggctcactgcaaccttcgcctcccgggttcaaatgattctcccgcctcagcctcccaagtagctgggattataggctcctgccatcacgcccagctaatttttgtatttttagtagagatggggtttcaccatgttggtcaggctggtctcgaacttctgacctcgtgatccatccgcctcagcctcccaaagtgctgggattccaggcgtgagccaccacgcccagctggccccatcttttaaaaataaacaaatagccaggtgtggtggct

SEQ ID NO: 90809 - DNA, 1057 bp, Homo sapiens
tgctgggattacacacatgagccaccatgtgtggccccccccttttttttttttaagagatgggatctggctctgtcacccaggctggagtgcagtggcacaatcatagctcactgcagcctctaacctctgggctcaagtgattctcctgcctcaacctcctgagtagctcaaattacagccaagagacacacactgcatctggctatccaccaccagtccttttatttattttttttttgagaccgagtcttgctctgttgcccaagcttaaatgcagtggcacgatctcggctcactgcaacctccatctcccaggttcaagcgattctcctgcctcagcctcctgtacaggcatgcaccaccacacctggctaatgaagtgtattaactcatttgatgtccctgacatgcctctgggtttgggactaaatagtcacatcttgcagaggaggaaactgaggcacagtggggttaaggggccgcccaggatcacacagtgatggagctggggcttgaactcagcccgtctggtgccagccttcatgtgtgtaagttactcctctgtatcctctcaggccagcaccgagtgtcccatttggggctgctcctgagaattttctagagaacacaggttcacacacgtgcccaaaggagcgtagaatttttgtggaaagattcccaggaggctgagtgcggtagcctcatgcctgtaatcccagcactttgggaggccaaggcgggtggatcacctgaggtcaggagttcgagaccagcctggccaagatggtgaaaccccgtgtctacaaaaaatacaaaaattagctgggcgtggtggcaggcgcctctaatcccagctactcgggaggctgaggcaggagaatcccttgaacccaggaggcagaggttgcagtgagccaagatcgtgccattgtactccagcctgggcgacaagaggaaaaactctgtctcaaaaaaaaaagatttcccaggaaatccatctcatggttgttttgaggaggagactggctgttccctgaactttctcactcatgaa

SEQ ID NO: 90810 - DNA, 1045 bp, Homo sapiens
atgcagcgctgcattgactctggcctctgggtccccaactctaaggccagcgaggccaaggagggagaggaggcaggtcctggggacccattactggaagctgttcccaagacgggcgatgagaaggatgtcagtgtgtgacctgccccagctaccaccgccacctgcttccaggcccctatgtgccccttttcagaaaacagatagatgccatctcgcccgctcctgacttcctctacttgcgctgctcggcccagcctggggggcccgcccagccctccctggcctctccactgtctccactctccagcgcccattcaagtctctgctttgagtcaaggggcttcactgcctgcagccccccatcagcattatgccaaaggcccgggggtccggggaagggcagaggtcaccaggctggtctaccaggtagttggggagggtccccagccaaggggccggctctcgtcactgggctctgttttcactgttcgtctgctgtctgtgtcttctatttggcaaacagcaatgatcttccaataaaagatttcagatgctctctgggctgctgggagggccgttcaggcagcccatctcttgtaggtgggagggaaacttggtgggatattgggggctgagctgtgcttctctggtcctttgcccaccagccatcgtgggtcctcgcctcacacatgctgttccacaacttggaacagtcttcttccagaggcctcaaaagcccccaaccttcagtctcacccacccactcccttgtccctacttggacctccagaatgcagggtggcccaagctgatcaccaccagagggcagtagtgatctgcaaaccaagtcacattccctagggttttgtggatctggcgcacctgcccgcaccccacacctttccagcttcctacaaccttttggagcagcatcctggatggactatatctccccaccctatggccagcgctgcccccaaacagatttttttttttttttttttttgagagtccagctatcacccaggctggagtgcggtgg

SEQ ID NO: 90811 - DNA, 1050 bp, Homo sapiens
tgttttcgaactcctgacctcgtgatccgcccgcctcggcctcccaaagtgctgggattacaggcgtgagccaccgcgcccggcctagcctctaggatttttaacctgcgtacctggaggaacagggctatccttaccgagattagggagaccaaggacaaggcaggctgggaggtggccatgttgagttagaggtgcccatgcagggacactgaggacatgagtgtctcagatctgcagtagagcagggctcccaagcaggtggtctttggcaaatgccagatgaggtccccggcgggggagcccaggccttggggagcccttcatgtaggtcaggaatagacttggggaaccgtggggcgcctctgaggagctgtggctggagggtcctgggccccccagtccctcctgagcgttgggccaggtccagtgagcactgcccaacccccatagacagccgatcgccagtacatggagggcttcaacgacgagctggaagccttcaaggagcgtgtgcggggccgtgccaagctgcgcatcgagaaggccatgaaggagtacgaggaggaggagcgcaagaagcggctcggccccggcggcctggaccccgtcgaggtctacgagtccctccctgaggtggggctccccggcccaggcgggcagcaggaagaccctgagcgggaccccccagggccacagggacccagcccctgaccccagcccctctgtacccccaggaactccagaagtgcttcgatgtgaaggacgtgcagatgctgcaggacgccatcagcaagatggaccccaccgtgagtaacccccgcgccccatgccttcccggcgggccgtgtgtctcccccagccctgtgtcccaagtctctgaagccggctggtgaaagtgcccctccaaggcttctccaaggagtaaggggggtcgtgtcaccttggcacacacccacatatattgagcacctactgtatcccagtatccagcagataaatgctgagctttgagcgcatgtccttcgtgactgtcactgttactgtgac

SEQ ID NO: 90812 - DNA, 1487 bp, Homo sapiens
aaggaggagcggagctgggagcagaagctggaggagatgcgcaagaaggagaagagcatgccctggaacgtggacacgctcagcaaagacggcttcagcaaggtgtgcggggcgggcggggcgggcagtgcgcatgcgcagccagagagcctgcaaccaggacgcatgcgcacccaatgcctggtcaggggaggaccccggtggtgtagttgaagagtgtggtggggggcggggagctgagggatggacgggggccacgtgggaggggggacaggcttggggggccgggcggatgaaacaccccaccggtcccctcctctgatctgccccaaggcccatgcccacgctcccgccaccttgatgctcatggcttcgtcaccacctccgccgtggatgggatgggcgctgcgaccacggcccgcccggccgcgctcgaggcgctccgcagccttgccccagcccactccccctctcaccctaccacagagcatggtaaataccaagcccgagaagacggaggaggactcagaggaggtgagggagcagaaacacaagaccttcgtggaaaaatacgagaaacagatcaagcactttggtgagtggggcttgtgggttatggggggcaaggtcgaggcaggccctttgcctccagggccctccagcaccttgccagcatcttcccacaggcatgcttcgccgctgggatgacagccaaaagtacctgtcagacaacgtccacctggtgtgcgaggagacagccaattacctggtcatttggtgcattgacctagaggtggaggaggtgagtggagctttccccgggactgtgaaaaggcgctgccatgaggccgccacttggtgacgctgtgcctgttcttcctggcagaaatgtgcactcatggagcaggtggcccaccagacaatcgtcatgcaatttatcctggagctggccaagagcctaaaggtggacccccgggcctgcttccggcagttcttcactaagattaaggtagggtccctgagctgccaggtggctggaggccccctccccagggaaccagcccacaatgctctaggtaaggccgactcctctccactgggactcaagcccctccagtcaccgcatcctagatcaggagagggtggggccagggaggaggagagaagtgggcagattctgccagactttaaaagtggaggccgggcgcagtggctcacgcctgtaatcccagcactttgggaggctgaggtgggcagatcacctgaggttggaagtttgagaccagcctaacatggagaaacctcatctctactgaaaatacaaaattagccgggcatggtggtgtgtgcctgtaatcccagctactcggggggctgaggcaggagaatcgcttgaacctgggaggcagaggttgctgtgagccgagatcgtgccattgcacttcagcctaggcaacaagagcgaaattccatctcaaaaataaata

SEQ ID NO: 90813 - DNA, 1035 bp, Homo sapiens
gccatgatggaccgactgactgacactctggcaaccagtccggtgtctgcttccagatcggattaaccgtttaactccttcgtgcctgtgcgcgccgcggccaagcagggtgctttgaagacagacgagttccagcgccccctcccagcccggagcggggatctgcgtgggcgggaagggcccccctccttaggtagctgccccccgctggcccggacggaggaggaggggggcggcgctgacagccgcggcgggcggggggcggggaggggcgggacggggcggaggagccggggctggcgccgagcgggccgcggaacgcggagcgcggagcgcggagagcgccgccgggcactgagcagagctccaggcgccgaaaggaagctgcagagcccggcccgggggcgattggcccgcagcgcccccgggtctgtccccggggcgccatggccctaccgcggccgggcgcacccgcggggccctgggctcgctggcttgcgcgcagctgagcggggtgtaggttggaagggccagggccccctggggcgcaagtgggggccggcgccatggaacccccgaccgtcccctcggaaaggagcctgtctctgtcactgcccgggccccgggagggccaggccaccctgaagcctcccccgcagcacctgtggcggcagcctcggacccccatccgtatccagcagcgcggctactccgacagcgcggagcgcgccgagcgggagcggcagccgcaccggcccatagagcgcgccgatgccatggacaccagcgaccggcccggcctgcgcacgacccgcatgtcctggccctcgtccttccatggcactggcaccggcagcggcggcgcgggcggaggcagcagcaggcggtaagactccccgcggcggatgcgcgcggaacggatgggcgcgcagggaggaggcaactcgagctgccggccgcagggggcgctaggatgcgggtggggtcggtttggctggcgggggcggagggaattcggctgcgggggcgtctggg

SEQ ID NO: 90814 - DNA, 2086 bp, Homo sapiens
gtggccctcgccaggggcggggtttgctgagttggaggcggtgttggccaggctgggggcggaactaactaggctggaggaggggctggctggcctgggggcggggctggctggcctggaaaggggatggccgggcaggaggcggggctgggggcggggctggctgggctggaaaggggatggccgggcaggaggcggggctggctgggctggaaaggggatgaacgggcaggaggcggggctgggggcggggctggctgggctggaaaggggatggccgggctggggtagagctgactgggctggaggcgaggctggccgggctggggaggggttagctagttgggggcggagctggccctcctgcggttggagctgcacacgtgggccctcccctgacctccgggctgggctgcagattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgggcggggctggggcgggacggagcgggaaaggaagcctaggagtcgagggctttggggaggagtgggtctgagtcccagaggaaccctcaacctggacagagcgggcggcttctacctggtgaaaacttcagaggcccgggtcagtctggggggcgggtgtcagcggccccagtgacgcccccttgcccgcaggtgctggccacggacatgtccaagcacatgaccctcctggctgacctgaagaccatggtggagaccaagaaagtgaccagctcaggggtcctcctgctagataactactccgaccgcatccaggtgcccccacgccccatcatctaaggagggaggacactcccccagccacacctttaggtctgggtagctaactgccccttcctcagcctctttctcccaagtggcccatcttcctgtgtccttctttctttttttttgtttgtttgtttttgagacggagtcttgctcttgttgcccaggctggaatgcaatggcgccatcttggctcaccacaacctccgcctcccgcctcccgcctcccgcctcccgggttcaagcgattctcctgtctcagcctgccgagtagctgggatcacaggcatgcgccaccatgcccagctaattttgtacttttagtagagagggtttctccatgtctgtcaggctggtctcgaactcccgacctcaggtgatccccccccgccccccgccttggcctcccaaagtgctgggattacaggcgtgagccaccgcgctcagccctctttttttaaatttatttttatttactttgtatgtttaaaggagagttggggtctcactatgtcacccagtctggtctcaaactcctgagctgaagttatcctcctgtcttggcctgccaaagtgctgggatagctggcgtgagccaccacacctgacctctttctgtctgtccccttctccatcttcactttccaatcccatctctccttcccatctctcccaccatttcctcccatttcccccaattcctcctttcttctcatcaactccttccaggtcccctgtccctctccctaaccatcttctcttccctcaccccccttccgactcctcccatattttctccatctcccacacacctctccccgttacctcctctgttctctgttctccccaccttctctccctactccctccctccccaggtgggagataagaaagcctgaaagctgggtgtggtggctcacgcctataatctcaactactccagaggctgaggcaggaggactgtttgaggccaggagtttgagaccagccagagcaacattgcaagatcctcttttcctttcctttcctgtcctgtcctgtcctgtcctttcctttccttcttctttctctttcttcttttctgtttttggttttttttttttgagatcgggtctctctgtcacccaggctagagggcacggatcttggttccctgcaaactccgcctcctgggctgcagca

SEQ ID NO: 90815 - DNA, 1026 bp, Homo sapiens
gctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacg

SEQ ID NO: 90816 - DNA, 1075 bp, Homo sapiens
ggtgataactatatggaaaagaataaaagagggaagggagccttgtgattttaagtaaagaggtcaaacattacagctcttttagaatttgtctcaggttttctggttctcactggaaaaccccccacgcaaaaaatattttaaaacaggagccaagcagtggctcatgtccataatctcagtactttgggaggccgaagcgggaggatcacgaggtcaggagatcgagaccatcctgattaacacaatgaaaccccatctccattaaaaatacaaaaattagccaggagtggtggcggacgcctgtagtcccagctactcgggaggctgaggcaggagaatggcatgaacccaggaggtggagcttgcagtgagctgagatcatgccactgcactccagcctgagtgacagagcaagactccgtctcaaaaaaaaaaaaaaaaaaaaagccacatgcatcactgctgaaagagtgctccaagcagcaggggcagcaagcgcaaaggccctgaggtgggagtgtctgaaataggtgaggaggcccctgtggctgcagcagagtgtgggaggaggatatgaggtcaaggtgggggatatcccgacatcaagaaggtggtgtggacaaatagtgccgggctctgtgggtcactgggaaaactggcttttattcggatgcaaatacataggggactttccagcctcagggtctctgtcttgctgttccttttgcctggagcacttctcctctggctcctcatttgcctggtggctgcagaggcgcttttctaggctctgctgctaccctcatctgcccttcattgggttactgtttttttaaagttgtgtagaggctgggtgcagtggctcatgcctgtaatcccaacgctttgggagaccgaggtgggtggatcacctgaggtcgggagttcaagaccagcctggccaacatgggaaaaccccatctctgctaaaaatacaaaaattagccgggcgtggtggcatacacctgtaatcccagctacttgggtggctgaggcaggaaatttgcttgaacctgggaagcggaggttgcag

SEQ ID NO: 90817 - DNA, 1075 bp, Homo sapiens
ctcgaggcctctgttcctctttcacccccagccctgcccaaccgcccccctcaccccactccagctttcctcttgctcaccctggtcagctctgagcagagtgtctcaaactccttcctgtctccagcatagaagcccacggtacagcttgggtccatcttggcaaaggccatcttgcggggcgaggtgcagtggaaggactggggcagacagacgaggaaggctcagaggctgggctgcccacccgccatggccccaaccacacactggggctcccactcacctccagggggaagtcggcctggctgacatccacagtgggctggcagtagtgagggtccaggtacagcaggaagtcatctgcagggggtgcaggtgtgagtgggggtgcggtggggggtgggaggagtgaggagggggtgggcctaccttggtagccaatgaagtacagtgagtgtcgcggtttcccacccatgatgcccaggcacagctcgcaacgcaggagttcctgcagggaggagggtaggcaggtgctgtcaggcagccactcaacaaacgcttggcaaacacctcctctgtgagaacccagcctctggagggcagcagtgatcaagaccacaaaacccttgccctcaggagctgacatcctagtgtgagagactaacaaggaagatgattacatgaattttttttttttttttttttttgagacggagtctcactctgtcacccagcctggagtgcagtggcccaattggctcaccgcaacctccgcctcctaagttcaagcgattctcctgcctcagcttctcaagtagctgggattacaggcacccgccaccacacccgggttaattttttgtatttttagtaaaaatggggtttcaccatgttagccaggctggtctggaactcctcctaacctcaggtgatctgcccgtctcggcctcctaaagtgctgggattacaggctggagtgcagtagcacgatcttggctcaccgaaacctccatctcctgggttcaagcagttctcctgcctcagcctcccgagcagctgggattacaggcgcccg

SEQ ID NO: 90818 - DNA, 1378 bp, Homo sapiens
tgggcaccacaggggcgaaggtgggtaggacggcgaagaactgtggatatgtggaactgaatggcggccagtacatcacagggtagacagcaggggagttggcggaggatcctggacatgcagggcctcccacctcaggagctaggtgctgggagggctgtagggagccctagctgtaggagtaaagttgccaaggagggggtcattggcggcatcgtagggggctcagctcctatgtctcgagtgggctctggtaaccgccagccctgaccctgcagaagtgctttggggacgagtactacggggccgtggaggaggagaagccacaatttgaggaagaagaagggcttgaaggtgagatcagctggggcactgggctggggattggggactggggactgggactgaagcccaaggtcccaccctggccccacctgtctgttctccctgcatccagacgactggaactgggacacgtgggacgggcctgagcaggagggagactggagccagcaggagctgcactgtgaggaccccaacttcaacgtaggtatcacgggttgagggagtcccaggggccctgacggggggctggtgggatctgacctgtgcgtcctggcagatggacgccgactacgaccccagccagccgaggaagaaaaagcgcgaggcccccttgacgggcaagaagaagcgcaagtcgcccttcgccgcggccgtggggcaggagaagcccgtgtttgaacccggtgaggcccaggtgggcaggccgtgggtaggcagggggcaccgcggggcctggcatagcccagcagcctggctctgtctcgagcaggggacaagacgttcgaggagtacctggatgagtattaccggctggactacgaggacatcatcgacgacctgccctgtcgcttcaagtaccgcacagtggtgccctgtgactttggcctcagcactgaggaggtaggggccccgggcaggcagggacactgcagggggcaccaggtatgccgaaggggtagaaagctggccctgagtcccaatctctgttgctcagaaatgccacaacatggcaggctgtttcttcatcttgaaaatgataatattcggttgggcgcagtggctcatgcctgtaatcgcagcactttgggagaccgaggcaagtggatcacctgaggtcaggagttcgagaccagcctggccaacgtggtgaaactccgtctctactaaaaatacaaaaaaattagccaggcatggtggcaggcgcctgtagtcccagctacttgggaggctgaggcaggagaatcgcttgaacccaggaggcagaggttgcaatgagccgagattgcaccactgcactccagcctaggtgaca

SEQ ID NO: 90819 - DNA, 1045 bp, Homo sapiens
caaacgctatgaggaggaggaagaggaggaggaagatgaagaggaaatggaggaagaggaggggtgagccactgcatctccccaggacctagattttgggtgcgcttcatgaagtattcccaggcggcactggccaggaggcagagggcaccatgtgtgtatttttttcacagatggtggcagagttagtcttctgtaaggcagagccacagagtataggctctggagccaggtggcactgcctcaaatcctggttcggcttcaagactttcatgcctcagtttccccatctgtaaaatgaggacaatagcagcgtgcaccttgtagggttcttgtgaggattaaatgagttcatacgcttcgtacccaggcgtgcaggaaaggggggctcgacctcacttggctggccccctggcatcaccacatcttgcccctcagggtccacggtcccccagtccagctggctgtggacgactcctcagacgaaggggagctgtttctgaagaaacaggaggactttgaacagaagtacaatttccgtttcgaggagccggactcagcatcggtgtgtggctggggctggggaggactcagcccccagggttcaggcccagggaaccccacatcatctctgcggcccttgtgggcttttctgattgcgcctaggtcaagacctacccacgcagcatcgcgtcctccgtgcgccgtaaggatgagcgcagaaaggagaagagggaagagactcgggagcgaaagaagagggtgagtgtggggggtgagctggggaggaccccccagccctggaggaaagcccatgccctccccctctctgcctgggcctgcaggagaaagcaaagaagcaggaagagctcaagcagctgaagaacctgaagaggaaggagattctggccaagctggagaagctgcggaaagtaacaggcaacgagatgctgggcctcgaggagggggaccttgaagacgacttcgaccctgcccagcacgaccagctcatgcaggtgcggccctcatcccggcccaacatgac

SEQ ID NO: 90820 - DNA, 1064 bp, Homo sapiens
cctcctacctcaggctcccgagtagctgaattacaagtgtgcctcaccaagcccagctaattttttaaattttttgtacagatgagggtcttcctatgttgcccaggctggtctggaactatttggcccaagctatcctcccgcctcagcctccggagtggctgggattacaggcccgcgccaccacgcccagcctcaatatctccttgacgatgaaatgcatagatgaatgaatgaatgaatgacctctgtttgctcaccatgcacaccctcaagagggttacttgagagctaagactggaaacaaaggttggggccccacccctcccgggccaggccccgcccccggtccccgccctcgccctctcgaggctcccattggaggaggcgcgcgggggctggcccggcgggaggggcggggccggggcccggggcggggcgctgcagcccgcggagcctcccgcccgcccgggctggggtcgcgctggctcggactccgctccccgccccgccgcggccatggaggacgagcggaaaaacggagcctacggtaggagccgcctccggtcaggggccgcctctgctgacctgcgggtgggaggaccttgagccagggggacatctgagaccctaggcaccggcgctgcggctggatggccctccgcgctcgggcccccgcatccgacactgcgcggatcccacgccccctgctctaaccgggtcgccccgcgtcccctccccgggagccccagctccccctccggctgatgggccggggctcacggcgcatgctccgcccggggaggtcccgttatctgggcggctcggatggcgggcgggggaggggaggcgcggcgatctgggctcggaaaagagacagggccctgacctcctcaaatccccctcctcttccaatcccctttgtccatttcttcctccttcccttttccgccagaagtagccgtccggggcttttggccagatggggaaactgaggcaagactgggcagaccgaatacccagctgagagcccaccgagtctggccagccgcctggaaacggcg

SEQ ID NO: 90821 - DNA, 1049 bp, Homo sapiens
taatcccagcactttgggaggctgcgaggcaggtggatcacctgaagtcaggcgtttgagaccagcctggccaacatggtgaaaccccgtctctactaaaaatacaaaaatgagccaggcgtggtggcacgtgcctgtagtcccagctcctccggaggctgaggcagaattgcttgaacctggaaggcagaggttgtagtgagccaagatcgtaccatggcactccagtctgggcaacagagtgagattccgtctcaaaaaaaaaaaaaaaagacggagagagagaaagaggattttgtgtggatggtggggccctgccagcgggggtgaggggttgggatgtcactaatccaaagagggtttctcagcaggggaaggatgtggtcccagcataggatggactcagggggtgggggctgctctgggaaggacacggagcagggacagctcgtttctccttgcccagacggtgatcgttggctcctacttgattgcacacggtttcttcagcgtctatggcatgtgtgtggacacgctgttcctctgcttctgtgagtgacccctcaccccaaaccttgctgggccccgaatcccttctttccactgggcatcacatcaccctccaacggggcaacacgcttgcctgcccccagcttccccagggcttggctgtccctcgtcctgggtccccagcctgtcttcctggtttccttttgcgcttagaagcagctccgacctcctgtccactggcccaggctgcagcctggacgctgccctggagcccgcccgcgcttcgcagtttctggctttgactggggggaggggatctgtggctgccactaactctggtctctccatctgttttttttgtttgtttttttcttctctcttcctctcctccatgcctgctggcttccctgttcttccctgcctccctctttccctcccttcccgaccaccccattttccccctgccggttcccggggggagcccaggtgaggacctggaaaggaatgacggctctcaggagcgaccctacttcatgtcg

SEQ ID NO: 90822 - DNA, 1044 bp, Homo sapiens
tgtccttgaggcccctgcccgtgggctcccctcatgcctcctgctctgggacctctctccacagtggaggacctggagaggaatgacggctcggccgagaggccttacttcatgtcttccaccctcaagaaactcttgaacaagaccaacaagaaggcagcggagtcctgaaggccccgtgctccccacctctcaaggagtctcatgccgcagggtgctcagtagctgggtctgttcccccagccccttgggctcacctgaagtcctatcactgccgctctgcccctccccatgagccagatcccaccagtttctggacgtggagagtctggggcatctccttcttatgccaaggggcgcttggagttttcatggctgcccctccagactgcgagaaacaagtaaaaacccattggggcctcttgatgtctgggatggcacgtggcccgacctccacaagctccctcatgcttcctgtcccccgcttacacgacaacgggccagaccacaggaaggacggtgtttgtgtctgagggagctgctggccacagtgaacacccacgtttattcctgcctgctccggccaggactgaaccccttctccacacctgaacagttggctcaagggccaccagaagcatttctttattattattattttttaacctggacatgcattaaagggtctattagctttctttccgtctgtctcaacagctgagatggggccgccaaggagtgccttccttttgctccctcctagctgggagtgacgggtgggagtgtgtgtgcccaggtgggggtgtctcctggctgggaaggagggaaagggagggagagttttgcgggggttggcagtggagagcaggctggagaggagatggctaatagctgtttaatggaaacctgctgggctggagggagttaggctgaatttcccgacttcctctgccagttattgacacagctctctttgtaagagaggaaagaaactaaacccacccaagggatgatgtcagggggagaggtggagggcagatgtcc

SEQ ID NO: 90823 - DNA, 1009 bp, Homo sapiens
gagatggggcttctccatgttggtcaggctggtctcgaactccgaacctcaggtgatccaccggcctcggtctcccagagttgtgggattacaggcgtgagccaccatgcccagccttctaggttctgtttattggatgctttttatcttaacaaagtcctggcagagaaagatttgatttgtttccatcaggaagtttggaatctgaggcagatagtggtttgagtgtcatcttcacacaatgaatgagtagagatttggggcctgggaggcacgaggcaaactttagtttcctactgaagcatttgtccgttttatctgaaacaagtagattgccgatctgtattattatacatagtaagctgctgttgaaatggttgtgaaagtagagtaggcaggtaggtggtggttagggggcctcatcggtgctgatttttaagaaatttttatgatatttatgatctgttataaatccttgtgaaacttttccatgagaacacttcacgggtgattccattatgaatagcaattggtggccgggtgcggtggctcacgcctgtaatcccagcactttgggaggctgaggtgggcggatcacgacgtcaggagttcgagaccagcctgaccagcatggtgaaaccccgtatctactaaaaaaaaaaagtacaaaattagccaggtacggtggcacacacctgcagtcccagctattcgggaggctgaggcagcgaatcgcttgtacgtaggaggcggaggttgcagtgagctgaggtcgtgccgctgcactccagcctgtgtgatggagcaagacttcgtatgaaaaaaaaataataacaattggaaattcagatacatttagcatcagctgtatttaggcatcgtgtaaaagtgatgtccagttaaaatttaatttaatttttttttttgagacagggtctcactctgtcacccaggctggagtgcagtcgcgtgatctccgctcactgcagcctctgtctctgaggctcaa

SEQ ID NO: 90824 - DNA, 1387 bp, Homo sapiens
aatggtaagtttgtttttgatcacagatactgtttcttcactcatgtacagagatgtttgtagccttttccaaagcatttgcttccattaccatttttattagcccttttggattataaagcaatattatctattctgtattccattctgatagtgtaggaacgaagtcagtgccccattactcccactgcccagagacaacagcttttcagtttgcttgtccctccttggttcttcagttgtgctcctgcaggctttgcttttacacacgagcgatatagcatcattctgaattgtgcagcttaaaagatgaacgttgggctgcttgctctctttacatcatttttaacttaattctcacatccctagcgtccaatgcgaatttttgtgaatgatgaccgccatgtgatggcaaagcattcttccgtttatccaacacaagaggagctggaggcagtccagaacatggtgtcccacacggagcgggcgctcaaagctgtgtccgactggatagacgagcaggaaaagggtagcagcgagcaggcagagtccgataacatggatgtgcccccagaggacgacagtaaagaaggggctgggtaagtgaggttttccgttgtccttttcttttttgtagggtagccagggtagaggttggcacctgttttctaagaaactccagcctctctggggacctctgggttgtggtcagactgaattcctcactgagctgggtgttggtctgtccctcagggaacagaagacggagcacatgaccagaaccctgcggggagtgatgcgggtgggcctggtggcaaagggcctcctactcaagggggacttggatctggagctggtgctgctgtgtaaggagaagcccacaaccgccctcctggacaaggtggccgacaacctggccatccagcttgctgtaagtgtggccaccactgccgggtaggtgggtgggggggtggtaggcatgctgattgaggatgtggggcccaggaagaagtgtcctgctaggctgtgctccaagaagcacatgccacacttgccctggcacttgctgtgcgtgtgccttctcagtaggtgacaaccaggacaccaccaagccacagagattctgtggaacctgactgcaggggtcataaggaccccgtgcctattgtgtgccaggctgcaccagcccgaggtcattgggcataaacttcacgtctaggctccattggatggatggctagatagatagcagagttgttatctcttccattggatccaaagctgaatgtaaagaattttttttttcttttgggacggagtctcgctctgttgcccaggcctagagtgcagtggctcgatctcagctcactgcaacctctgcctctga

SEQ ID NO: 90825 - DNA, 2700 bp, Homo sapiens
cctttatcttcatccttgaacgttctcaaacatgaatgtggaagttgcttttctatggagccattctctggctgtggagaagtgtccctggtgattccatggttttaaagatgagacaaccagatggtttctgcatgagcaccacgttggagtttaccaacagcctgtgctgcagctgagctgagggcctcttcgtttgtcctctgtcatggctcttttatcatttaaagtgacagaagcacaaagagctgatacagagttttggataaagttttaaactgttgtccaatttttcaaaccacatcattggacctcacgctaataatgtgctcgcagtccatggcccgccgctcgcatgcctgtcttcaggccttatccaaacccctggtgtgcagatggcagagaagataaacgctctgcttggccgcagcataggctggcatagcgcccttgttgctgtttacctttggttctcatagctgattccgactaccaaagcccttctagttgatcaacgtagggacgctggacctttgaccaacaggactctctctgtcaagggctggggctagggcagtcccgcctggtgggcggagttggtcccctttgctgcagatgccttgggatggctgttgtgtgatgcagagagggagttcatttcctctccctcggcctttttaaattttttcctattgaacattttagcatagctaatttattgggagaacatggggaggaggcaagggaagaggattagaagataggctccacctatctctcccctccctcatgagattattccttttagaataactccccacttttgtttttatgtttgttttattttttctttttctttcttttttctttttctttttatttttggagggggcctccaatttttacaatttcctcacagggcagagttgaatgtgctctagtttctccttccctggtccagggtggagatgaattcagcttctgggaaactcagctgccctttagaaagctgccacatcccctttccacctgacagaaaccccttggtcaaactgtgccttgtcttcttattccatccatgaatagaaacgctatcagtcaacgaccccccggacgttctggacaggcagaaatgccttgctgccttggcgtccctccgacacgccaagtggttccaggtttgcattttgttcttctatttgtcttttggtagagaattcctaagttttaacttggctaactgtcaccataaagattccttaacattgacgatagccgtgccgagcttagcacctgcagctgcgcaggtcctaaaggagtgcacctcaacaaattcgaccccaaaagaggctgagactgagttggtgggctgctgctgctgctgctgctttgtgttaagagtaacactctcttgtacacgtagtgacattgcggctggccacagccttggtggtcgccagtgttgactgtttacccttggcaaagcagcaacctgacacttgtgtcgttcatgttgacttgtgccctgggcggtgcctcagactgaagagcctgtgttttgttcccctaggccagagccaacgggctgaagtcttgtgtcattgtgatccgggtcttgagggacctgtgcactcgcgtgcccacctggggtcccctccgaggctgggtaaggcatgttgctgtggctactgggggtggtgtgtgcagagtcttttggatatcccaggaacacttgatggtcacggggcaggagtggcctcttgacgcgtggctggtgtgtactctccagagctgcctgtggagctgctcctgcttgccacacctggggttggggttggggcagtgtgggtcggggccctctgcagggtcgcacagctcaatcccaggagtgggggctgaccaggaggtgggaatgatccctctgggaaggtttgtagatagtctcacgcaggaccagtttttggcagttgcacccttttttttttcagcttgcagttgaggtggtttttatatttgtaaataaatggttagattttaagtaagaagtactacatcataaccttagcttggtctctgagctcacacagcctgctaggatgtcatgtctggtccttgaaggcccctgtcctagatgccctggctcaggcttagccctgaggctttgactttacccgactggttggctatgagtcccacgtgtgccccgacccactcatgcagtgacagctccccagtggcggccggccccatcctgtaggctcttggctcactgtccctcttccctttcagcctctcgagctcctgtgtgagaaatccattggcacggccaacagaccgatgggtgctggcgaggccctgcggagagtgctggagtgcctggcgtcgggcatcgtgatgccaggttggggccttgtgctttgcaggttgcagggaaaggacagggttccaggccgcctcctggcgggtacactgactgggttaggacagcagcagccccgtgtccaccccctagagctgaagcatgtgactaccctctggcaccatcatatccagccctgaccgggtccgcagccgtcattcagagggcggatccggggcagtggtgacccactcccacgtgactttcttgctctgagacacttgtgaattatttctgtcaagggctggacgccgagtgggtcaccgagctaggcatgtttt

SEQ ID NO: 90826 - DNA, 4558 bp, Homo sapiens
gctctcgtggagacctgccatcgtgctgatccagagccaccttgctattctctctgtagaggagaaggcagagcccccccaggctatgaatgccctgatgcggttgaaccagctgaagccagggctgcagtacaagctggtgtcccagactgggcccgtccatgcccccatctttaccatgtctgtggaggttgatggcaattcattcgaggcctctgggccctccaaaaagacggccaagctgcacgtggccgttaaggtgagtgtggccagcatcactgtcttctaatagcagaaccatggtctttgttttgggccccttctgagccattgtctctcagggagggcatgtagattctaaaaatacacatggttagatggcgagtatttgccaagtcacgtggcaagaacgccttcccactgtggctggcaggcagaggggtccccaaacatgattggggcattagggcctcctgggagcaggagctgaaaggaaacagccctcctccagatggcttcccgggtgggtgcctgtaggccatgaggaggccctgcatgcagccctgcttcactgggaccttgggggtcttgccacctctgcaggtgttacaggacatgggcttgccgacgggtgctgaaggcagggactcgagcaagggggaggactcggctgaggagaccgaggcgaagccagcagtggtggcccctgccccagtggtagaagctgtctccacccctagtgcggcctttccctcagatgccactgccgaggtgagcacatggtgggcgctgggagtgactgcctggacagagcaggcagccatgtgtcctgtcagtgaggtggttactggtccttgttaatttgccccaaaaagtggacctttcaggccagaagtccgcacaggaagctgggtgctgccctccgagccgtgtcggggagggccttgtggatgttgtcccagcatcctataggctacactggggtggccttgggttgataacgtgctgttcagaggggaggcacaggaagggggcacattgctggaaggccctcactagagtcagtggagactctggcaagggctggcagtgtatgaagagcagaggccctgcctcagtcctgccactcctcccatgtgactggaatgcccatagctgagtttgtcggtcttcttttctgttttccctgagaacgtaaaacagcaggggccgatcctgacaaagcacggcaagaacccagtcatggagctgaacgagaagaggcgtgggctcaagtacgagctcatctccgagaccgggggcagccacgacaagcgcttcgtcatggaggtgcgcagcctgaagctgcctgctggggcagtcccatggggaggcctggggtccccctgcccctggagggaggcactgagtcatctccatctgcactttccaggtcgaagtggatggacagaagttccaaggtgctggttccaacaaaaaggtggcgaaggcctacgctgctcttgctgccctagaaaagcttttccctgacacccctctcgcccttgatgccaacaaaaagaagagagccccagtacccgtcagagggggaccgaaatttgctgctaaggtgagcagtggcccttgaacctccttgcccaggcatgggttcttctgcaatgtgagcacgaagggaatgtcacttccctgtgttctcttctagccacataaccctggcttcggcatgggaggccccatgcacaacgaagtgcccccaccccccaaccttcgagggcggggaagaggcgggagcatccggggacgagggcgcgggcgaggatttggtggcgccaaccatggaggctacatgaatgccggtaagggccctcatactgcactgtccccgccttccccacgtgcatgctctgggaacaaatgtgtggggctcctggggtgggccggagacactgctggaccccggtaaccctgtctttccctttccaggtgctgggtatggaagctatgggtacggaggcaactcggcgacagcaggctacagtaagtgtgcgtttctgtctgtctgacctgggaagcagctgcagtgtagcgtctgggcctgagttagcaaagggtggccagagcagcctcgaggaggctgtagaaggggcacacacctttttgcggtgattaggtcagacggccctcgacccccaccccttcccggccccacagtgggattgattgtgttaatacacgaactcgtgtaactgcaaagttccttaaaagttagaattttaaatttctctgctttaagccatgcgaagcaccaatcttgtgaatacgcttttccggccagtgcacagctcttgtcttgagaaggagccttcattggggggttacaggagcagagaaatctaaaacatgaatttcaaatgtggcgctctgtgccctttttcaaaagaattctaatttcttctctctgctctgtctcccccttttgtaggtgactttttcacagactgctacggctatcatgattttgggtcttcctagagcgtctaaaagtattgcacacaaaatcaactttttactccaatttcctccaactccaaaacccaaagtgtccgtgctgtgtccctgtgcttcactgggtttctcaaccgtggcttttcaccgcagcttgtctgaaactcttagcctgcagaatttaagacaatggcagtttttatcgtgatttgcctttgaacttggtcctattgaagttcacaataagtggaaaacaattttttcagagaatgtatttttgtgcagaattgcacagaattctagagacagcgttgttcggcatcaaggcaaaagcccacctttgctttttatggaaagcattactttatttaaagagacagacaatgacgcattttaatctacctttgtcttaatttacagcaggttttgtatgaatttttaaccttttaacaaactcccaaatctggttgatgcctttgacagtgatgaaaacgatttcaccacatctgaatccagagaaaccggctttttttcttattgcgagcatgttaaaacgttgggaacatgtggggaattgtatattgcgctgaattaacttctcccgcctcttgtaatgctctggtgggttcttgtttgggaatgcgatattttgtggctggtttagctagagagtgaactctcaaaggtatcaaaactgtgcttccattattagtgcaagaaacagacaggctttaaggggtagatgacgtgaaattttgcaagtcttaattacagctgcagatgcatgggattctggatttttttgttgctttttagtttaatgggactttaaaagtaattgaggagaaagaaccgtgatgttccctgtttctccagtaaaggactggcttttgcttgggcagaggtggtgctgctgggtgtgcagctgccacagactccaaaggcgtagaagtttgtgccaacacacggagtcattctggctctctgctgaggcccctgttttctggcaggtgccctccttggaaactggttttggctctgatcagcggttctttttgcagcaaagcctgcatctgtgttgacttgcaagattttgcgtttattcaggcaaaaactggtcaaaatggttactacatgatttgttcccagaggtttgaaacattcagtgaaactttttaaaactttgattgcatgatgtattttttttttagaaagttattgtttgagaataatgtctttttataccaggaaaatagttatcctgaatgacgttgaaaactccccctcccctttatttttttttaatcaatacatgtgaaagtaacaagccctcggcccttgcgtcttcattcattcccggcttcaggcggggcgaggtggtgtgctcagtgcaggacactggggaagctggggctgtggggctgtggggtgtgggtcctggtgggggggttctgaagatcccatcctcccagtctcctcgctgagctgccgcatgttcgctttctggcattgtgggacacatcctcccccttggtgtcttggctttgtgatggcgggcgagggaggaggcctgcctgaagaacacaaactgaaggttgcagatagttctgtccacgttgtcatgcaggcagcccaccacaccagcgtggggtacacatctccagtgggtggaggcacgtgaggactcccagttaccctacccaggaggcggtgggcccttagtgtcctcaatctgggaaggaaggacaggcagcgtgggagcctccccttccctcccacccaccctgggcctggaggtctgggcagcctgactgggcaaaggtggctgcattcacaagccgacccgctctgagagcccaggaactcagctgcgcctggtgagcgcttgggcgttggccagcttggctggagagccaccaccatgacccagcctcccacctcacccaccctctgagccttcccacacccactgtggaggctccctgtgtggggctcccttgcaaggcttggggtgcagcattccctcagccagtgccgtcccctttgttccact

SEQ ID NO: 90827 - DNA, 3175 bp, Homo sapiens
ggaaggggcctcgggagtcattagggctgtaggtctaggcctcacccggctttcctgccccagccgtggccactgccctctgccagccaggctggggcttggtcacatcctgagtcacatgcttgcatgagtatcgcaagggaggtgcctgcatcattgactgagtctcgatttgtcttccaagaaccaaaccagctcagaccagttggtcttctcaggatgatgacggtccggggcctctttaaatagcatcttttaggggcctccaggcctgtgcctgtggagcctgttcccagcacagcagggaggaggggggtggctgctgcttctctggggctttgcttttcctgtcaccattggggatctctgggtagccgtcagctagctgtgaatgtcgtcccgcgctcggagtccatctcattgtaatgttgacatccgctgcaaaagctgctggcgcgtgctgcttggcaaagccccattgttgtcatcagctgctgggtgagtggagctgaaggctgggccagcccaaacggctgtgctaaggaccggagccactgctcctctccctccttgtcctactgcctctgacccgggcttgtgggtcagccttcaggacccatggctgccgcctgcccttccctcccttccccctgccctttcccgtcctccgcctgacccactgcctccctgtttaggtcagttctacagcaacggagggcattctgggaatgccagtggcggtggcggcgggggcggtggtggctcctccggctatggctcctactaccaaggtgacaactacaactcaccggtgcccccaaaacacgctgggaagaagcagccgcacgggggccagcagaagccctcctacggctcgggctaccagtcccaccagggccagcagcagtcctacaaccagagcccctacagcaactatggccctccacagggcaagcagaaaggctataaccatggacaaggcagctactcctactcgaactcctacaactctcccgggggcgggggcggatccgactacaactacgagagcaaattcagtgagttggcttccagagcccctcggccgggccagggtccaggccccagcagtgcagcccacggagtggcagaagctcggcactgcccagacctctggctgagggccttaggaggaggacaagtggtgctggctgcgggcgggtgctaggaagatggggcgtgggacctcatggtgccgtctccgccactctctctggtgtgttctccgaaggcagggtagctgaggcctctgtcccgaggccctggctgtgggtgaggctgcaaggtgacttcctgggacttgctctagagagttttgcatccagcccctgcaagagcctgacctctccgccaccgcctttccgcttcctcatgcgcagacccagcaggcccgggctgcaccagtgacccagtggggctgagtaggtgtgtccttgggacccagcagctgtcagcagcaggccagggacttgacagaggctgtgctggtgggtcagaagggggtgctgtgtgtctggtgctgctggctgaggagaggcggctgctggggtctcaagcacttcctcagctgctgctgggaagtttgggctgcaggaacagatgggaaggcaccccagagcagggctttggagcttggtgaccagcccagcccagggccaggtgaccctgcagggctccagctggcccctggtacttacctgatgggctgatgtgcgacattgaagcaggcagggagaagagttagaggcccagggtctgggccaggggccggccgcgtctgaggcgcaccacaaggcccccgggccgcccaaggtgtgtctttcctggggccccttaaccatcctgtcttctctcccccagactacagtggtagtggaggccgaagcggcgggaacagctacggctcaggcggggcatcctacaacccagggtcacacgggggctacggcggaggttctgggggcggctcctcataccaaggcaaacaaggtgggcctggagcccctggtggcacagcatggggggcctggcagctgctgtgaagcgggatatggacctggtgggagcagacagcagcgtgggcagggctgcagtggcaggtgggccctgtgagaacacgcactcggatgcactggcagctgctaaggctttcgggagcagccggagagccagcagtgtccccacgcttaacccctggtacctgtgtgaaatgtgggtgacaccaaggccaaacagctgttcccccggttctggccagtagctcagccttgggctcaggtagcttctcccagaaacgagggtcacagtggtcccacctctcagagtcttggtgccagcctgatccagtgatgtgtggtaggcaggcagagccgcacaggagcccataagtcttgcccacctgcatcctggccgaggcttgggtgtgggctgcctaacctgagccccgctggctgggcccctcggctctaatccaccactctctctcctaggaggctactcacagtcgaactacaactccccggggtccggccagaactacagtggccctcccagctcctaccagtcctcacaaggcggctatggcagaaacgcagaccacagcatgaactaccagtacagataagcccccgcggggcggagatttctaccttctgcacttactccccatcagaagatcgagttttatgcatcacagttaacatgtcagctggccctccaggcccccgcccccatcccgtccacgttgctgtgtcgtgaggtgcagcgggtcaccctgtggcccgtcctgtgacccatatttagccgtgtttgggactccgtgtcttcaatggtttgttagttgccattacaactttgtctgggtagagtttttgagtttttgcagttcagtatccctctgtctattcacacttcgtgttagtggtaactcagtttgtctttaaatagttacagaagggatacgtcatttgttaatgcttttgtgaagtgagttaaacgagctttctgtattttaatgctttagtgtttcagttttataagtgaagattttattttaaaaaccagtgggaaagagtggggggtttctttttatgtctgggtcattcaggcagtacatctgaattaagctgaatgtaga

SEQ ID NO: 90828 - DNA, 1072 bp, Homo sapiens
tgtaacaggataggattttaagctggggagaggcaggatcaaaggcacattctgtaaagctccttctggctgctgtataaacagaccgggaaagtcacgtgggagttagcaagacgggggatggggggatgctcttggggaagtccaacttgtccccatgtgacggcaggctttccccaagcattgcgggctttcccagtgatgttgcccccatctcaccatcaggctcggacatcatcatgcagctggacgacgtggttagcagtactgtgactgggccacgtgtggaggaggccatgtacaggtgtgtatatgctgtgtgcatgtgtgggatatgtggtgggaggggatcctggtccctgtagccttgtctcctaccccctcaccaggcccctggggcttgtgactggggccctgttgcaggtcaatccgctggctggaccggtgcattgcagcccatcagcggccggacaagcagaacctcttcgccattatccagggtgggctggacgcagatctccgggccacctgccttgaaggtagagccatgcgctggcaggcccagggcttggccatcgcggaggtccccacatgggcctggcgtatggcgggactggattgctaatgtgtagaagggcactgcgctagaaaaaatagccggagcaaaggctctcgggccacgtgcagtagaatgtattgagagaatggccatgattccagtagttaatgatcttctaggttttttgtttgtttgtttttgtttttttttttgagacggagtctcaggtgatccaccccccttggcctcccaaagtgctgggattatagtcatgagccaccgcgcccagcctatttatgtatttatttattttactttttttttttttggagggtggagtcttgcactgtcgcccaggctggagtgctgtggcgcgatctcggctcactgcaacctctgcctccctgcaacctccgcctcccgggttcaatctattctcctgcctcagcctcctgagtagctgggactacaggcacccgccaccaggcccggctaatttttgtatttttagta

SEQ ID NO: 90829 - DNA, 1397 bp, Homo sapiens
ctccgtctctggctctgtctgtctgtctctgtctgtttctctgactctctccctgagcgactctggaagtctgggcagggtgtgttctgggattgaagaccaggcgcatttcctcttctgtggccctcaccttaccctgtaccctcagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttgggtatgttgtggatagggaagccagagccctacctgtgggaagtggattcctggggaccccctaccctgcttggggaggtggcatttgggggaaacggacacaggtctgatctgaggagactaggaagacatggctgtcccttgggggccattctgagggaatatggcccagtctggggcagtgtgagggttgggaggggccctgggaagcccctgaggttctctgccccctcccgtcatggctgcaaccccagctatgccactgatctggtagtctgcgtggctcttggatgtgacatgttcgactgcgtcttccccacacggacagcggtgaggctctggcagaaggaggtcagggcgggagacgggtgggggactagggaggcaaggttaggggtggggggtggggagaatgaagccctgggtgacgcccctttccctgcccttcctctcccacagcgctttggctctgccctggtgcccactgggaacctgcagttgaggaagaaggtgtttgagaaggacttcggccccatagacccggagtgcacctgccccacgtgccaaaagtaggcaggatggcactgggagctggggcagggcatggaggggacagggcctggccgtgctgagctgtcccctgccgctctacaggcacagccgcgccttcctgcacgcactgctgcacagtgacaacacggccgcgctgcaccacctcacggtccacaacatcgcctaccaggtgagccagtgcccggggcaaggtgggcgggggtgtcctaggtgcgtatgccccacgctgacctcccctccccgcagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaacttacagagtgtgtctgtgtcttcttgaggaagtggcctgtctgggtc

SEQ ID NO: 90830 - DNA, 1289 bp, Homo sapiens
gccaacgtgcctttttcggaaacacccccttcctctcttgacaacttgctttctgccgctattggctgttgcacaacagtgacggttcttttgtccaataagtcagcaagacggtccccagggggaaggtttactcaaccataggcccgtgcctagtttttattggctagtgtatccgagtggcggtgcagcaggccagtcgcgtgcggcgcgagtgctttgggcgcagcccccggggccggggcgggaggtcgctcgggtcgggtgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccggtgagcgggcgcggcagggatcgcgggcgggtggcggcctagggcgcggagggcggaccgggaatggcgcgccgtgcgccgccggcgtaactgcggcgcttgcgtgcccgcggcggggaaccggacggggtcggggaggcgggccctgtgggacgccctgggcagaggactccctgcaggggctccggagcaggcccgggccccaggggcggtgtcacgggccagggcgccgtaggacaggaggtgcgctggaaccctgcggtccatctggtcccagctttcgtgggtgaagtctgccatctggttggccgtgggtctggggtagatccctcttctgctctttcgggctgtccatcagaggtgaaaccggccatctagatatctattggggcgaccgctgcggtctggctggcttgttcttgtatctggagctgcccccgccgtctggttggctgtctctctgtcctgggcaagcctccctgccaccaccatttggttgtccatctgtccagtcccacctggcagccccctgctgtctggctagctgtccagggtgacctctgctgtctggccgcccatccgtgcccctcacagactttaacactgagcagtccctctgttgggtgacaccagctggcctctactgtctgactggctagctgactcctaggggaccctgtttgattctctc

SEQ ID NO: 90831 - DNA, 1035 bp, Homo sapiens
ctggaatgacttgtggagaggtggaattggatgggatggtttccagagtggaattttagccattcaggcaagaggtagtcctggaaacagtcgtgtcaaactcaaatgttcccttgggactttgccggcacttggaaagtccagcatcaaaatctggcccaggaatcatgtttacgtgaggtttcccaaagcctgcagcagcagaggttgtccttaataacacaaatgacaataacggccagcatttgttgagtatttgccgtgtgccaggctcacccttatgaccaccctgtgagatcagggctgtgaccatcttcattcgacatgtcggaaactggggtccaggcctgtgacgttctggctttcccaggtgatgtgacctggaagtttcagggccaactggaccccaggtggcttgcagctgccagctgatgctctttcctggtggcagcctctgacctctgacctctgggctctttcaggcctacggaccatcggtgtcatcaccaagcttgacctgatggacgagggcaccgacgccagggacgtcttggagaacaagttgctcccgttgagaagaggtgtggctttgggggtgctggggaagcaggaggatgggtggggtccttatcattactgaaaccccagcacctgttccctgcctgcctggaagtcattgcttctccatttcaccgtaactccttctttcttttccctttgagctatgtatctttttcttctgatttgtatgcattcgtttttcaagtgcacaattaacacctgctggtttctgaaacattagaaaacaagtgtatagaaagaggaaactaaactcacccgcagccacacttcccccagacagccactggtgaatctgcagctcccagctccccagggtttataactttaattaatttttttattactttctattatgagccttcccttcccttttccttttcctttttgttttttgagacggagtttttgctcttgtcacccaagctatagtacagtggcacaatctcagctcac

SEQ ID NO: 90832 - DNA, 1781 bp, Homo sapiens
tacatgaatttatattcccaccaatatgatgagagagttggtgtcatgtcatgctttctgaaactgggttttaattaattaatttgtttgtttatttttattttttttgagacagggtcttgctctttcacccaggctggagtgcagtggtgcaatcacagctcactgcagcttcgaccttcctgggctcggatgatcctcccacctcagcctcccgagtagctgggactataggcgtgcaccagcccacctggccaatttttgtatttttagtagagatggggtctcactatgttgcccaggctggtctcaaactcctgggctcaagccatctgcctgccttggcctcccaaagtgctgagattacaggtgtgagccactgtatctggccagttttcaattttttaaataaaattttgacgagttaaatattctgccttgtgaatatagccacacgtgggagagaacgttccccagatgcacgcctgccacgggggcgccccgggtgcctccatgcatgtgcttggtttgtctcttctcagatggagtttgacgagaaggacttacgacgggagatcagctatgccattaagaacatccatggagtcaggcaagttccacgaggagagtcaccactgttccttcctctccgtggtgcgaccccccagctaattgggtcacccacacctctgagtccctaatcgttaggccttaagagggctcttggatggttttctgtagctgcgagcccctccctgagggtctccaagggcacatgagggtggatgtgtcttagtcctgcgtccattgcaggcttcagggctgtctgcagctcctgatcaaatagggcttagttcctgcccagtcggttggtgtgaacctcatgctaaactaagaatgctcactgcagatttgcctggggaggggcggggcggcactgaatcagggttttgggaagccagcatgagtccccatcatggcttcctcgtgagcctcttgggtcccctccttattctaacaaaggtagttgctccaggtgtctgcccttccatcgccgtggggtcctcgggtcaccctgagggtttccgggcagtggactcaggcatccgaccccacacatgacacaaccttcattccttgttggggacccggccagggccaatgaaattgctgaccatgctttgtttctctctgacttatctcccctgcccccgggtctggacggtttcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaaggtattgctccctcggcagggtgactcctgaccttgtggaaacgggggtacgggggtttggtatcaggctcccagcgcctcattggcccccactggtgccttttctccccatatcgctttgtgtccgtgaacttggcctctccccagaggctggggcaggagcatgtaggcctgggcccaggcacacaggggagtgccaggcctcctggactggccagacagatgcacagttgtccctgggaccctgataccaagcctagcatgtgtctgatgaaattggggtttcactgggctgttgctttgctgcctcctgggaagcagagagggaccccccgcgtcaactgctggaggctgagctccttgaagctccctggctgtcaccccttcttgaccaatgcccggcattctcaga

SEQ ID NO: 90833 - DNA, 1149 bp, Homo sapiens
ttgccagggaatttctgcttgagcccctctgttcttagtctggaaaagcccacatttgctgcttaagcttcttcgattagaaaagggagggggaaaacagtccaaacaggttggaaaacgctcgtcctagagccaggtgtcatggacatgaatgttagaggactccgcacaccttggctgtctgtctgtgcaatgacaaccccccgtggcccttctgtaactacaccccagaccgagcccacacccccaaaccccagacctctttgatccgaagcagcttccggggcaaatgcgggcgcaggctcccccatgcatggactaatcagatgactctcgtttcttctcttctctctgtctcctgtcctgcgtgtgtggcctgcactgtccctgggtgtctttctgcctcatcctgccctccgcatgacccaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaaggtaacaggttttgttctcatctccgcatttgtccccgtcctccccctccatgtgttagtctcaacccgagcatctggaaaattcagcctcggcaggaacccccttccgcctaccagttgtcacttagagatgtcgccaccttgcattggcagatggaatggggggagtggcatcacacgtgggttgtggctgcccgtgggggcggtcagcctttgttgttgccaaacgcattgcatttactaagcagtgccctttcctggaacccctagagaaaggggtttcccagccagcaccaaaacagcaaaacacaggaaacacatcatctgtatagccctgcatgttctcacagtctaggccacctgagagtaaccattccattttccccgactcgtggacttgacccacactgcagaagatgggactcccctgtgcatgaggtctggttaagttggtgctgcagatgaagcctggggaggtgggggcatttggcgagtgtgtgccacagatacagtgatcaggagtggttctctgcaaggagttcctatcgaggctgatggcccagatacccgccttaccattct

SEQ ID NO: 90834 - DNA, 1106 bp, Homo sapiens
agaacccctcctagagatgagccgaagtccctgactgggcctcccctgcctgtgggtggcagcccccggccctgtgctcccggccgccgggtgtgtgtgggctcacagcgctggtccccatctttggtttgctgctgttttcctcaccttgatgtctctgcttctcacacttcatccacagttccttctcacaatctctcctgtttttcctttgaccactctttcctctggattcctgggccttcccacttaccccagctgttactatactgagcagctggtgacctggtgggtattgcctgctgtgtgcctttgccctggtgtgtgaacggggtacgccctggctgggtggccccagccctgggtgggacatccctggggcccgctgaagagctacggggtgctctctcagagccagggccagtgctgggcctctgggccaggaccttgaccgcaccagctgtagcccctgctgtttcagagcctgcaggctggggaggtggagtccttaaacaaattgtcacaaggatgatgagagtaggaagagagggtaggggatagactatgggaaaggggagctgggaatgtggcctggagagatcttcctgaagaagtcaggtgatgccagggggacccagagaattggacccagggaaggaaggctaccagaccaggcaggtagaggtaagagagccagcggccaggccccatcgccaggagggccctgcaggtccaggggaggattttggattttcccccaagacaccaggatgcttctgattagatccaggcccaggagaggggccaccttgtgggctgctatttgagggagccctggcaaggatgggagccaggaggcccttaggaaatagcacctctggaacctcactgtcacccagccatcactgtggaggttggctcagctcagtgccacctccttcagatgctgttgatgaaaatccttcttgtgcttgaatgttctgggcttcccattgccctccaaatgtatattataaacagggcccaagcctggcgcagtggctcatgcctgtaatcccaatactttgcaggaggccaaggtgggtcgattgctggagcccaggagt

SEQ ID NO: 90835 - DNA, 1049 bp, Homo sapiens
aggggtgggggcggggactccaccatgtaccttgcacgatcatagagcctactggaaggaagaacgtaaccattgcatgatttatttttgcgcttgccgtaggtaatacatatgttgttgcttttttgtttcttgagataataatgaattaaatattaacaccatgaatatgattaatagcatgtaattttttttcttttgctgttttttcccctgctcttctcttctcctgtttttgtgcttttcctgctttttctttgtccccttcacgtcccttccatctcttttcctttgcctgctcttccctgatttacccacaaccctaactttgcatattcaaagggggagatcctggtaagtacatgcttagtgtggtagcaaacattagagaatctagtggtgatggagaccccgcccacccctaatattccctgttccccatcccctccaaataacaaaaatactaaaaatcgagctaacctggaaaccccatgccgcagccggcgctggactgcacgttgccctgggtataagtcgactcacacaggcactaactggaccgccacccttgaaggcgcacttctgcagccagttcctggcaggttttcctggtttcctgtaggtcagggatggcaaatacttacacaccgcccctgcctcccctcacatccctggctgtggaagatctcgcttaagccagaccagaattcattcttggcactgcccctcctccttctatctcctatgcagatgtcactcatggatcagagcatatttttccacatggcagaaatcttgccctcttgtgcccatggcagacatggctagttgatctagcactctttgccttgtgccgctcctctagcacacgcccatggcagacattgctaagcaatcctagcattctttccaaataagcttgccagcactcctgttctatagcagatgtggctaagtgattaaggtattgtttttctccctatatgataccctcttctctatgcatggcaggcatgactagtcaatcaggagcctctttcctagatgct

SEQ ID NO: 90836 - DNA, 1880 bp, Homo sapiens
ggcctgggtgtgcagatagggccatgggtggggcagtgacgggaggaattagttggcctcgggcttgtggttttcaggttcctcatgtgttccccccagtccctttgaatttgccaggccaagaccaggaacctgcttctcccttgtaccccaagaggtttaggggttcctcttttcctaccagaggccacatagcccagccccgtcatgagcgtggccgtggcctctgggtctcccatctgtggttcccatctctacccgggagactcaggccaggaccctcacccaggaaagagactggagcagcctgccagaggatccctgctttgccgccccctgcctgccctgccacccataccgccccatgtgcctgcctgcctgtcactgtgcaccctagcccgcaacggcctgccgcctcttctgtctctcccacccctacttccttctaagcccagtcccattgggatgtgtcccttggatgcaaacctgactttctgctgaggcctggctgctccctttctctggctcacaagtggtggatggctaacgggcctttgtttgccacccacagcttgcagctccctagggtgggattttgtctctgaacccgtgtggagaagggcacctcagggcttctgccagacgtcctgccccaaggcttggtgtgccatccccagcatggccccgatcagtgccctggccctgtggccatgcaccccaaagtgtagcgtgggccctgtgctccagctctgaccaacactaaccccggctggaggcaggagagccaggccaccgaggggtgtgcgggcacatccctctccttagaaaccgggccaggcctaggagtatggaggcctcacatttctctgggggagcaccgacagcctgtctccctgttttccctcacctggttgtcattcagtcatggaaccagggtctactaagcactcgttctgtgcccagctctgggctgagacaaggcagtgcccccaccccgctccccccgggtgaatggaggcattcccagactgccagacctttggtgctaacaccaggacgtcctggacagaccaggaagagctcgtcactgcgttcccagaggggatgctgtgacctcacaggggctgctggcctcagccccctcacccaccaccaggcagcccgtgaatggccagatgccaggggtcactgcctgctccaaacaactgtgagagtcctgtctgctcatcccagggagggataagtctgtacccttggccttaacaaggggcgcccggtggcatctcatgctgtccccagcctgggcagtgacttctgcatggtccaggggtccctgggtactctttagccacctccgtcttcatggccacctggggcttagcactcacatccagccaccaaggagccgctggagctgtgggctggtggccctggttcagaatgtcaggcccggggtgggtcggggtagtccggatgaagcccctccagaggaccgcccccgactaggacagcatctgggccccagagggattcctggaggccccatctctggcgctcctgccgtgccgtgccctgccatgccctgcactgggggatgcaggccagcccttcgcagctgtccatggccatgctcagcccaccctttgtagcttggccaagtctgtcagtgcctgggtcccaggccgccctgtgcgtgcctccgtgtgcttcctgcagctcccagggccctcgtcctgagtggggtggggggctctgcccacacatgcctccagcggccagggagcatgggagcacagcccccaggctgcctgccgttagttgtcaggtgagtccctgcgcaggcctgggttctgacccccacgcagatgacagctacagcc

SEQ ID NO: 90837 - DNA, 1008 bp, Homo sapiens
gacatcagcaccagcactgtgtccacgcctgtacccccgcctgtcgatgacacctggctccagagcgccagcagccacaggtccggaagcctggttcccctaccctcaagcattcggcctgcaggttcctgccctccctgtgtgtcctgcagggtcctggcaggaaacaggacacagcccaagggtggcacccagggctgggcactgtgggagctgctgccctgctgaggccggaggagggagagaaggggtatgggggcgagccagccctacagctctagggcaggaccctgtgaataaataccccgcctgccctctgctggtgccttccattggcacagcccaaatggaagctggggtaagaggctggaggggcagcagccacaggagagagatgagcctcctggagcacagagaagggcagatgggaggctctggaggggcaaacgcaaggcgtggccagagctgctgccgcccctgagttgtccattgaggccgtcgggcagggaacctcagagggggctgccttgcagagccctgggggagccatggagttccttaaggggaggatatcgcacccaggcctgcaggtggcagggactgaggcccaggagggaatctggatgtctggacagggcttgcaggttccacggcccctagagatattagggcttgatctggaggactctggaagtgtctttggctgtgagggtggatcccaggcccaaggcctgagggggccctgtgagtgggaagtgcctgagggggccgagggcaagggaaggtgggactggcgctcaggttggggtgggaggatcccactgcgcctgcgctgtccccatagccagcccccacctcaggttctggcagccacagtggcatggcgggggctcctactccatctgtatctgtagctcacaccctctccttcctcacagccccactccacagcgccgaccggtgtccagcatacacccccctggccggcccccagcagtgaggggcccc

SEQ ID NO: 90838 - DNA, 1045 bp, Homo sapiens
ggtgactccggggctcccagcttgccctctgcctactggggtgtgccaccaggcagctggggaaccctcacactgggcacctcctcccactgtttaccttcttctccttcctgctcctgcctgcctcaacctaccgtgggccaggctttattctccccacttctccggtggggaagctgaggcccagggagggcagggggctcactgagggtcaaacagcaggcgagttgatgcctaggtttggcactcctgcccgacaccctggtggcttgcggaggtcagcctgggaacaccctggggtggtgtgtgggtgggggctgggtcctcaacccaggcctgcctcttgctcccggcctcactgccgtctccccctccccacctgtctttattctctttgcagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcc

SEQ ID NO: 90839 - DNA, 1180 bp, Homo sapiens
gtaatcttgcttcagcctcctgagtagctgggattgcagttgcacatcaccacccctggctaattttttgtagagatggggttttgccatgtagcccaggctggtctcaaactcctgggctcaagcgatcctcccacctcagccttccaaagtgctaggattataggcatgagccaccatgctcatccttgtacatttatttaggcattaaatgttcacagcaatttggaagcttatagaagaggaaacaggctcagataggttaattaagttgctcatggtcacagccagtgagtggcagggtgaggatttgaacttagcctgaacaagtctgtgtttgcagctgtacctcccagggttaatacagcctccctccgtatcccccggtttttttggtctctgctccctgatgggtggagggaggcctgacccttcccctcccgctgccctgtaggagtccattgagaccatgcggacccggctggagcgcagcatccagatgctcacgctactgcgggccttcgaggcacgtgaccgcaacctgcaagagggcaacttggagcgggtcaacttctggtcagctgtcaacgtggcggtgctgctgctggtggctgtgctgcaggtctgcacgctcaagcgcttcttccaggacaagcgcccggtgcccacgtagcccctgccatggaaggaagaacgggacaaaggaggggcagcagggtgtgtgcatatgagacttgggggtccctccccaattttagtttcctgccaaaacgggagtgtgcagtcagggcctgcggtctggccccatgagtctccttccgtcctcagcgggcagggaacacctctggcttgtagaagggacggctcagtggctgcaccgacggtcctggaaatctcacatggtgggcactgcagcgttggaacgtgagcctcggatttcctggcccctctactgtaaatgtgccttagcctaagcctcccatcctgtgttagcgttgcctggtgcggggcagggcctaacaaggaaacctgggccctccaagccaggttgaggtctggtaacagaatgccaggaagggggcctggaagaccacctgccccggcccctctcctgcaggggccccacacaggcatgagggatggcccggccaaagtctaggcagaagcctcctataacaaa

SEQ ID NO: 90840 - DNA, 1050 bp, Homo sapiens
gagcggaaggggagggagtaatgaagcaggcggggctagagtaagagatccagagggggcggggccatcgataagtatagggagcctctgagaggacaggactctggctggtgggcgtggcgatagtgctgataggtcaactgcgggggcgttgcccacacaggcctttctcgggggttagactaaggaaaaaggctgggcctatcctctttcggaggcggagccaaccaggggcgtggtcaggtaaacgtccattaagtacttttggtaggtgcgtggtcagctgaaagtatggaccccaagctgtcatatcaatgagggtggaggcaaggggcgcagccactgggacaggttggggcgggtgtgggtgtgccgccgttcaggtaagcccttggtggtctgtattgatcagtgttggttcagccgtagccctcttcggcaggcgcccttggcctaccgctagccctccacccgctcttacctgccccccaggtgatcggaggtgctggactggacgtggacttcacgctggagagccctcagggcgtgctgttggtcagcgagtcccgcaaggctgatggggtacacacgtgagttcagtcttgatgcctgcctgggttcagttacagccctgcccttcccaggcggcctcaggttaccgccctgactgccccgctgagtcggctggctggccaccctgggtcatgtctgtgtgtctgtctgcccagggtggagccaacggaggccggggactacaagctgtgctttgacaactccttcagcaccatctccgagaagctggtgttctttgaactgatctttgacagcctccaggatgacgaggaggtcgaaggatgggcagaggctgtggagcccgaggagatgctggatgttaaaatggaggacatcaaggtgtgtccaggctgcgctggggccactccttccagatctctaggattcacctggggtgccccccttgggctgacccagcctcccctccgtagttgtgccctccaactgaattatagtaagagtagcagctcttaaaat

SEQ ID NO: 90841 - DNA, 1047 bp, Homo sapiens
accgcttggccacgccccctctccctgactctgctggccgcccagcccgcgaccctctacctggtattcggtctcgaggcttgcgttggccggcgcggactggtagaaacactgcttcctccccgccggcaacaggaacgtgaactcaccgtcctggattggcgggggccccgcccctcccacctccactggtggcattagtagccacaaggccagggctagggccgcgccggccgccatcatccgggtcaccctctggtctgcaaaggggtcgcggctcctttaagcgctagccctgccccggtgctactcggcggagctcattggcagtggcttctgtatgttgtccgtaaccagaggtgccaggagtgaaggacccccccactagagggcaggcggcccgaatgaatgcctgatgtgcccagaaacactcaaccgtctgggaatatttttctcaaaggcttcggctctcttctcggccgctggtggaggaaaattacaaaaataagtgccatgatggcgcatcttttgtaggcagtagctaagacaactaaagttacaggcggcagggtcctttttagtcacctccacgtggttttcccagagtgcgccgcgcgtgacaacctttggcgggaccgacgtggtggagtggacccaaaaatagcgtctaggcgtggccctgtacgcgacccgtagggctcgcctataaaagggctggggcggggcggagatacctgtggcgtcgtgttttgcttgctctgtgagcgtggtccaggttcgacgccttttgcgccttagaggcatcagcgtatcagtttcctcgtaagtcgggagtgatggaacgaccaccctgtagtgcggctgtgagaattgagatgaggcttggttcatattgagtgctcagctttcctggcttatagacagtggaggggcgtggccccaccatgcaccccaagggtctcagactcaagggccagcaggtaaatagagccattacagtagcctcgggtcagaaaaacgacagcccaggtaggaagagataaggac

SEQ ID NO: 90842 - DNA, 1079 bp, Homo sapiens
ggcgcggggtcggcggtcccgggcggcgcggggccctgcgctaccgtgtcggtgttccccggcgcccgcctcctcaccatcggcgacgcgaacggcgagatccagcggcacgcggagcagcaggcgctgcgcctcgaggtgcgcgccggcccggactcggcgggcatcgccctctacagccgtgagtacggggccccggggcaggcgcagggccggggctgctcacgaggccggcccggggcgggggccggcggggaggggccctgagcgcgggggcctggcgtggggtccccgggactgagccggtggcctgcagggagcgaccgtggagggccggtgccaggggacagacagagaaaagagggcgtgcgtggtggccggaggggcaaggtgcccagagtgagcaagggagcgcgaaatggggagtgaagggcctgagatttgggaggggtgggtgagcaggaagtggggggctctgagtggaaggggaatttggaggacgccaggcgtggtgggcttaagcgtgggggagggaggtccggggtgcgggagaggtgggcgtctcgggggcgggcgtggccgcctctgcagggaggagggtggggcgtgggcggcccgggatccctctggggaccccctggatagctcaggacggttggaaagtgtttgctggtctggggcgcccgcgagtaccgagttccaccgctgtgcgaggtgtggcgttcaggacccccgaatgggaaacttcaggatctggggagagggcccatgcggggacggtgggagccgcagggtgagctcctcgtggaaacgtggacgggacgggccccttcctgatgccgggcttcgaagtaagagctaacagcctcctcccatcttcttttgggggatgtgagaagctggttacattttccgaagctgctttcaaaactgacatttcactggggggaaaagaaaatcacaaatgcgtttgccagcaccccccacccccgctcccagtctttgtagttcattcttcttcttgttactccttcttatctcttctctttgattccttgttcacattttgctactctgtg

SEQ ID NO: 90843 - DNA, 1051 bp, Homo sapiens
cctcccacagtcctggaattacaggcatgagccaccgcaccgccctctttatccttaagtaacattgatatggagataaaaaacatgggttcttggccaggcgtggtggctcacacctgtaatcccagcactttgagaggttgaggcaggcgaatcacttgaggtcaggaggttgagaccagcttggccaacatggcaaaatctcgtctctgctaaaaatgcaaaaattagccaggtgtggtggtacctgcgactgtagtcccagctactccggaggatgaggtgggaggatcgcttgaaccagggaagcagaggttacagtgagctgagattgcaccactgcatgtcagcctgggtgacagagcaagaccctgtctgaaaaaaaaaaaaaaagcatgggttctggagttggaggtgatcagtgctgggtgtattaatttcccatggctgcaataacaaattatgacagatttttggtttaagacaacaggaatggattctctctcagttcatggtcagaagtctgaaatcatggtactggcagggccacaatccctggagaggttctacaggaaaatccttgcatcttccagattgcagtggatccagctgttgcttgatttgcagcagcgaaacccaagtccctgcgtctgtcttcactcctgtgtcttgtgtcctcttttttccttttttttttaaagtgagatggagtctcgccgtgttataggctggtctcgaactcctaggctcaagtgatcctcccacctcagctgttcttttcttttctttttttttttgagacggagtctggctctgtcacccaggctgaagtgcaattgcgcgatctccgcttactgcaagctctgcctcctgggttcaggccattctcctgcctcagcctcccgggtagctgggactacaggcgcccgccaccacgcccggctaattctttgtatttttagtagagacggggtttcaccgtgttagccaggatggtctccatctcctgacctcgtgatctgcccaccttggcctcccaaagtgctgggat

SEQ ID NO: 90844 - DNA, 1058 bp, Homo sapiens
aggtgcgagccaccgcacccagcctgtgttttattatttatttattttgagatggaatctcgctctgttgcccaggctggaatgcagtggcgcaatctcggctcactgcaacctctgcctcccaggttcaagcgattctcctgtctcagcctcccgagtagctgggattacaggcacatgccgccatgcccagctaattttttgtattttagtagctcactgcagcctctaactcctgggctcaagtgatcctctggcctcatcctcccaagtagctgggactacaagcacatgtcaccacccttggctaatttaagcaatttttttagagacagagtcttgctgtgtttcccaggctggccccaaacccctggcctcaaaccatcctcctcctgcctgagcctcagaagtagctgggattatagtcacgaaccgctgggcccggtgtggcctatttttgtacagacaaagctaagaaaggcttttacagtttttgagagattgattagggaaaaaaactaaaacccaatccacaaacaacaataatcagttgagaccacagtgtcctgcaaaacctgaaatatttactcactggcccgaggcaggggaagcttgtagacccctgggataaatgaatgaggcaggcaggagttggggtctgtggggagtttggccccagccaaaagagaaaccaaaaaatcctcaggccgaatagagcatacttctgaattgtgtgagccccttgtgccaattgtggcgcttactgtatgttaccacttactctgaaaagagttctgtgaggtcagagataccaaccccaatttactggtggaaaaacagaaatgaaagaacttgactggccaaagtgatgtggttggcaggcagcagagatggctttggcattctgggtgactggatgcccaccttaaatgcatatataagtggttcagtgacatttatctgttcatcacaaagacccaaagtagcagaggcttaattaaacacgatggcattttattttttgtgctctaatgctaaagtgtgaagattgtcaggtg

SEQ ID NO: 90845 - DNA, 1043 bp, Homo sapiens
tgagccatcatgcctggccgcttatttattttaattgttgtttagtcagtacacacacatgcccaggccttagttctgtttgatgcttttgacaattatggacacccatgtcaccaccacccaaagccagacatggaacttgttcccctctgggtaggtttgttcagtgggacagcccctctttccctgtctgttcctctcatcatttgtcccctgctgccaggcggggcattcttgtaaacaggtccagactgggtttggggggctctgtgcccccccacccctgccaggagaacccccttttattcttcctttttgtctgtctctttaaagcgattcattagccttggcaggcgtgggtctgagctgttttcctttatgtcgttggcaggtctttctcccgctaattgtgttctcggagctggggttcatttttgccggatgtgttacacatgtgcaagcgtagtggttttatgtatagaaaacctgcccagcggtgtgggcatgggtgctactcctggcgaggactgcagaaaggcccctggccaatcagtgctctcgtgaaagagggatgctcttgttaaccatcccgggcagggggcatgtgaataaataatcaaagactggggtgcctcttgcagactgagggagggacattccagagaatttgctgcattcttccttgaacaggacgggaaggcgaagataggctggagcttccagatttccatcctgtgcccttgagggaccctctgcaggagcctggctctgcctttgagccctggagcccctagatgcaggatgatgggatgcctggctcttactcccgctcacacactccaagtctcgctatcaggacagccccccacagggagccacagcagccacagctcactccctcattttttttttttttttttttttttttgagacagggagtgcagcggtgtgaacacagctcattgcaacctcaacctcccaggttcagttcatgctcctgcctcagcctcccgagtagctgggacggcaggtggccccacacc

SEQ ID NO: 90846 - DNA, 1110 bp, Homo sapiens
cccaagcagtgtgtgaagctgattctctgtcagccacgtgccagatgggttgggtcccaggggtggccacctgggggacagggccagacacttgttctgggcccaatatggccttgtgtccagaactctctcggtggctccttctctcgaccctttgccttgagccggagcactgtggggacacaggaaccaagactggtgttttgtgccaatgccacactactgtgtgcccgtgggtcttgggccgggcatgggtgggttcgtcctcatggctacacagtgaaccatgtgttattttatttttctagacactaaagctgaggtgtcgggaggtgatggtcccttgcttgcaggtggcagagctcaggttcaaacctggatcttactgcacctggctcgtttgggaggcctcccttgctggaatgcaggtcagggagccccgatgcccttgggctgactgccccacgtccatcacacccactgagggccgtggggtgggtgcagggcttgttctgggagattccaagctgaggaaagcagggctgtccgccagcctccagctgggtcacagaagaggctcagggcctgttcccactcccctcccccagccagcagggtccaaaaggatgttgggggggtggtccccagtccggcctgcccactctagggaggggcccagataacttgcgtagacgccggccctcccgcccccagccttcgccattgccttttgtctggctatctttcatgtacaagggagaaattcaagccactcaggagggtgtaacatgaaaagtcagtctctccttctctccgcactgcccgtgacctgtggtttctcaggcacatacaagcgcgcacgcataaatctctcctccaacctgctgggcttcaagttatgcacgttcacacaatggcaaaggagggtgcggattgaaaagtatgacttgcttcccggaggcagcactgaagtcactttattgtgtttccagacaagccccatgaatgcagtgtgcactgcccctcctccctctgtcccttccccgcccatctgtacacctgtggtgcgtaggttttacaccactctgtgccttacgttgtggctcgatc

SEQ ID NO: 90847 - DNA, 1097 bp, Homo sapiens
ttagccaggcgtggtggtgggtgcctgtagtcccagctactcgggaggctgaggtgggagaatcgctagaacccgggaggcagaggttgcagtgagccgagatggcgccactaccacctccagcctgggcaacagagtgagaatctgtctcaaagaaaaaaaaaatagttttttttttttggtatttttagtagagacagggtttctccatgttggtcaggctagtctcccaacttatgaggtcaagcagtccgcctgcctcggcctcccaaagtgctgggattacaggcatgaggcaccgtgcccggcccacagtgagctcttaacaggctatggccaatcgcagccatggttggggcgccagcgaagcaggcagaggggcacccaatgcccatgtgtggatggaggctgtcccttgagagcaggtctagggagggccccatggcaggaagacgcagggaagcccacatggccctgcccgcctgcaggtcttggtgaagagtaacaacctgacggaccgcatcgtggtcatcccgggcaaggtggaggaggtgtcactccccgagcaggtggacatcatcatctcggagcccatgggctacatgctcttcaacgagcgcatgctggagagctacctccacgccaagaagtacctgaagcccagcggtgagcactggggggtacacaggccaggcccctcggtggaggccctggctgccgctgagccaggccatcagtgcttcagctccctgcttactgtcggtggcccggggtgtagggaagcctgggcttttcccccgctcccaccccaaccccactccagccagctgtggcttttggagccctgggccccaaacacggccagacacccagctgcccactcgcccagacagggtacacaggatctcctggcacctctgccgtcccatgtcctgctcctgcgggacagcctctggctgggagtggggattgggacaggttctgtggtcagcagttccccaacaagccctgctctcctcacagtccaggaggtggggtgggcgagcatgtgtgcaaatgcaggggtgtgggtgcgagtgtacgtgtgtgaggaggtg

SEQ ID NO: 90848 - DNA, 1053 bp, Homo sapiens
cttgcttttttggttaacttgcttaatgatttagcttggagatctttcctcatctgttcataaagagcctcttcattctttctcacgtccgcatggtctttgatgggagagccatcactggtttaattagatggtttccagtgtgtcgctaccacggacaatctaattatacatgtaagtttgttgatgtgttcatgtatctggaggttaaactcctgtagtgccaaatcttttatgtggataaacacttgtcatttggagagctgtcacctgattgccctcggtggcgttgtgccggtcccctcctcacggcgtgtctgggaagagcaagctcgttttagctgcacagcctagaagccgtgggcagacctgggggaaggggcagggctctcccctcccatgctggccctggcgtcagatgccacgtcacacctgtggtctctcccaggacacatttgacatccggatcctgatggccaagtctgtcaagtacacggtgaacttcttagaagccaaagaaggagatttgcacaggtactggcacccacactccatcctcccaggcctggctcaggccgaaggtcagggccacccctggctcccgccggcatcctgccgtcccagggcagatggtgggcgggggccccaggcctctgcacctggcaccccctcttctctctcggcagcgcctgtctggcttccccagcagccactgccctttgccttccaggatagaaatcccattcaaattccacatgctgcattcagggctggtccacggcctggctttctggtttgacgttgctttcatcggctccatgtgagtgccgcagagcagcccatgctgcctcctccccactcccagggcttcctgcagctgcaacctggctgggggggtggaacatggctccaggttccaccatcccttccaatgggagtgagagcctgtctcggagcaagagactgttgtgggtggggtgtgtgtgtgtgtgtgtgtatgtgtgtgtgtgtcctgtgttcccagtgtctgtccctcatgggtctgtgtctgtc

SEQ ID NO: 90849 - DNA, 1044 bp, Homo sapiens
ccgcaaccacgagatccctactcaccctgacatgtgccaagagacagacacagacccatgagggacagacactgggaacacaggacacacacacacatacacacacacacacacacaccccacccacaacagtctcttgctccgagacaggctctcactcccattggaagggatggtggaacctggagccatgttccacccccccagccaggttgcagctgcaggaagccctgggagtggggaggaggcagcatgggctgctctgcggcactcacatggagccgatgaaagcaacgtcaaaccagaaagccaggccgtggaccagccctgaatgcagcatgtggaatttgaatgggatttctatcctggaaggcaaagggcagtggctgctggggaagccagacaggcgctgccgagagagaagagggggtgccaggtgcagaggcctggggcccccgcccaccatctgccctgggacggcaggatgccggcgggagccaggggtggccctgaccttcggcctgagccaggcctgggaggatggagtgtgggtgccagtacctgtgcaaatctccttctttggcttctaagaagttcaccgtgtacttgacagacttggccatcaggatccggatgtcaaatgtgtcctgggagagaccacaggtgtgacgtggcatctgacgccagggccagcatgggaggggagagccctgccccttcccccaggtctgcccacggcttctaggctgtgcagctaaaacgagcttgctcttcccagacacgccgtgaggaggggaccggcacaacgccaccgagggcaatcaggtgacagctctccaaatgacaagtgtttatccacataaaagatttggcactacaggagtttaacctccagatacatgaacacatcaacaaacttacatgtataattagattgtccgtggtagcgacacactggaaaccatctaattaaaccagtgatggctctcccatcaaagaccatgcggacgtgagaaagaatgaagaggctctttatgaacagat

SEQ ID NO: 90850 - DNA, 1044 bp, Homo sapiens
cgggcacaacgccctcacccccacccggctcccactacacatctccctcggaaaacatgtggaacacgggcagcacctacaacctcagcagcgggatggccgtggcaggtgagcagggcccaccccaatgcccagccaacccgggaggccgccctcgccgcaggcctggcccctctgcctccagccctgacgtctccctctctggacacagggatgccgaccgcctatgacttgagcagtgttattgccagtggctccagcgtgggccacaacaacctgattcctttaggtgagtgtcccccagggccaggggcagcagggagccatgcccaggactgcccaggggccgggaagggcctgtggtgaccagggtcggcctctgcttggtcctttcaccttttcctcttcctgggggctctcggccgaggctctccgtcctctctgcctcgctctgcagcctgctgctgtgcatgggctgggtggctgggggcggtgacgccgtctcccttccttctttcctccctctcgctgcgcagccaacacggggattgtcaatcacacccactcccggatgggctccataatgagcacggggattgtccaaggtaacgagggtggcgggggcagggcccgtgggggccgagctagcgtgtgagtcgccatcctctgtccggccgcccgcctgccctcttgcctgccctttctctctctctgtgactctgcctgggggctgggcgggccagggcagcccctcactgccattgcctgctccacagggtcctccggcgcccagggcagtggtggtggcagcacgagtgcccactatgcagtcaacagccagttcaccatgggcggccccgccatctccatggcgtcgcccatgtccatcccgaccaacaccatgcactacgggagctaggggcccgccccgcggactgacagcaccaggaaaccaaatgatgtccctgcccgccgcccccgccgggcggctttcccccttgtactggagaagctcgaacacccggtcacagctctctttgctat

SEQ ID NO: 90851 - DNA, 1395 bp, Homo sapiens
cccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgcaacacgtttcctcatttattttttctttctttttctttttttctttttttggagggagaggtccctgcaaggtcccttcccgggcaggggagggatggaaatgccgtcacagtagtagggactggagcgtctacaaggatggaggggagctactcaggcctaacgttagctacaaggaaaaaggacgccttccgtgacagatccttgaggtgtctgtgtctgccccaagtggccggcagtggccttccctccgggcccaaggcctgcagccacctgctctaactcttgagtgggggggcggggggggacctgcaggggctcggggacaggacagcagcaagaggcaggggccgaggacggaggccttcccgacagtggggtgggttgtacattcaagtgtgaggtgaaccctttggtggggagggggcccctgaagcctcggcggggccacccctccccgcggcgcctctgagtctagggagaggggctgctggctcggcccggccggcctggcttcacagagggtctgcggattgacactggttcttttcataaaaaaataaaattaaaaaaagcagcatgtcacgtccgttgtgaccgaggcctggtcgtcgaaggggaggccccgcctggccaggctaccttcccactggagacaggcagggggacaggtgctaagggacctggcaggcagggctggcaggccccatggcgcctgttccagcagatgacaagcccaggtcagggtagagcgggcaggaggggggacgagggctcccacaacatgattttgtgtaaaatatggcagcgacacacgctcagggccgggaggtgggggttagggtggggacggcggcaacatcgtgtaaaaaagtgtcccagttcccatagcaaagagagctgtgaccgggtgttcgagcttctccagtacaagggggaaagccgcccggcgggggcggcgggcagggacatcatttggtttcctggtgctgtcagtccgcggggcgggcccctagctcccgtagtgcat

SEQ ID NO: 90852 - DNA, 1048 bp, Homo sapiens
cacagggatgagccacaggacctgggagcaacacggcggcaggtgaccatgccagtccccccagccaccacccactctgcaccaggccaccctcaccaccatgggaatgaggcggcaggtgaccatgccagtgtccccacacagccaccacccactccgcgccaggccacactcaccaccatggggatgaagacaaagagggagtagccgtagatgcacacagtctccaggaaggtgtagggccccatgcgctcctggacacccttgcgccaccgcaggaagccccacagggccaggggcaccagccacgcatagcagtagatgctgatgcctgccacggtcactggggggggcaaggtgagcagtcaccccctgtaccccagggccctgccaggcattgggcctgcccgtctgcttacccttgtggaactgggggctgtagtggatggaggggtccctcctctgggccagcaccagcgtcaggttgccagtgacggccaggacaaaggccaacgtggcacagatccagaaggggcctgggggtagggggcacagtcagggtcccgggccctgcactcccaggacaagcagacatgtatcctgactgagctgtgctgagaccccagcctcttcctaagcaccttgcctgactcaccaggacaccgggggcctcctggtggctgagcccagtgctggctgtcagttcatccccctccccgaaacactcaggactgcacacccttggcctgtgtctcacctcattggtgccaattcctcaacccctgtcacctcctctttgactctctgaccccttcagccatggggagcagccaggcccagttcttggccccttccatgtctgcgttcacccatagtatgacctccttcaagcccagggccttatgcctcctctagagcccagggctctgccctgagcactgcaggctccagttcaagctcccgggtgggcatctccggcttcatccacacccttgccctctgccctcactgccaagctggtcccgtggatacgtggcaactctatcca

SEQ ID NO: 90853 - DNA, 1238 bp, Homo sapiens
ccccacctatctagccacaaagccagtctcttctacttccccagcacgttccagaatccagtgccactctccacatccacagtccccaccatgtggccgcctccaccccagcctcctggcttccgccctcgccactcatgatggcgagagggaccccgaaaacacttaaagatccattctcggccagataacagtgactcacacctgtaattccagcacttaggaggccgaggcgggtggatcacctgaggtcaggagtttgagaccagcctggctaacacggtgaaactccgtccctaataaaaatataaaaatcagccgggcatggtggcacgtgcctgtaatcccagccactcaggaggctgaagcaggagaatcgcttgaatgcgggaggggaagattgcagtgagctgagatcacatcactgcactccagcctgggtgacagagtgagactctgtctcaaaaaaaaaaaaaaaagatctcttcttgccacagcatgggaggcttgtgtgatctgtcccctcgcctgtgacctccctgcagctcactcgctccagtggtaatgccgccctgcagttcatgcaagttcctgccatgaagcttacgtcgtttctggaagcctcttttcctaggtctcccccacccctcctgttgccaacaaggctcattccctcaccctcctcagggaggcctgccctgctgcaccctgcagaactgcagggccactcctcctgtctgctctgctgctctctacccgccaccctctgcagtccttcatgtctctgtctccctgaacagcaggtaagtcacactgtctgagtgactgatttgtccgcagctatacactggcatctgcaactcaggccacacttgttgagtgatccatcaaggaaccaaatgcacaacctcactcaccatacagatccggccgattccgcagatggtgccgcacaaagttgtggccaggccggggcagcagtgagcctttgatccggtccaggacctgggggcaaggccaaggtcaaggatggaagtctgccaggagcttctcccttgtcctgagaggctccttccctgctgacctccacccttctctttccatgccccacctgaaagaactcagcctttccctctctttttttttttttttttttttgagacagagtcttgctctgtcggccaggctggatggagtagtggcatgatctcggctcactgcaacctctgcctcccgag

SEQ ID NO: 90854 - DNA, 2237 bp, Homo sapiens
ctgggattacaggcatgagccaccccgcacccggcagtttttgtatttttggtagagacggggtttccccatgttagccaggctggtcttgaactcctcaggttatctgcccacctcggcccccttaagtgctgggattacaggcaggagccactgcgcccagtccatctttggtcttctgcatatgctgttccctgtgcctggaacatatactcctgcttccctaccctattccccagggaagccttctgtctcctttaggtctcagccaattcctcacctcccccaggaggcctttctctaacccaccagattgtgtgtgtcccctgtgttcccatagtcccgatccataaccagtcccaccataaccctttgagagcaccacagttcgttcaccagcacccaccatcaccagcaccctgcccaggggaagagtggctgaaccctgagcataactctgagccccatcccacctgcctccccagcctgacctgtgaggtgtccacgtcaaagaagctctgatagtagctgaaggtccagaatcccggctgctgctgctgctgctgctcctgcaggagctgcacattgcgggcattcagtgcctgcccggagagcctgggtcagctgggggctgcaaggaggcaggacacagggactcaccgcggccttgtcactctcctcctccacctcatcctcggctccatagctgccacctgagcccacggccacagccacgtgcccttgtggggtcagctgatcgcttctgctggtggtggctgcatctggggtgtcagccagaagattagtggcctcctcgaattctgtggaggaggtatatgggacacacgcacgtttgaggggtggaaagaactcgactgggcccaagctaaaccgatgctcatctgggggcggaggctctgctgagccattgatctcccccaaggtggggcccaacttcctcagtttggaggcatccggaggacatctgttcccttcctcctaaagtggaactgcaacttagggttgacgctgggatggggtcagggtctggggacgagaggctcgggtttgaggtctgagttcagggcgggggcggggttcgagtcagagatgggtctcactcctgggtcagggttcacagccgcctaggcttcggggtagagaaattggaagccgtatcggggggaggttctggcccggggcgggagtgggagatccggccacgtcggggccgcactcaccatggaaggtcagctcgtcggccgatgccatggtcgttcaggggcgtctccgcatccctcgctgaggacagagaccggtcaggcacacttcccccccgcccccgagccggtccctcggcccccagccctacctggcgaccaactgcacccacggaggcttgaactcgtcgtcccgtccccacaggtgcgctccgccccccctcacctgaggccacctgggccggcgtggctggggctctctgcgcctgcgcgtctcgcctacccgtcagactccaaccgactcagacctgacagcaacatccggcgcctgtcctctttctatcctctcccgttgggaagccacttccggtaaagttggcgcttgcgcagaagagactcccgggctcttaacgtcgggtatcaggagtttcttcccggagcaaggacccccaagacggaagaggatggccgcggcggctctgaggagattttggtcccggcgccgcgcagaggcgggcgacgcggtagtggcgaagccgggagtgtgggcgcggctgggtgagtagcggcggaaggcggcagggtgggtggccgccgcgacagggtgggtggccgccgcggccggatcactcttaccgcgctcctctcccctcagggtcctgggcccgcgcgctgctccgggactacgccgaggcctgcagggacgcttcggcggaggctagggcccggccggggcgcgccgctgtgtatgtgggtctgctgggcggcgcggcggcctgcttcacgctggcgcccagcgagggtgccttcgaggaggcgctgctggaggcgtcggggaccctcctgctgctggcgccggccacccgcaaccgcgagtccgaagccttcgtgcagaggctgctctggctgcggggccgtggccgcctgcgctacgtcaacctggggctctgctcgctggtgtacgaggcgcccttcgacgcccaggccagcctctaccaggcgcgttgccgctacctg

SEQ ID NO: 90855 - DNA, 1042 bp, Homo sapiens
ggagcgcggtaagagtgatccggccgcggcggccacccaccctgtcgcggcggccacccaccctgccgccttccgccgctactcacccagccgcgcccacactcccggcttcgccactaccgcgtcgcccgcctctgcgcggcgccgggaccaaaatctcctcagagccgccgcggccatcctcttccgtcttgggggtccttgctccgggaagaaactcctgatacccgacgttaagagcccgggagtctcttctgcgcaagcgccaactttaccggaagtggcttcccaacgggagaggatagaaagaggacaggcgccggatgttgctgtcaggtctgagtcggttggagtctgacgggtaggcgagacgcgcaggcgcagagagccccagccacgccggcccaggtggcctcaggtgagggggggcggagcgcacctgtggggacgggacgacgagttcaagcctccgtgggtgcagttggtcgccaggtagggctgggggccgagggaccggctcgggggcgggggggaagtgtgcctgaccggtctctgtcctcagcgagggatgcggagacgcccctgaacgaccatggcatcggccgacgagctgaccttccatggtgagtgcggccccgacgtggccggatctcccactcccgccccgggccagaacctccccccgatacggcttccaatttctctaccccgaagcctaggcggctgtgaaccctgacccaggagtgagacccatctctgactcgaaccccgcccccgccctgaactcagacctcaaacccgagcctctcgtccccagaccctgaccccatcccagcgtcaaccctaagttgcagttccactttaggaggaagggaacagatgtcctccggatgcctccaaactgaggaagttgggccccaccttgggggagatcaatggctcagcagagcctccgcccccagatgagcatcggtttagcttgggcccagtcgagttctttccacccctcaaacgtgcgtgtgtcccatatacctcctccaca

SEQ ID NO: 90856 - DNA, 1053 bp, Homo sapiens
gtatggtacacacctgtactaccaactattcaggaggctgaggtggaagaattgcttgagcttgggaggttgaggctgcagtgagccaagactgcatcactgcactccagcctaggtgacagagcaagccccgtctcaaaaaattaataaggctggatgcggtggctcacgcatgtgatcccagcactttgggaggctgaggtgggtggatcacaaggtcaagagctcaagaccatcctggccaacatggtgaaaccccgtctaacaaaaattagctgggcgtggtggcgcacgcctgtaatcccagctacttgggagactgaggcaggagaatcacttgaacccgggaggtggaggttgcagtgagccgagatcacgccactgcgttccagtctgggcaacagagtgagactccgtcacacaaaaaaaaaaaaagagaaaaaataaataacataaaactgaagtattaagggagtgatgctacctcaggggcctgtggcaagttaataaaaccaggtggtaaaacaactatctttgtttgtgatacttgtttttgtgtgtttgctactttcaaattttggcatttgacccttgcattcataatcagtgggttgaacaggtgttggtttaagtcagcatctcacttttacagaggaaaagctgaggttcagaaaatttatttttccaaggctgtggcaggaccaagattcgaactgtaactcccagctctgtgacttaatcctcaaacttgtggactttgatcctaataattcttgtcagaaatagttaaatactgctatcagttgccataaataaaaattggatatagaaatacatatataaagccgggcgtggtggctcacgcctgtaatcccagcactttgggaggccgaggcgggcagatcacaaggtcagaagatcgagaccatcctggctaacacagtgaaaccccgtctctactaaaaatatttaaaaaattagccgggcgtggtggcaggtgcctgtagtcccagctactcgggaggctgaggcaggagaatggcgtgaacccgg

SEQ ID NO: 90857 - DNA, 1062 bp, Homo sapiens
gggccggggtacggcggcgcccgagggtcaagaagcccagccggcagccgcgcgcgtggggaaggccacagtgtcgcgaggccgtggcagcggcggcccccgcggagcggcggggtgggtggggggcccgggccgcgtggaggccgcgcgatcctctccgcgcgcgctctcgccggggtcgccggacaaagctcgcccccctcgcccggcacccctacagtcgccctcccaattacagcggctgcaacaataggcaggcgttggggcttttctggctgcgtggtaacgggtccgacccgaatgttgcgtttttggcgaagctgcgatcggggctcagccaaacctccagatatgtccggcgtcggccggacacgggcattagcggtccccttgggctagccgacctcaaattgtcttaaaaacgtgtcattccagattttcaaggaaaggtaaaggactcccccgatgccttgcagttagtgacttcaaaatgtttgcccgaattggggttggggatggggtcggcggcaagtaggggagcacggaggaaatcctttgctgtgtaaaagcattgcttttcttttgcatccttttttctccttcccaattggtttttcagattaaggcttttattttcaacgtggaccttttgggcgagtgttttgtcccgatcttgaagataccagtcttgattttttttttttttttttttggtcagtgactccttggggaaagtagcaagggaataagcggaaaagccgcttcgcaggaatttgaagcaagttttcagtttggattgataggctgcattcaagcttgattcctggtgctgtcagtcacttagcacactgtcactttagggaagtggcttaacctctctgaacctcttagttttcctcctttgtgaaagctcctttgtgaaagggggtaatctcccaaatggaattggtgaaagcctgtaaaatggttcctcgcaagcgggaagcactattgtaattgtctggtccaatctccctcattgttcagcagataacttcttgaggccctactaagtgttggatg

SEQ ID NO: 90858 - DNA, 1519 bp, Homo sapiens
ctccggagtagctgggaccacaggcgtgtgccaccatgtccagctgattttcgtatttttagtagagatggggttcgccttgttggccagactggtctcgaactcctgacctcaaatgatctgcccgcattggcctcccaaagttctgggattacaggtgtgagccactgcacccggccagtcagaggctatttgagctatagtcctgttctttctgttaggaagataagcaagtggagagcagtgtgaagggtagaccagcaccccctgagacaccctctgccgtgatcaggaatatggcaggagcccctgaaggcccctgtggggcagtgcttgtctgtgagcgtggcccaccccttcctgggtagactgactgatcttgtgtgcctgagatgtaggacttcctctgagagtgatcatggagaaacggtttgggtggctggtggggaaggtactggcttcctgtgggatgtagattctgatgtgaccgtatgattgtcccttgctatccctgtcctgcctcgcccttggtcatgaaccccagactgaccaggactgtcttccagcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaaggtagggatccctgtgcccgcctcgcacctgcggcctctgcccactagggctgcaggcagcctctggaccgagggccttacttggaggatggggggaagccttcttgttggaggtgtcctgccttggctcagccccctaccccagggcccacggccatgaacagaaggttcagctcgtcagaccccagcctgtgctggcgcatgatctgggccccgcgggcacctgccccaccgtttcccgctcccttgctttctgcatgtgaaatttgggaatatcactacaaagttttcttttggtaatgaagaaaaacatccaaattcctaaaaaggcttttagccacgtggtttcccccgttctggctgtcaggctcacctgtgcagctcgcagagccgagcagcgggttccctttcctccaaggcgtgcccctcagccactgtctttacctcacctgcgctgagcagggccttcagtcagcaaggtggagaaggctctttatggtcacaagtctcttttgcatgtccctggatgtggttagaggacatattcccttatacatacagcatctgaaaggaaaggtcatattagcatccatgagaaaaggtgacatttctaagtgtcacgggccacaggaggtcccgggtggtagaagatgaggattgcttgaccacagtctcccatatgctcgtgctccactgggcga

SEQ ID NO: 90859 - DNA, 1033 bp, Homo sapiens
gaattagcccacataaccttcgcatgtaaccttcgtaaccttcagaccaagcctctagggtcactccgaggggttgcctcagttttgaggtgagaatgctgaggtgtgcagttgaaatagattcccaccgccctgcgcctcatccatgccagagctgcatgaaaaccttggcccgcctgacgccagaacctggctcacaccactgaaaaggcatgacctgggcgcgtctatcaggaatcttgtttgctgtcccctgaggcccggtcctgaggagtgccccgggctatctccctctctgctgtgccctgcggccagcatcctcttctgaggcatctcttgcctcatgactagtgcctgcctctctcgagggatgggtcccctgcagctccagctgtaactgggtgccctggcaaccctctcaccgcctttgctccttgtctctgctcccaggctgcaggctcgcatcgcacaccgaattcaggaacttgaaaaccttcccgggtccctggccggggatttgcgaaccaaagcgaccattgagctcaaggccctcaggctgctgaacttccagaggcaggtgggtgctggcatggccgcagctttccgaaaagggcctttgtcaccaacactgctgctaaggctccaaatacggcttgcctggctagtattacacctgcctgggctgtgaaaagcagccgtggccatccatgggcactcaatcactgcagagccttcctcttacggcctgcgcagtgctggggacgtggacctcactaccctaaagcacttgccgcctcaaagcagacttgtatgggcttctttcttcctttccctttccctttttttttttttttggaaacagtcttgctctatcacctaggctggagtgcagtggcataaactctgctcactgcaaccaacgcctcctgggatcaagcaattcttctgcttcagcctcccaagtagctgggattacaagcgtgtgccaccatgcctaatttttatatttttagtagagacagggtttcaccat

SEQ ID NO: 90860 - DNA, 1098 bp, Homo sapiens
tttcaccgtgttagccaggatgatctcgatctcctgacctcgtgatctgccctcctctgcctcccaaagcgctgggattacaggccaatattctaggttttaaacaagccttgcggggagatgtgtccaccatgctgctgaagggtcagccttctcttttgtgctttcctgcaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggtatggtcctgccttcttgacgtgcgctcttctacatgtgtagctggtactgcgggctccaggggtcactccccagggttacgccaaggcatttcacagctcggagttagaggtgggacagagggaaaagagcaggcgcgggcttgggagtcagtcctgggctcggatatttgctgatctctctgatcatcagaatgactgtgtgacctcaggccacttagccggctcctctgccttctctggaaaatggaggtggtgcccccttccctcgttctgtgagagccaggtggtgtgatccagacccccgacccctagcataaacatctctgaccatttatttgtgactgagtcgctggttgggcagatattggcagcgtgttctgggccaggtgctgctctgtgtacggggacatggcccctgcctttgtgggggctcctggttgtgcttgaggggcagatacgcgaatgaagcaaacagagtagtggatggtgaccgctacagtgaggagggggaagtggagtggaaggggagggacagggtagtaagtaaaagccttgaaacagaggcccaaagggtggccctgatgcacaaacgcagagacccagggaaggagccccaggcagtgcggacaaaggttgaggtggcaggcagccatgtgccagggcagccggtagccctgggctcccagaacagcgttgtgtggggcaggaggtgaggtcagagcttacaggggcaggtgggaggtggga

SEQ ID NO: 90861 - DNA, 1069 bp, Homo sapiens
agaaggcttcgggtttggggtgtatttcgtggacagagtgggtaggactggctcatggcctctgtaaatggctgctggcgggactgtctgcctagcgggtgcccttggaacctagcccttggtgggttttgaggaaatgattcctgaatgaggagtcgattgccgtgtgaagggctggtggcacggcacccgcgtgagctacgcgtgccctcagtgcgcttctggattgactggccatgggtgctcacagacatgcacattgtgccaccacattgcagtaacccccatgcttttgtaggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaaggtgtgctgggcctggcatggtgcccgccgcgggtgggatgggagcagccgtcttcacgtgtgtggcctcagccttgtgggtcagggcctgaccgtgtctctctctatttccagaaggcagaaaatgcagaaggacagacgcctgccattgggccggatggcgaggtgaggaagcagggtttcttgtggaagtatcaagctagccctaaggcgttggtctgtttcagactttaaaacctgtgttcttttaaaattacgaacaatgatatgtgatgatggtgagaatcccagggtgtcctctgacgcccatcccacccgaccccacatcccacatgttgtgttttcttccagacctttttctatgcatgtgccacaggattcatctttcaggttttactttgttgtaacgtccgacttacaggagaggtgcaagaaccgtccagagatgtcctgtgtgttcttcacccagagtctccattttcacgttttgtgttttgttttgtttctttgagacagggtctctctgtcacccaggctggattgcagtggcggatggctcactgcagccttgacctcctgggctcaagtgatcctacccttcgag

SEQ ID NO: 90862 - DNA, 1025 bp, Homo sapiens
gttgatgggttatatatttttactggattactgagtatacagtttacgcattttcccaccactggccatgtttgcctgccattttctgtgcaaacagttgagtgggtgcttcccaccttggcctctgtaagtgtttggtctggaggccctgcaacctcagtgtcacacgaatgactctttttcagcctctggacgagaccagccagatgagcgacctcccggtgaaggtgatccacgtggagagtgggaagatcctcacaggcacagatgcccccaaagccgggcagctggaggcctggctcgagatgaacccggggtgagttgggccttgcattccagatgcagtggggatccaagtcctcggtgggccttgttccagggaggtggcagccaggagcaattttacttctgtttgaattcccggcaggtttggtagggaaagtgaattctgctggctctgagcagatttgtatgaaagcccttacattttttctaggtatgaagtagctccgaggtctgatagtgaagaaagtggctcagaagaagaggaagaggtaagagtgcatttcctggctttcaaggctctcagtgcccactggcagtgacttccaccctgtgtgttgtgaccgtctcctgccctggctgggcatcttgtggggcagggaacagcagggcccaggcctgcccgaagtcggtgctttagagctgtcctatccaatagggcagcttctggcgacatgtgaccatttccattttaaattaaatcagtcacattacataaaatttaagactcattttctctttcacactggctgcatttcaggtgcttggcatcccttatctgggaatggtctgcctcatttgcccattttttttttttttttttgaaacggagtctcactctgtcacccaggctggagtgcactggtgcaatctcagctcattgcaacctccacctcccgggttcaagcaattctcctgcctcagcctcccaagtagctgggactacaggcgcctgccaccac

SEQ ID NO: 90863 - DNA, 1050 bp, Homo sapiens
tgtttaaggcctgtatttcagaaagctcccaggctttggaaatccctctcttaatcttgaaatgatgttcaggcagtgaattcctcacgaagtcgccctgaagccctcttggtttcctgagtgcaagtgtcccgtggtgtgggcaggtttttcctgtgtgctgtgtggggcatggacaggcagacaatgtaacaggtgggagtgagctgttgagatgtgtattagaaatgtcacacgtgtccatcgttcgcacagtcatcctgcagcttcacagacgttattgctaaggatgaggctaagcgataaagaatcagtttggttcagaggaaaaatccgtggtaaaggcagtagagggtgggatgtggcttaggcagaactcgtggctggcggtgtcttgactctctgaagtgggaggaccctctggtgtccgacccggccttcagtcctggcgtggccgcatctgtccttgcagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcgtgagtacccgctgccagcaacatcccacacgccgctcacacgctcctgtgtttgtttcctaagtttgccgcagtagaataccacaaacgaggtggcttaattacagaaatttgttttcctggaggccagaagtccagggtcaaggtgtagcaggttgcttcctcctgaggcctctcttcctgcttgcagggatacgtgcttacatgtatctcactgtgtcttcacatggtccttcctctgtgcgtgtctgtgtcctcatctcttcttcttagaaggacatgggtcaggttggatgagggtgcatcctaatggcctgctttaacttcattgcctctgtattggccctgtctccaggtacagtcgcatcctgagctgctgggggtcaggactgctccaccagcctcggggctgtg

SEQ ID NO: 90864 - DNA, 1044 bp, Homo sapiens
gtcaccaacccagttcccctgagaccctccacaccagcaggacaagtcccccagtcagcaagatgtgtcttctgccagaacgtgctcggcatttttctgtgctgtagattcatatgtgtgattttgcagggaagccagattgcttttttgcaatttgcattgttcacctgccaatagtcatggggtcacgggcctgtctctgcccaaggcttgcaagaggctacgttgtgtggctccaactcggtgagtcagccccggggcaggacgtcaggcctgtgctctccacccagctgcgctcttccacctggagccttcctggctgctgggcgcagagtgggagattctccccatgtgccgggccacctgctgccccctgccctgattgcccactctggggcccgcagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtgggtttgcccagctgtgcccatgctgacggttccaggtgcggctggctttgctggttggaacgtgttgagcaccagctacagctggctgggcctgtgctgggtgcctggtgagagtctgcatctgcatggagcaggggagccctggaacccaaggctggggcagccacaagggccccaggggagcagggcagaggtcatggtggtgaatctcggaatgctcggggcgtctctgaccctatgctccaggtgcagagtggatggtgaggaagatggccctgaggcagctgtgggaccgcaagcgtgtggagagcacagctagaggctgtagcgtgctgtaggcccctttaggtgccctcagaactcaccctcagggcagtgggaaggaaacttggaa

SEQ ID NO: 90865 - DNA, 1029 bp, Homo sapiens
ataggttagagcacaaaatcccacttcctgtcagggggccaggtgcctgtgcgggctctcctggccacatcaggaggggccgtgggcttggggttgccccccggccccccatcatggctctgggttttcaaggcctgctgcagccacacccctgggcccagttcccacagcaagacccatggactcggggtccccggctgcagttgtccctcttggctctttgtttcctggctggctgtagagaggcccccagaagatggctggggggccctttctggcccagtaaccctctggtatctctgcctggtgcttcctctcattgcccaggtctcccctcttctccccagctgtgagggtctcctcacccacaccccagtgtgctctggtcagagctcatatgacagggccgagggggtcagagctgggttcggatggggggagtcaggcctcaagccaccttgggccctcgtgagcattatgtgtcccctgcaggtggagtacgtcatcaagtgcgacatgtctgcgctgcagcgagtgctctaccgccacatgcaggccaagggcgtgctgctgactgatggctccgagaaggacaagaaggtgggccccagagtcccccaactgcattccccactgggtgtccaaggccggcagcgtggcaggcagagcagagcgtgctctgaccatcgggtcatgatctggtcatgatccccagggcatctggccagccctggttatgatggctggtggcttgtgtcaggacacactgactcagctgccagtggcttctcctttgcctatgaaacactggctccttctgcaattggcagcctgggcccagcactaaccccagcagggttagagtgttctagaatgccccccttctctgttattaagtgaaaggaagggagcgggctgtctcctgcaggggctgctctgagaatcccaggccccaggccccacctgcctggctctcctcaccagcagtgaaattatcctcccaggaaatgcaccagaccccttgattct

SEQ ID NO: 90866 - DNA, 1114 bp, Homo sapiens
cctcagtgtccacatctacaacacttggggtttggctggagagaacatgagaagccgaggtggcccttccttctgggtctagcagagcatgggtgtctccagtgtggcatttgctcctggggcttctttatcgggcaaggggacaaggtctggcttcccggagcatccctgttccagccccgtgttgtgccggccatgtgactcacagctcctctcattttcatgagtgtctgggtttgacgagaaatacatgtgccaccctggtgatacgcctccccagcgagggtggccgggcttatttcagttgggggaaatggctttgctgaagctttgggtgggtgacgtctgcttaggatgcatgtctgtgcccttgaacccggcgcctggcctggaggcgggcgatgcacctcctgccttacctgcctgcagggttccaggtttaacatcctgcgccttctctcctgcctcctccacactccaggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggtgagtatgagccagtgaggcgtttcttacagggttttgttgttgtggctgccacagaagctcctcactggcattccctcctgtgaggcagggtgaggcccaggcgctctgggtccagtggccagagtgggcctagccacaggctgagcatcttgggcactcggcactgggacaggccgtggattggacgccgggtgtcctgactcctaggctgacagtctttccacgacaatgctgggcgcactggggaaggggtgccctgtgcacttttagctggaagtgacagaattccataccatgtggacacaggaaagaaagcaccaataggcttacatagctctaaccccaggaggttaaacatccttcaggcacagctggatccaggcatgcaggtgatattggagagacttttctccagctctttgctctgccttcttccatcttggcttcctttccacctgctcag

SEQ ID NO: 90867 - DNA, 1339 bp, Homo sapiens
cagcctgggcaatattatgagaccccgtatctacaaaaaatttttttaattagctgagtgtggtgacacgtgcctgtagtcccagctacttaggaggctgaggtgggaggatctcttgagccctgggagttcaagactgcagtgagctatgatggtgccactgcactccagcctgggcaacaggtcgagaccctgtctctaaaaataaataagtaaataaaagaaatagatggggagagtgtggaacagaggtgtcaacatcacctccgggtgaagggatttcaggagcacgttcttttctgtacagagaagatagttctttttttttggtcaagaaattcaaccattagttttttaaagacaagcttgggtggggtgcctgctgggggcagtgctggtctttcactgcagcccaggcaccccttgagagtcccagtgtgtgttatgccccgagccagtcaagctgaagggagagcgggtgcgggggccctcctccgtgtcccagcccggcccctgggattgcgtcgcggcctctgcttgtcgacctgggtgctggctgtcctattttactactattgaccctgaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacaggtaagcgaggaggcggggagggcgggggctgtaggggtccccgtgggagcaggcctggcatctgcactctgactctgcacactcaggcttgggccgctcactctttcactcatccacaaacactgactgaatctctgtgtctttgagcctggccctgaggaacatgctttctggaacagggaagcacacatgtatctgcggtgatgagagggaatgtcacatgtggtcgagaggagaggcaggggtgcgggtctcggagaaggggacattgcagcagagccttgagagaggggaggttggggagagtgcaccagcagaggccacagcaggcggagaggctctgccaaagttgtggcctggtggcctcaagggatgaggtgggatgaggggttatatggcagtaatgggtgctgcccgtgtggccaggaggttggggacaagaggctggcatgtctggagcagagaaagtggcagccctctcctgtccttgcaccctcc

SEQ ID NO: 90868 - DNA, 1036 bp, Homo sapiens
gacatgtcctatatacgaggcagcatgcggttccagctgtggccacggcccagcggcggatcataacgtgttggtggatcatgagtgccatttatatgtttttcatttactaatatccttttccgtgagcgactctatatgggtaccatttaaataagaagaaaggaatgttctcagcaactccccagggaggcatgtgcaccttctgccagcccagggcaggtcacagagctgggcaggagccagcaaaggtgtaaggcccatgcctggcccaggactcacccagtcttccactctccaaggtcttatttcacttcctggtacacactggccagtacggctgtccccgtaatgggagggttgtactgtttgattttaaataacagtttgctgttagtcatgaagcagagcgtgggggaattgtatctgttggaggggaaagtgaagggagcccacatgcatggtttggagagaatcttaccaagtgtgaagttttagaggatggtaacaattggagtgcctaaattaatgagtcaaaattaccgcgcaaggccagctgtggtggtccacacctgtcagcccagcactttgagaggctgaggtgggaggatcacttgaggtcaggagtttgagaccagcatggacaacatggtgaaaacccatctttactgaaaataggaaaacaattacctgggcgtggtggcacgctttttgggaggctgagacaggagaatcacttgaacccaggaagtggaggttgctgtggaccaagattgcaccactgcactccagccttgggtgacagagcaagacgcccactccaaaaacaaaatactgcttaaaaaggttcttttagccagatgcggtggctcatgcctgtaatcccagcactttaggaggccaaggcgggcggatcacttgaggtcaggagtttgaaaccagcatggccaatatggcgaaaccccctctctactaaaactacaaaaattcgccgagcgtagtggtgcatgcctgtaatcccagctactcgggaggc

SEQ ID NO: 90869 - DNA, 1578 bp, Homo sapiens
tccagaagctacaagaaagcacatgtgcaggccaggcatggtggctcacacctgtaatcccagcactttgggatgctgaggcgggctgatcacctgaggtcgggagtttgagaccagtctgaccaacatggagaaaccctgtctctactaaaaatacaaaattagcctggcatggtggtgcacgactgtaaaaaatcccagtgactccaaaggctgaggcaggagaatctcctgaacctgggaggtggaggttgcagtgagccgagatcgcaccattgcactccagcctgggcagcaagagcgaaactccgtctcaaaaaaaaaaaaagcgcatgtgcaagaaatagctcctgagctgagttggaatttctcatccttaaacaatgtgggaacctgctgaggtggggtgggggctcccgggtgggcggactcgggggtgatagccgccggttctgccttgcagcagcagtggacgtcagctcagcgaggtcttcatccagctgccctcgcgaaaggagctgcccgagtactacgagctcatccgcaagcccgtggacttcaagaagataaaggtaaccctgacgttgtacctgcgccccgcatgtgcccggaggggagtctgacccaggggcacccccatctgagagctgtggtgtgtgggcagaatgaccagaaaccacctaggcggtgccttgggctacctggttagggacctggtcgtgggcttttggggttccttgtaagggttgggggtgtcctgagggatgtcagtgggcagtcggtgttgggtgttccttcaaggtcccactcacttagtgctgggcctcagtcatgcagttcccatgcctagtgagccaggttaccgaggctggcgcttcggccacatcctcataggcacgaggaatcctagcccgtggggtctccagcacacagccaggcctgcgggcaggcgaggcggggtcctgaggtaagacctgctcctcccgtccactgcaggagcgcattcgcaaccacaagtaccgcagcctcaacgacctagagaaggacgtcatgctcctgtgccagaacgcacagaccttcaacctggagggctccctggtgagggcaccgctgggggttggggatgggccactcccacagctgggctttgacccaacccgcccctccttcccttctgaattgatgggttaaaaacaagtcccgctagctgtggtggttcgtgcctgtaatcccagcactttgggaggccaaggcgggaggatcacttgagaccaggagttcacgaccagcctgggcaacataacaagaccctgtctttaaaaaaaaaaaagaaaaaattaaaaatttccaacttgggatattttagcaattacaaaagcagtatgtatttaccgaagaaaataaagataggcacaacagaagaaatagactcagagtcctctgtctgttggaattttattttaaattccctggggcacattctcttcaaaggaatcctgtgggtttgttctttcctgtgatagaattgacacatacacagcctcaacttggcaaactttcttaagtgtctttgggatt

SEQ ID NO: 90870 - DNA, 1020 bp, Homo sapiens
aattttgtatttttagtagagacggggtttcaccatgttggccaggctggtttcgaactgctgacctcaggtgatctgcccacctcggcctcccaaagtgctgggattacaggcatgagccaccatgcccagctgtagtacaggttttaatatgctaaatactcttcctttctttattaatgtgcatggaagttctaatatttttttcccataccccagagagtccatattttggaatcaacaacactagcctttgttgacaagtgtctctcttgggttccttctttgtgtcctccactgaattttggggttcataaaatttcatttgttgtgcttgcttaattccctgggaatcagactgttcctgatcggatgacatttctggttaattctttagttggcaggaaatagacacaggaaacgtggtcagtttctgattctggcgttgagagaccctttctccttttcctctctctcagtgggcgacagatgcgaaagaaacgagttccagtgccaagacgggaaatgcatctcctacaagtgggtctgcgatggcagcgctgagtgccaggatggctctgatgagtcccaggagacgtgctgtgagtcccctttgggcatgatatgcatttatttttgtaatagagacagggtctcgccatgttggccaggctggtcttgaatttctggtctcaagtgatccgctggcctcggcctcccaaagtgctgggattacaggcaccacgcctggcctgtgacacgattcttaacccctttttgatgatggcggctggaaaagtggccagtggattttgatgtattcaatcatgaattaggaggtggggagagaatgaattattggagctttccttaaagccattaaatggctctattgttttttcaattgatgtgaatttcacataacatgaaattaaccagctcagtggcattaatacatctgcaatgctgtgtggccaccacctctatcttgttccaaaactttgcataacctaatgtctt

SEQ ID NO: 90871 - DNA, 1170 bp, Homo sapiens
ctcaggaggctgaggcaggagaatggcgtgaacccgggaggcggagcttgcagtgagccaagatcgtgccactgtactccagcctgggcgacagagcaagactctgtctcaaaaaaaaaaaaaaaagtgggattgacattctcttcaaagttctggggttttcctttgcaaagacaggattggcaaggccagtgggtcttttttgtgtgtgtgtgtgtgacggagtctcactctgccacccaggctggagtgcaatggcaggatctcggctcaccgcaacctcctcctcccaggttaaagtgattctcctgcctcagcctcccgagtagctgggactacaggtgcccgccaccacacccaactaatttttgtatttttagtagagacagggtttcactatattggccaggctggtcttgaacccctgacctcacgtgatccacccgccttggcctcccaaagtgctgggattacaggcgtgagccactgtgctcggcctcagtgggtctttcctttgagtgacagttcaatcctgtctcttctgtagtgtctgtcacctgcaaatccggggacttcagctgtgggggccgtgtcaaccgctgcattcctcagttctggaggtgcgatggccaagtggactgcgacaacggctcagacgagcaaggctgtcgtaagtgtggccctgcctttgctattgagcctatctgagtcctggggagtggtctgactttgtctctacggggtcctgctcgagctgcaaggcagctgccccgaactgggctccatctcttgggggctcataccaagcctcttccgcccttcaaatccccccttgaccaggaggcattacaaagtggggatggtgctacctcttcgggtttgtcacgcacagtcagggaggctgtccctgccgagggctagccacctggcacacacactggcaagccgctgtgattcccgctggtcgtgatccccgtgatcctgtgatccccgccccgtgaggctgaacacatagtgacgcttgctagccaagcctcaatgacccacgtaacatgaagggggaaaagccagaaagttctgccaaggagcaaggccaagaatcccgaagggaaatggactttgaagctgggcgtcttcttggctgtcttaatacaagtggcacatccaaat

SEQ ID NO: 90872 - DNA, 1354 bp, Homo sapiens
gataaattcttacccccacaccactggtccagatagtcagtgctcacccacaacattaaggatattccaaatttgaaacattccaaaatcagaaaaatattccaactctgaaaatattccaaaatccaaaaaaattcaaaatccaaaacacttctggtcccaagcattttagagaagggatactcaacccaaaataaggacagcaattctataaattgtgctaccatcttgcaggtctcagtttaacagctttacacctattagcgcaccagtgctcatagcagtgctgggaaatgtgtacagatgaggaaactgaggcaccgagagggcagtggttcagagtccatggcccctgactgctccccagcccgcctttccaggggcctggcctcactgcggcagcgtccccggctatagaatgggctggtgttgggagacttcacacggtgatggtggtctcggcccatccatccctgcagcccccaagacgtgctcccaggacgagtttcgctgccacgatgggaagtgcatctctcggcagttcgtctgtgactcagaccgggactgcttggacggctcagacgaggcctcctgcccggtgctcacctgtggtcccgccagcttccagtgcaacagctccacctgcatcccccagctgtgggcctgcgacaacgaccccgactgcgaagatggctcggatgagtggccgcagcgctgtaggggtctttacgtgttccaaggggacagtagcccctgctcggccttcgagttccactgcctaagtggcgagtgcatccactccagctggcgctgtgatggtggccccgactgcaaggacaaatctgacgaggaaaactgcggtatgggcggggccagggtgggggcggggcgtcctatcacctgtccctgggctcccccaggtgtgggacatgcagtgatttaggtgccgaagtggatttccaacaacatgccaagaaagtattcccatttcatgtttgtttcttttttttcttttctttctttattttgtttttgagatggagtctcactctgtgatttttttcatctctaaatttcctacatccatatggccaccatgaggccccaggctggccgatggttgctgttagcttattgggaaatcactgtttggaaggtgctggttgttttttgttgtttgttgtttttgtttttgtttttgttttgagacggagtctcgctctgtcgccagggtggagtgcagtggcgcgatcagctcactgcaacctccgcttcctgggttcaagccattctcctgcctcagcctcccaagtagcgcggattacaggcatgtgccaccacctccggctatttt

SEQ ID NO: 90873 - DNA, 1111 bp, Homo sapiens
ctcccaaagtgctgggattacaggtgggcgccactgtgcctgttcccgttgggaggtcttttccaccctctttttctgggtgcctcctctggctcagccgcaccctgcaggatgacacaaggggatggggaggcactcttggttccatcgacgggtcccctctgaccccctgacctcgctccccggacccccaggctccatcgcctacctcttcttcaccaaccggcacgaggtcaggaagatgacgctggaccggagcgagtacaccagcctcatccccaacctgaggaacgtggtcgctctggacacggaggtggccagcaatagaatctactggtctgacctgtcccagagaatgatctgcaggtgagcgtcgcccctgcctgcagccttggcccgcaggtgagatgagggctcctggcgctgatgcccttctctcctcctgcctcagcacccagcttgacagagcccacggcgtctcttcctatgacaccgtcatcagcagagacatccaggcccccgacgggctggctgtggactggatccacagcaacatctactggaccgactctgtcctgggcactgtctctgttgcggataccaagggcgtgaagaggaaaacgttattcagggagaacggctccaagccaagggccatcgtggtggatcctgttcatgggtgcgtatccacgacgctgagggctgcagagggaatggagggagcaggaaggagcttcaggaactggttagtgggctgggcatggtggctcaaagcacctgtaatcccagcactttgggaggccaaggtgggtggatcatcaagaccagcctgaccaacatggtgaaacctcgtctctactaaaaatacaaaaattagccgggtgtggtggtgggcacctgtaatcccagctgctcgggaggctgaggcaggagaatcacttgaacctgggagatggaggttgcagtgagccaagacagccccactgcactccagcctgggtgacagagtgagactccgtctcaaaaaaaaaaaaaaaaactaaacaaaaaactggttagtggctagacaacaggatggtatcttccaagcccatggctgactcagcagctc

SEQ ID NO: 90874 - DNA, 1586 bp, Homo sapiens
actggggaggactttggcttttgccctgagagcggtgggaagtgactgaatccggtactcaccgtctccctctggcggctcctgggggaacatgcttggggatcaggctgggggaggctgccaggcccaggaggtgagaagtaggtggcctccagccgtgtttcctgaatgctggactgatagtttccgctgtttaccatttgttggcagagacagatggtcagtctggaggatgacgtggcgtgaacatctgcctggagtcccgtccctgcccagaacccttcctgagacctcgccggccttgttttattcaaagacagagaagaccaaagcattgcctgccagagctttgttttatatatttattcatctgggaggcagaacaggcttcggacagtgcccatgcaatggcttgggttgggattttggtttcttcctttcctcgtgaaggataagagaaacaggcccggggggaccaggatgacacctccatttctctccaggaagttttgagtttctctccaccgtgacacaatcctcaaacatggaagatgaaaggggaggggatgtcaggcccagagaagcaagtggctttcaacacacaacagcagatggcaccaacgggaccccctggccctgcctcatccaccaatctctaagccaaacccctaaactcaggagtcaacgtgtttacctcttctatgcaagccttgctagacagccaggttagcctttgccctgtcacccccgaatcatgacccacccagtgtctttcgaggtgggtttgtaccttccttaagccaggaaagggattcatggcgtcggaaatgatctggctgaatccgtggtggcaccgagaccaaactcattcaccaaatgatgccacttcccagaggcagagcctgagtcactggtcacccttaatatttattaagtgcctgagacacccggttaccttggccgtgaggacacgtggcctgcacccaggtgtggctgtcaggacaccagcctggtgcccatcctcccgacccctacccacttccattcccgtggtctccttgcactttctcagttcagagttgtacactgtgtacatttggcatttgtgttattattttgcactgttttctgtcgtgtgtgttgggatgggatcccaggccagggaaagcccgtgtcaatgaatgccggggacagagaggggcaggttgaccgggacttcaaagccgtgatcgtgaatatcgagaactgccattgtcgtctttatgtccgcccacctagtgcttccacttctatgcaaatgcctccaagccattcacttccccaatcttgtcgttgatgggtatgtgtttaaaacatgcacggtgaggccgggcgcagtggctcacgcctgtaatcccagcactttgggaggccgaggcgggtggatcatgaggtcaggagatcgagaccatcctggctaacacgtgaaaccccgtctctactaaaaatacaaaaaattagccgggcgtggtggcgggcacctgtagtcccagctactcgggaggctgaggcaggagaatggtgtgaacccgggaagcggagcttgc

SEQ ID NO: 90875 - DNA, 1049 bp, Homo sapiens
tgtatcccacgcacacactgtaggatgtaagttccaggagaagctgctcgctgctttgccgttagaaccccaccctgcacagagcaagcgctcgacctatggagaaataaacagccgctttctctcccgcgcaggcgcatcgggaaggataacggagcctcccccttcctgcgccgattggtcatcaccgatgactgacggaggagtggtcgcaggcgcaccaggccagaccaaaggcggcttagcccagtctaagatcctgttccccatgcctattggccattgcttatgactgacgtatcaaaaaatccaatggaaagcaacctcttctggaagagggcgggccccgcggacagtcaaatttgcgcgggttggagcctggcgtagtcatggccgccttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgaggtgagggtcggagcgtggtcgcgggcccacgggggaaggggcccgggtgctgggagggggcgaccaggcccacctcaaaaccccttctctcctggactctcccatctcctgccctatgccccctgggacggccccctctgagccttagtttcaccatctgagaaatcggctttatgacagcaaccatcccccaccccccaggggtttagtggtaaatataggagtctggaggggttggccccttctgagctctccgtgagcaggagctgggggtctcagggtttgaactggggctcaggagtcaaagctccgggtttgaatcctagcacccatccccatgtccgctgtgagacttgaggtgagtttcttaaattctctgtgcctcagcttccttccttgtcaaatggttgtgacaatagcccatcccttcttcctgaaggcattcagatgttttatggagcatctgctgctgccaggccctgggctcaccgcaacctcca

SEQ ID NO: 90876 - DNA, 3490 bp, Homo sapiens
ctcacgcctgtaatctcaacactttgggaggccaagatgggcggatcacctgaggtcaggagtttgagaccagactgaccaacatggagaaaccccatctctactaaaaacgcaaaattagccgggcgtggtggcgcctgcctgtaatcccagctactaaggaggctgaggcaggagaatcacttgaacccaggaggcagaggttgcagtgagctgagatcatgccattgcactccagcctaggcaacaagagtgaaactctgtctcaaaaaaaagaaaagaaaaagccagggtcctctccaaagcccaccaggccctgcacaaccaccctcaccttccccactactgtttctctccccctctagccacactggccttattgccacacccctctgcacttatcccagggcctttgcacgtgctgtttccgctgcctggaatgctcttccctgctcgctggctccttgatgccgttcacagtcagctgagaactcaccctccctgaccagccactgtccaccctcattcctttgcatccctcacccccggtgaacatcctcaaccacagtcatgagtttgcttcttcaaggcggtgcccccagatcgccacctccttggggccaggggccacgcctccctcctgcttacccatcatatctaccaggccagccaccacgttggcgcctcgggggattggaaaggatcccaaacaaaaagaattctgcttctctgtttcagtttgccccaatgtcagatgacgagagccctacatcatcctcggcagaagagtagccgtgagggaggcggggaccagccagaccgggagcaaaccgtcccttgtccccgtctcctccctgttcccgttcctccctggcccaccccactcacactccccaaggcccacggctcaaaggcaagcgagctctccctctgcttccctgggggagccccgacggccacaggactccagctccaagtgggttttcttggctcccctgttcaaagtggccacagcgcagaccgaagcaaaattcttgtatacattggcgccagggctgatgctggggtgtgggttttatgaagaacattgagaacaatcagctggtaattatggatggaggaagagggagaggaaaaaaatattgtatttttgaatcattgttgcaggagggggtgggaatcttaggatttgttgccagatttgaaagtcactggaacttgcatattttcattttaatcctaagtgttattacgcaccagttggggttcacccttcatcccccacatttaattgtctgatatagaatagtgttgtgtccactgccccgctagacggctttcttaggggaattttcttctggttgtttcacaagacagattctgtccttgtcacccgggacagaaaactcagtcttttcaccctcattcagatgaagggactcaggacaggctctgtgacttacagggacccaatcaattcacaatgagaaattaccggccaggcgtggtgactcacgtctgtaatcccagcactttgggagggcaaggcaagagcttgagcttgagcctagacgttaaagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagaaagaaaagaaaaagagacaaattacccagaaacccctcccttccccacatggaggccttggcaaatgttaattttcctagaaaatccttcagacctgaagacgcaggaaaagaatctggctctcagggtggcttctgcgtccccgccgccaggccccagactatggtcacagggccgtcctgttcctccccgggactccagaatttctctcctcaaaggaaagaaaacagggcatgcgcttgttggcaaaacgcagggccggctcccaaaaaccccatgtgtgtacgattaaaagttggccgtccccaggcctcccagcgcaaacttcaagagacagggctttgctgaaaaccaaacatgggccagctgggctttttaacaacctagagactttccggagctgcctggaacagagcctgcgggaaacggggcttgccagagacactcacagtttccttcatggcctgttttggtcccctaagaatctccacatcattgtctttcttgtgccttttccttggtgagcaacagaaagggaagggttccaagcctctaaaaatgtgctttgtgatcaggagtgcgctccaaaccaaatacgcgcgctgccctttcgaggccagtgagctcagcctccaaggctttaaagccacatttcagcaagagaaagcgctgagagctcgcaggttcattaaagaaggcaaagcactggtttctctccttagaaaagtaggtttcttggcttgatgtagactggcttgctttgatttttagtgaagggaatgtacgtaaaacaaaatagggcttggctggtcaaaggagacaagcaggatggatggatggatggatggatggatggatggatggatggatggatgaatagatagatggtgtttgcatgtaaattgcagagaaaacaaaaccaaagctgattggaaacaattaattgtgggtgtctgagggggaaggtcgcagctttgggcagctttgagaagcggtacaagagttctgtgcctgtgtgtccagccctggagccagccagtgcatttattttaagctcttagaagcaactccttggcccaggaatgcgtgacccctgagatgggtccacgcatctctctacacttccttctctccgtgggatactggactcgtgcctctgcgcccattctcttctcacgcatatccatgagctttaatttcactttctgatcacggtacgtccataaagccagtattacacttaaatgaagtattcttttttgtaatcgttttttttagaaggtaaacaaatttaataaagctaccaataatgttgatgattctgtgtcttttcttttttcgctgtgctcccttttaagctttaagatagatatctttccttttttttttcttttttctttttttgagacggagttttgcttctcgtcacccaggctggagtgcagtggcgcgatcttggctcagtgcaacctctgcctcctggattcaagtgattctactgcctcgattctcccaagtagctgggactacaggtgcccaccacactcggctaattttgtatttttggtagagacgggggtttcgctatgttggtcaggctggtctcaaactcctgacctcagatgatccacgcgcctcagcctcccaaagtgctgggattacaggtgtgagccaccactttttgtttttggagagtctcactctgtctcccaggttggagtgcagt

SEQ ID NO: 90877 - DNA, 1109 bp, Homo sapiens
gagcctggggaggttgaggctgcagtgagctgcgatcgtgccactgcacgccaacctgggcaacagagcaagaccctgtctctaaaataaagcaaaacaaaaccaaaagcactactggcatgaaatacattcaccctgttgtgcaaccaacacctccgtctagttccagaacgttctcttcacccccaaaggaaacctgtatccatcatttcctccgcccccgcttctcccagcctctggcaaccactcatccgctttctgtctctgtggatttattactcccctggtgacgggagggttgtttgagattcaggaggagatcagcaagttgagggtacatttcaccatcagagtatgtgggagctacagcaggttctagaccagggggtgtcctgccctggggcctgcatgaaccataatcctgttccttgccctccccaggcaggacagacggccctgatgctggccgtcagccacgggcgggtggacgttgtcaaagccctgctggcctgtgaggcagatgtcaacgtgcaagatgatgacggctccacggccctcatgtgcgcctgtgagcacggccacaaggagatcgcggggctgctgctggccgtgcccagctgtgacatctcactcacagatcgcgtgagtctccaaccaggtgcaccccggggagggcgggagcacagcatggggacgtcattcatagcaccggatactttgcaggatgggagcacagctctgatggtggccttggacgcagggcagagtgagattgcgtccatgctgtattcccgcatgaacatcaagtgctcggtgagtctcaatccggccgggtaggcacgggatgggtgggtctctgaaaggacagagatttgttgtttttgtttttgaggcagagtctcactctgtcgcccagggtggagtgcggtggcacgatctgggctcattgcaacctccgcctcccggcttcaagccattctgctgcctcagcctcctgagtagctgggataacaggtgtgcaccaccacacccggctaatttttgtatttttagtagagacggggtttcaccatgatggtcaggctggtctcaaactcctgacctcgtga

SEQ ID NO: 90878 - DNA, 1141 bp, Homo sapiens
ggcagagtcctgccctgggagggtctgaagggggaggcagagtcttaccggaaaaagggggtagtctaagccgagggatagagccctgtcctgggggatttgagaggcgacatagcctagcgccgggagtctgaaggggaggcatagccctgctctggagggtctgagagcagacgcggttgagtaccaggtgggctcccatctcttcggcaaataaaccccaactctccccaggcatcagtcttcaccctgagaatggggacaagaggattcaaaggtcctggtgtttctcccatccccagggacccctggcccagcctccccacctgccttccctgccaaggaccccgatccaccctactccgtggagaccccctatggctaccgcctggacctggacttcctcaagtacgtggatgacatcgagaagggccacacgctgcgacgcgtggcagtgcagcgccgcccccgcctgagctcgctgccccgtggccctggctcctggtggacgtccactgagtcgctgtgctccaatgccagtggggacagccgccactcagcctattcctactgcggccgtggcttctaccctcagtatggtgctctggagacccgcggtggcttcaatccgcgggtggagcgcacgctgctggatgcccgtcgccgtctcgaggaccaggcggccacacccaccggcctgggctccctgacccccagtgcggccggctcgacagcctccctggtgggcgtggggttgccacccccgacaccacggagttcaggactgtccacaccggtgcctcccagtgccgggcacctggcccacgtgcgggagcagatggcgggtgccctgcggaagctgcggcagctggaggagcaggtgaagctgatccctgtgctccaggtgaagctctcggtgctccaggaggaaaagcggcagctcacagtacaacttaagagccagaagttcctgggccaccccacagcgggccggggtcgcagcgagctctgcctggacctccccgatcccccagaggacccagtggcactggagacccggagtgtgggcacctgggttcgagaacgggacttgggcatgcctgatggggaggctgccctcgccgccaaggtcgctgtgctg

SEQ ID NO: 90879 - DNA, 1042 bp, Homo sapiens
tctccatccccaccccccaccgcggccggggcgcccgggcggctggagggggcggtgccggctgggggggcgggaccagccggagggggcgtggtgcgggcggagccacctccgagggccgggcgcccaggctgcggcgcgcgcgaagacgctcgggcggcgggacccagggaaggcagcggccggagcgcgcaaggcgagtgggacccggggctgggtaggggttcaagtctggttcggggatcgagtgtgcaccccctccacacacacctactaccctaccccccgcctccaaccctgggacacgacctcgctggtctcaacgagccgctgcctccaactccaccttctgtgcccaaactttccagacttggagtgtctgtccccgcgtccctgccccctcctcgtctttgaccccatacccccatcgattcctcccagtaccccccatcgattcctcgtgccctgcccgtttctcctgtcttggctcccctctgcccgctctcccctgtctctgtcccactttctgcctctgttcctccccggctctgccctctccccgcactgtcccccctcgccctcctccgcggccatgccccagacggcgggaaggcggccgggcgtccggccgggctgggcctgggcttggcggctgggccggcgtggggagcggcagctgtttgccattagcccgggatcccacaggccccgccccctctctgcacggggcggggtccttctcgcctccccccaccccgagtttggggcgggaagacccccccccaccaccaccaccgacctccgcgatgtgcaggccggtcttgggtggtgggttggggagacccgcgccccttccctgcgctccctacctgtcccctcttataggctccagtctctccatctctgtcttatcctgtcaccccttccccattccccaggggtcccatggcgagagaagggtctcagccacagacatccatctcccccaccacaccccctcgtctcctttctcttccccttactcgggacgtgctggtcctca

SEQ ID NO: 90880 - DNA, 1184 bp, Homo sapiens
ccacgcctggctaatgttttgtatttttagtagagacagggtttcaccatgttggccagactggtctcgaactcctgatctcaggtgatccatccgctttgccctcctaaagtgctggaattacagcatgagccaccaccacgcctggctgcggtggcttcaattttgcataagcatctgaatatgtcatccagatgtacaaaggcagggcaggctctgagcagtcatttcccagatacatgaattcatctttctgagcctcagtttctacatctgtaaaatggggatgattcataccttccgtggtggactgcaagagagaatcggagaatcccacagccagatcagggacaggagagatcccagaaggatccttggaggaagacgaggaggaggaggaagaggatgtgggctgggaggtctatggagttgggggccccatggccatgctgacccaccctcattctttttccaggaactccttgaacagagcaagtttccgaaaggcagacctctgagcccacaaggaccaaagctgtacctagaggaaccagcacccgggcctcagctgtctgtgctgcgaggggagtctgccctggtgcccactgggctgtggggtgaccacactgtacttggggctgggccctctgcccctgtgtccccatctgtgtgcactgatgcttcctcccttttttaatttaaaatggtttttataagcaacctgtgccatgtggtgcggtcactaggggctgggtcacatgctcatcacatgctcacagtccactgccccatatccacacatccctgcatcatcaatggggacaccaagaacatactgggtgccagggacatcgtggtgacaacaggcaaaaattcctgcccttgtggagctgatgttctagtagggaaggcaacacacaaataatgtcacatgcttacctgcaataacaatacctggtttttgtttgtttgtttttaacagacgctctcactcagtcccccaggctggaatgcagtgtcacagtcatagctcactgcagcctcaaactccggggctcaagcctcctgagtagcagagattataggcacatgccactgtgcctggcttttttttctttttcttttttttttttttagacagagtttcactctgtcacccaggctgcagtgcagtggtgcaatct

SEQ ID NO: 90881 - DNA, 3325 bp, Homo sapiens
gagttcaagaccaactagggcaatatagtgagaccctgactctacaaaaactaaaataaaattatttgggcatggtggcatgtacctgtagttccagctatgtgggaggctagggtgggagcatctcttgagcccaggagttggaggttgcagtgagctatgattgtaccactacactccagcctgggtgatggagtgagaccctatctcaaaaaaacaaaaaagataagtagcagtgaagaccatggagccctctgtgggagctgagtggaaaggctcaacccctatctgggataggggtggtcagggtgggcttcctggaggaggtgatggagggtgggtaggagcacggaggctcacaagggagatgggtagacaggagcacagtggagagaggaagacagtttggggaatcctgaccccacctcaccctcagggcgggctctacgaggcggtgaatgaggtctacaagaacctcatccccatcctggaagcccaccgtgactacaagaagctggccgcggtgcacggcaaactgcaggaggccttcaccaagatcatgcaccaggtgggcccaggaccccctccccagaccccaccctcagccccactcctcatccccactcctcatccccagggatctgctgaccttgacccttctcttccccacagagttccggctgggaggtgagtcagccttggtggacagccacctgcctctgggacccccgtgatgactggccagcagccatcagtgaacaccagggggcaccagaggagcatggccgctggcccttggggctggggctgtggccacaagggacccaccccattatttccctcccttccccaaaaatgcccccaccccccgccccagatctcgagggcagcttgtgactcacccagctgggagctctccagagacacccctccctctgccagggccagcttggtcactgcaggggggtggcggggtgactcttgactccctcatggtctcttggtctctttctcatctctccccagtctatcacgtggctctccctatcttggtatctcactgtctcttagtctctgtctctccctgcgtacccagcttccagcctcccccaggctctctgctcctcatttctggttaatgtgtcctcccgctccagcccccccgaatcccgcttcttccctgcttaggtctatttttaggcatctcctagtttggggagaatgttctggccaaagatggcagaaacccagagcccaggcaggcaggctgggtgggagctgggtggggagggcaggtcctcttcgcccccgcccccctcccgtctctgatctctccccccacggaatgattctcacggggcagtgttaaccaggaccctgggggttgagggaactctgacctctgacctctcccatgacattgtctctctgtcccccacacctctggccccaccatgtctgccccatcctccccggatcggccttggtaagtgaacatccagccattctacttcctttccagtcatggggtggtgtttttagggtggtagggagggggttccttcttccaaacttagggctggggacaggagcaggggaatgccatggaacaagggaaccagagccactgtcctagagtgagacacagccatcccttccctcagccatccaagcatttatggggtacctactgtatacccattcttgtgggcctcagggcacaggaaggagaatgccctagaacaaaggaggcagagcctccatcctagagtgagagacagccatccctctcctcagccatctatgcatgtattgggtacctgctgtataccctgtcccacgggcattagggacacacccgtaaacaatacagccccagtcctaacttcctattgcaatccatgccccaatgttctcagggccccctgcctgtgcccatgccctgatgttctcggggtcctcacactcccatcctgatattcgagacacctatctctggggcagggagacctccagcaggggcctcccggacaaccacaccctttctcacagccccagcgcgtgttcgggacgtatttccgcgtgggcttctacggcgcccacttcggtgacctggatgagcaggagtttgtgtacaaggagccatcgatcacgaagctggcagagatctcacaccggctggaggcacgtccttgtggttgggggtggaacggggcatggggctgccttggggctggagtaggggctgtccctgggtggccccgagtcagccctgtgtctccaggagttctacacggagagatttggcgacgacgtcgttgagattatcaaagactctaaccctgtggacaagtccaagcttgactcacaaaaggtgggtcccccaaccatttccccaaaatcttagattcacagagactccaagtgctgtttcctggggaccctcaaatcctctttctctgggaaaccccaaatcatatttcactgagggaccccaaaacctattcctcaggggattcccaaacatccagacataggaagacttggaaatgacaaagtccccagatcccctctctccaggaacagggcttgggctgtgcgtgctggggctgtgggatcctcacacctgaccctgcgcccaggcctacatccagatcacgtatgtggaaccgtactttgatacctacgagctcaaggaccgggtgacctactttgaccgcaactatgggcttcgcacattcctgttctgcacgccgttcacgccggatgggcgcgcacacggggagctgcccgagcaacacaagcgtaagacgctgctcagcaccgaccacgccttcccctacatcaagactcgcatccgtgtgtgccaccgggaggaggtgggtggggatcctgggcctggcgggggtggggaggtgaggggacatcagaccctgggaggggaggggagggtagacacagggacccagacccaaggtggttcacggacctcagacccagagaggggtggcacagggaccctagaccagatccccagggaggggaggggaggagaccagacccagggagacctgggaggcaagatgcagggaccccagacccagggtggcccagggattccagacccagaaagaggaggcagagggagcccagatctaggaaggcccagggaggagaggtgtggcccaggaagaggcccaggtaccccagaactgggctgagaagatatggagaccctgcattccaatctctaaactgaaacctctacctccagacccaggaggacccagggattctagactcacaaaggggaggcacagggact

SEQ ID NO: 90882 - DNA, 1057 bp, Homo sapiens
caataataaataaaataagtaaaataagtgaattccaggagcagacaaccagaaacccactcttggggactgttgtgagggaagacttctttttttttttttttttgagacagagtgtcgctctgttgcccaggctggagtgcagtggcgcgatctcggctcactgtaacctccacctcccaggttcaagagattctcgtgccacagcctcccgagtagctgggattacaggcgcccgccaccacacccagctaattttttgtaattttagtagagatgggattttgccacgttggccaggctggtctcgaactcctgacctcaggtgatccacccgcctctgcctcccaaagtgctggtattacaggcgtgagccactgtgcctggccatgagggaagacttctgaaatttgagacagggacagcacttaccaagggtttatctttctttccctctgtctttccctgccagagggcccaggtcagcggtcaagactggcctcaatgcttgactcagacacagaaggcgaaggggacattgcgggtaccatcaacccctctgtggccatggccattgctggtggccccctagcccctggctcccgggccagcatctcccaggggccaccaacggtgagtagggaggcttgtccccatagacatcatccactttgaatgagagaagtcatgtatcaagatacagattggccaggattcatctcacatggagaaaatggaaattgactttgattcctctctggccccaggcttctcgcgcaggctgtgccctctctgctgagtcaagccggaccttgctggcgtgtgtgctgtgggtgctgaaaaacaccgagccggcgctcctgcagcgctgggccactgacctgacactcccccagctgggacgtctgttggatttgctgtacctttgcctagctgcctttgagtacaaggtttgagggcgtgggcaggagatgatggaggaggcaggctaaggatgtacccagggacccagcgtgctgcgggctgagtgggaaggggtggactgtctttgtgcaga

SEQ ID NO: 90883 - DNA, 1767 bp, Homo sapiens
tcctaggggtggcagatgatcttggtgagagccaagcccctgtcggggctgaggtttgggtgtgtgggttgacaggcacctgtgtccccaggatgtggagctggccgagcacctcaacgccagcctggctttcttcctcagtgaccttctgtccctggtggaccggggctttgtcttcagcctggtccgggcccactacaagcaggtaggagtgggcgtgggcagggtgggcatggcatggatggaaggcggagcaatgttgacatcactgatggccacccctctcctgcaggtggccacgcggctccagtcgtcccctaatccagcagccctgctgaccctgcgcatggaattcacccgcatcctgtgcagccacgagcactacgtgaccctcaacctcccctgctgccccctgtcacctccagcctcgccctccccctctgtgtcctccaccacctcccaggtgggctgccttcacttctgcctcctctctttgacctacaacctctcaccttcagtccatctcctatggttccctcatctctgtccctttcacggtggaccactgcctaggtgaactaatcccttatgtttgacttttgacttctgacccttcacctctcttgccattctcagcaatttcccagaaggactaacctctgatttctctcccctaaatcctaactcccagcccagtgttccatctgctatttctcagtcctctgacttttgactccgtgccctgttacatcacagatgggttaacgtcagcccctcacttctggccttgaaacccatgcccactgtcacctccagatgacttaacatcagtctttcatctgtggctattggcaccatgatttctgtcacctccaagatggctttaatggtgacctgccacctctgacccttgaccgctggcatcccccatttttcccccactctgcagagctccaccttctccagccaagccccggaccccaaggtgaccagcatgttcgaactgagtggaccattccggcagcagcacttcctagctgggctcctgctgacggagctggcactggccctcgaacctgaggctgaagggtgagcagagctcctgtctagccccaggacaggtgggacagtccaggagccatgtccaccctgtcctgagcacctcattaccccatagggcattcctgttgcacaagaaggccatcagtgctgtgcacagcctgctatgtggccatgacactgacccccgctacgccgaggccactgtgaaggctcgtgtggccgagctgtacctgccactgctatcgattgcacgggataccttgccacggctgcatgactttgctggtcagtgggccaggggaagatggggtcacatgatccagggacttggtcacagaaggcacaggatagtaaaggtgggagaacacagtcactggtatgagtatagacattaggattagcagagcaggttaaagtgctaggacagactacttaagtcataacatctctgagcctcaggtttctcccctgtaatggagacagtaacaacaccaactacttcataaggttatgtgaaaatgtggggggctgtagtactgagatattgtcagcctacaatagatgggagatattattgtaccatttattattttctaagaagagcaaaaagtagggaacatccaagtgagaaaatgattggagtacattcattcactcattttcaacaaacatttataggcattgttgaggggggtggtataacag

SEQ ID NO: 90884 - DNA, 1031 bp, Homo sapiens
gcttccttacacacttggccctagggcctattccagctctgtgcccatcaccaaggtaacctgtaccctatgacaggcccaggggactcctagcagaacaagcagggggggcctttgggcagtcatttccttggattgctgggaatctggaaatctgggtgacactgaggctgggccttttcaatggaaggccctcacggtgcacagtgagttgccagggtatggctgggactggggtagctagagagccctcaagtgtcagagtaggtcccagggttgggtcgtctctgtcatcagacctcctgttcctgcgagcagcctcaccccctaaccagcgaaggaggaagcgagagtggagcttgaactcctctgcctatacccatttcacagatggggatactgaggcccaagccaggcttgggcagggccaggcctggaaccttgggctctctctgctattcctggcacctcaccaacatctcacctcctctgtccttatcttcctgccttgtctttctcctccttccccatcttgtgtttaacctcctctgtccacactcaccctcctccacctctgcatcctcctctctgtcctctagactcactgactcggtcacactctacacctcgtctacactcaccctcaccttctctggccacacacattcttgctgtctacactgatttcatctcctctgccttcaccccacacaccatgtacccattcccagccttcgtgtgttctcggtcccactccatccacactcctcctgcctgttgtggttgcactgctgtcactggtcactggcgtactgtgttttcattgttattctcacctcctccatcacgttcttttttttttgagacggagtctcgctcttatcactcaggctggagtgcaatggtgcaatctcggctcactgcaggctctgcctcccaggttcaagcgattctcctgcctcagcctcccaagtagctggaattacaggtgcctgccaccacgcccagctaatttttgtatttttagtaga

SEQ ID NO: 90885 - DNA, 2497 bp, Homo sapiens
agagtgaaactctctaagaaaaaaaaaaaaaagtcaggatcttattctgtcggccaggctagagtgcagtgtcacgatcataactcactgctgccttaaactcctgggctcaagtaatcctgttgcctcagcctccccaggtaactggaaccacaggcgcgcactgccatgcccggctaattttttcattaatttttttgtagggacagagtctcgctatgttggctgggctgggcttgaactcttgggctcaagtgatcctcctggctcgccctcccaaagtgctgggattataggcatgagccactgtacctggcctattctcagtttttcagtgcccccccaatctctgtgaggcggcagccattatgcctattttatagatgaggaacttagaggctcagagaaggaaagtgattttgcagagattagctgagtaggaagggactgggaggcatcacatcaggtgggtgggtggttgaccctattcactccatcctcaggggcccctccagtgacagtgcaggctgccacactggcccgtggctctggtcgccccgcaagcctctacctggcgcgttccaagagcatcagcagcagcaaccctgacctcgccgtggcccctggctctgtggatgacgaggtttcccgcatcctggccagcaaggtagggcaacgggggccctggaatctccagcctcagtggttgtggttgccacgtgtgtgggcgaagaatctgttgatgaagcatgggaaacaacagagacgacaacgtgaatgaaggcgtcactctgggcagcagagttgggctgggctgtcacaggttgtggggtatggatcagactttgtgttgagctctactccgtgactgacccgaggatgggtggcggagcttggcgtggctgaacaaagagcaatatgtacctagtgtagcaggtgcatatacacattcacctcatgcatatacctacacaggtgcatatacacattcaccccccatgcatatacatacacaggtgcatatacacattcaccccatgcatatatgtacatgggtgcatatacacattcacccccacatgcatatacctacacaggtacataggcacattcaccctatgcatatatgtacatgggcacgtatacgtgttcaccccatgcatgtgtggacacaagtgtgtatacatattcaccccatgcatatacagacacgggtgcgtatacacattcaccccatgcatatacttacacaggtgcatatacacagtcatcctgtgcctgtatgtacctgggtctgtatacacattcacctgatgcatatatgtgtacgggtgtgtatacacatgcaccccatgcacagacttacaggggtgtgtatgcatgcacctgtggacccacatacacaagttatgtaaaggcatgcacccaatggacctatatacacgtgcacatttttcaggattgtgtgtaggtgcacatgtgggcacatgtatggtccagaaccatgtccacgcttggtatttcatgctgctttccctgccctccactggggatgctaccacttctccgtgtatctccagggcatcgatcgctcacactcctgggtgaattccgcttatgctccaggaggcagtaaggctgtgctgcggcgggcgcccccttattgtggggccgaccccagacaggtgcccttcctacctgtccctgcactcatgtgacaccacctcagcatgagctcctcccaccttcctggctgcatctgactaacctaggggggctgcctgaaggaggtggcagacccctctcctgcctttgtttggggctgtgaagtctgtgtttaggtatcactgggtcatcctaactggctttttgctgccacataggccacagtctcagatggagacagaaggcacaggggtaatatgcaaatcgcatgcaaacgaagtgcaaatccagtcacccataacctcactgccctgcatggcctgttcacctccctttaatccacccctgatgatgggactctcaaagggctggaatggaacctctcggctcccctatcccattttagacaaagagctccccttaccctgcctctttccaggtacctggtgtagggggacgctttgcctccaaacagacctgggttcaagtcctagctctgctatgagctcaccccatgctctgagcaattggatgcatcttcctgagcctcagtttcttcatttgtaaaatggagataacactccaaattttcggatgcagtttggactcaaaatatagtgctcccccagcagtcctgagcctgtgcttgagttagggctgagggcactgcagtgggattttgttgggatgatagattcttggtctggccttgaccctgagcttccagctagttggggaaatagacacggatcaaacaaatgcataagtatatgatcacacagcgtggaaaggaagcaagtagcaaccgaataccagcttccctctgggtggt

SEQ ID NO: 90886 - DNA, 2143 bp, Homo sapiens
cctcaacttcagcagccgccagggctccgtgcgcaaccttgctgtgcgagtgcagtacatgacaggcgaggaccccagccaggctctgccggtcagtggctgtgccccagggaaggggggtagggcatcccccatgggtccctcatgaatccactctcccaggtcatctttggcaagtccagctgcagtgaatttacccgcgaggccttcacaccggtggtctaccataacaagtatgtagggggacacgtgaggaacttgggggcactcatgggggtaggaggatgtcccttatatatacacataaggcagcatcgatgggaagatgggggacaggaagaagagaggtagaggctcccagagtgctaatgagggaagctgaggcagacagcagagacagtggggcctagcagcaataagggcgtggcatggcagaggtgatggggcagacagtggggaccccagcccccagcagatcccccagcccgattctgccaggtcccccgagttctacgaggagttcaagctgcatcttccagcctgcgtgacagagaaccatcacctgctgttcaccttctaccatgtcagctgccagccccggccgggcactgccctggagacacccgtgggctttactgtgagccgtcccctccctccctccccctgagccctcctcgtcccccaacctggccgcagacctgacctccagcctctccccagtggatcccactgctgcagcacgggcgcctgaggaccggccccttctgtctcccagtgtctgtggaccagccgccgcccagctattccgtgctcacacccgatgtatgtgccctggagctcctgcctgccaatgcactgtccccagaagcactcccgagtcacctgccttccttcctgtcaatcctgggaggcttgttatcctctactggtgcctccagggcccccgtgtagctcattattcccctattaatgcctctctgtgtcctacatgtcctccccaaagattcccattgcctctctgctccattcccactttagccaccctgactgccttcctgatcactgtcccctgccctcgtagtaccttatcattccccatgaatgcaccattgttaatgaccctaggcctcaaatcctcctatcctgtttcctgacctactcaatgaatattcattcaccctgtgtctccattctctgcccccgtcttggcatgtggatttccagcctgcccagtggaccctctcagtctactgggaccagggctgggggcagggtgcttggctgcacccccagaccgggctacactcacgctgcagtgtcgcaatggctggggccgctgggtgacctgatcagtcagggagggctgaccagtgcccacctggtgcctccctcccacaggtggcgcttccgggcatgcgctgggtggacggtcacaagggcgtgttcagtgtggagctcacagccgtgtcctctgtgcacccccaggtacggggtgggccgggaaccaagagtcccgccctgctcccctcttgcctgccctacgattgagtaacagttgccgatggccggggaggtctggcctcaggccttggacgtgactttggtcagctggacccagctttaagggaagctgctgattcaggcaggggtggtcttcattccctgaggccccaccctgctcactccacatccctacccaggacccctacctggacaaattcttcaccctggtgcacgtcctggaggagggagccttcccattccggctcaaggacactgtgctgagcgagggcaacgtggagcaggagctgcgggccagtcttgcagcactgcgcctggccagccccgaaccccttgtggccttctcccaccacgtgctggacaagctcgtgcgtctggtcatcaggcccccgatcatcagtggccagattggtaagcgaatgtggcctcagacctcagtttccccatccacatggcttctcagtcctgaggtcctgagggatcttctataagcccatttacctctctggccatttttctcatctgaaaaatgacctccagtcccctgcacccagagaaggtcttctgtgaccctttggcccgggtgcagcggttcacgcctgtcatcccagcactttgggag

SEQ ID NO: 90887 - DNA, 1258 bp, Homo sapiens
aaccgaggcaggcagatcccttgaggtcaggagttcgagaccagcctggccaacatggtgaaatcccatctctactaaaaaatacaaaaattagctggtgcacctgtaattccagctactcaggaggctgaggcaggagaatcacttgaacctaggaggtggaggttgcagtgagccaagatcacaccactgcactccagcctgggcaacagtgagactctgtctcaaaaaaaaaaaaaaaaagaatttattgagcaccaactgtgtgcccgccccatgctgaatattttacctgcattgagtacctggccctactgtgagatatcaggtgttgcccttatttgcaactgaggcacacaaaagggaaactgaggcacacaaaaggacttgagttttgtctggggacatgcagggtagaggccacagagctgggaggctgatctgggaggtctttgggactcaaggtgcagaagcgagttctggccggaaatcagggtctcagcccactagggttgggggagctccttacctttaagacctcaaattctcggtaggcagggcccagccaggcgctcctcagctggacttctagccgctgcacgctgtcccgtagcaccttctgtgcctgggccacctcccccagcacctcagctgtggcctctgcctgcagctgcagaatatcctcctccatctgcttaataaacagtgggtcactagtaggatgtccaactcatctttgtgtacctaaggacttgcctgagtttatcgctgaaaatcttgtatcccaggaatcccttcagtcctgggcaaaccaggatggttggttaccctagacacgaactcctctttggactcctggccaccccacagtgtcgcagctacggtgcccacctgagtctccaacaggcttgcccgaagttcctgggctgcatcccggccccggctgacctcctgccccaggagttctattgtgcggccatagagacccaggctgttcctggcctttgtcagccgtccctccgtggtcctgtacacaccgttgagggcctggcccagctgcagggtcccatggaagagcagggtcagctcctcatgctgtgccagttctgggccgcccatgggggccgctgaggcaggccgggtcaccattgccagggcccagagcaggcacagagcaggcactggcatgactgagggtctaaggtatagccacagcactgtcactgaagccttttatgcctcatacccccactgatcc

SEQ ID NO: 90888 - DNA, 1076 bp, Homo sapiens
ttccccgcccgcgaagtctatgccccccataccagctacaggtacggcctctggggcccagctgggcacttgaatgggaggtattcatacatcatgctgggtggggtctccctaagccaaggacacacacagacaccctgggtgagatgccacgactctgctttaatgaggggtgtgtaggcatgaaagggtacatgtccttcctccacccctccccaatggggctacatcctctgcctttgtccccgcctgcgtctgtctctgctctgtgctcagaagtggggcccggcgccctggctgatcccagtgaacaggcagctcctccctgcacaggggcctcacggggcgtggaagtgttccttgcagcatgattggtcctcagttccatccaggcagattcaggctgggagcgccgctgtgtggagtctggggagggagatgtggctcagcccaggtgagggggcccctttccagctgccctgtgcgccccccatccaactgccctgcctgccaaacccctgccaggctcacctctcctggatctgtcgcagccgatgctgctgtgccaccatctcccgcctctgccgctgcacgtggcctgtgagggcccataggatgtggctctgcttgtcagcgtgagcctgtgggggtcagaatggaaacctcagccgacagccacctcacctcccatcccctgaccctctgccccagcccctcattgtatctgtgtgacccagcaagtcaacaatgctctttggcctcagtttccccatctgtaaaatggggataaaataggactcacttcatggggaggtgatgaacatcctatggatttttttttttttttgagtctctctctgtcacccaggctgagtgcaatgacacgatctcagctcactgcaacctccacctcccaggttcaagcgattctcctacctaagcctcctgagtagctgggactacaggcatgtgccaccacgcccagctaattttttgtatttttagtagagacggggtttcaccatgttggccagggtggtctcgaactcctgaccttaagtgttccacccacctta

SEQ ID NO: 90889 - DNA, 1050 bp, Homo sapiens
agctctgtgaagtcagggcatcagctacagaagggtaaactgaggctcagaggtggaaatgacttatccaaagccccaaagcaaggatgggaagggatgtatgttctggatggggtccaggggcagggctgggtgtgttggggaacagcaggatggacagaggtcccccagatgagggagcagaggccagggacccgtgggcctccctccagacctggaaggccacaggcccagccgggaggggaaggagagtccgtgatggcttcagaccccactggtggcagcattctcatctcctgatctgtgcttgatggggaacgcgttgggggaactggggagctgtgggcccttaaagcctcagcactcctggttctcttggccctcggcctatttatttcgttccacaatctggattttcctcatagaaagaatctgtccgctccgctgcctgagttttcccgtccccaatggccccctccctatctttccaggacggtggccgcagaggtgcggaagcaggtgtcccgggaacgcagtggctccccccactccagcaggcgctgcagcagctccctgggggtaagtatttggggggtccgcccccagccctctgccctctctcagacagaggtaggggcttccttggcctaggttctatcccaccccctccctcctgtggcctgtcctggggggaaaccgagagggacccagcagtgtcgggggagggagtgcctgtcctggtcctagtagtctcaccaattcctgtggccactctccctgccgctgcttgtcaccctgtgggtggtcaggggagtggctccctcctgatgtcccccatctccagccacctggaccacctagatggggatggaggagggagaagttggggaggggagtgactttcgcctgagaggggtggggccatgttgcccacagggttgcggaggctttaggaattgtctcttgcctggcctctgtcaacatttctttccttccactgttagtttctgcccttccaggcatggggtgtgatttccttcctggagcccc

SEQ ID NO: 90890 - DNA, 1013 bp, Homo sapiens
ctcaggattctctcaaaaactgggaataatatgggaacatttgtttcttctaaaaataaggcaaatgttacattgaatgatttggggggtgaggtttaattggaaatggtctctggggactgaaaactgatgtttttgcagattacctcagggaaacggaggtttgttgagtttacagacacattaaaccaaaggccgtgggaaaacccctctccagctccaggggattggtcaggaccacccactaaccagtgccttccttcttaacattcacttttagcagcttgtgtttattttacatgggcagttttgatgggaaattgccatgaccacaggggtttggagttctgctttttttttttcttcttctttttcgggggactgggggactcctcccaagatcacattttagcatctttctctcctactccatttagaaaaataagtaacaggtgaaatgtggtctcagtgttaacgggataattctgctaccggctcctccctgatgattctgaaatacactactgaacgagctctggctggtcctttctatcctggatgtggttcttctgtgtagcaattccttgatgtccagtttggaaagatgtactcttctcaacaagaaaaacttaaatccgtcgtgcccaaatatagttgtgcttttatttccattagtgaagtgcgtttctgggaaagggggtttgatttgcaactaagcagatatcagtcaagggctcttcaagacacagcagaaacctcaccgggcctcgggctgcctcccactgggtcccatggccaccaccttgaccttggaaagctctgttatatggaaggtagggaggacactatttccctcaactacttctagtaaaaagctcagttctctccccagcagcaagagggcacctgtgaacacctgagtcacagcgcattcctcctctgcttagaacattcgatggctcccaccttacttgcagtaaatgctgaggtccttcctgtggcccccggggccc

SEQ ID NO: 90891 - DNA, 1080 bp, Homo sapiens
cggttcctaacggtgggatcggtgtcctcgggatgagatttggcgtttcctcggggctttggtgggatcggtgtcctcaggatgagatttagggtttcctcggggctttcgggatcttcacctaatatccggtattattttatgagaggagtggtcttggctgtcagaactggatccctggggtgatatttgggaattagtggagtgatctctgaagacctagggctatgatctggagctgctgtggctgaaatttggggcctctgaagtggcatggagattgaggtccagagagcctgagatcttgagggctgacatttggagagatggggtcgagggttgtctttgggccttgactgctttgggcctttctcactctcattcccgggatgctttgccagaatctctgctggattggccgtaaccctgtccccgagcgggctcacagggtctgaaggccacgcatgaggcaaaggtaaagttctgagccacccggtgcctccttcccaggactgcaagatggaggaaggcgggaacctaggaggcctgattaagatggtccatctactggtcttgtcaggtgcctggggcatgcaaatgtgggtgaccttcgtctcaggtagggaccctcagcttggatgtcatgggtacctggggtggggatggaaataagaggggaaccgggaagtgccctaacacccctgtggtccccataccctgcaggcttcctgcttttccgaagccttccccgacataccttcggactagtgcagagcaaactcttccccttctacttccacatctccatgggctgtgccttcatcaacctctgcatcttggcttcacagcatgcttgggctcagctcacattctgggaggccagccaggtacgtgggtttgagtgccactgccctctggagacttgttcccaggacctcagtcagcgcctatggctacaccttttccagggggggaaaaaaaaaggctaggcatggtggctcacgcctgtaatcccaacactttgggaggccgaggtgggcggatcacgaggtcaggagttcaagaccagcctgaccaaca

SEQ ID NO: 90892 - DNA, 1034 bp, Homo sapiens
ggtggtgagggcggctgtgggtaactgtgattgtgtggttgtcattgtgtgtctgtgtgtggttgtgtaactgtcatcgtgtggctgcatgactgggattgtgtggtttcgggaggtccgcgggtgtgtgtgtgtgtgtgtcactgtcattgtgcggctgtcgttgtgggtgtcactctgatggtttgtgtgtgtgtgtctggctatgctgtgactgccattggccccccgtgtggctgctgtctctgtgtgtgactgtcttggtgttcgtgtggttgtgtgcataggactgtcattgtgtggctcctgttgtgtgttcattctgatggtgtgtatgtgtgtgtggctgtggtcgtgcgctgtgcacctttcttgtgtggcattgtgagtctgtgtcatggtccatggatgtggccatgtggttgtagatggcaccttgtctctcccctgtgactgttggtgtgaataagagactgttagtgtgtgtgtggctgtcgctgagtgccttgtaattgggggtgtgacgctgtgatgagttctgtgacccccattgtgtgcggtgactcttttctgtgactcttaagtgtgttgcaggcctgactgtgtgtccctgactgtagcggtgtgggggcttgtgtgggactgtgatgtgtgtagggtctcctgacatgtctctctctgtttggcctggggtgggggtggggacttgtttgatctgtttggtgtctctgacaggctatgagcccactgtgtgtgagtatgcagtgacatgtgttgtgtgtgttggacacctgtctgaacaagggggcccctcttgtttactgcaaagtggcgcccagcacagcgcctggaagtcggcaggtgctcggtcttcactgtgggatgggtgaacgctatgccatggttgtgtgtgtgtgtgtgtgtgtgtgtgtgtggtgccaggatggaggctgcggctgggttgtgcttcctaagggtgacagcatgggtgactctgggtatctaggacctctggcaaccatcaccccatatca

SEQ ID NO: 90893 - DNA, 2171 bp, Homo sapiens
ctccgcatctctcggttgccaggtaaccgcctccccgtctctctccactgtttccatggagatcacccgcgttccgtggctgacactgcgttctcattggctgaggctgcatagaggggcggtcccaacagtgggcggggtagagccgcgccgcaggacggagggtctggacactttggggtcacgtgctcattccgtttccctacctcccccaaccttatcccgcccctgggggttcgcgggcatttttcaggaactttctttccggcttgagaagccgccactcccaagatggaggtacgctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcctcgtgtaggtgtgaacgagcgggtgggagggcacctcagtttcttacagggggcaaccggagggtgcatgtgtgggtgtggacggcggaggctgttaatccctttggtctgttggcgggaattgggtcacaattgggcacagggagcggaggttttgagatcttgagatcctcgccattgatttgagcaaagtgagactggccaggattggggagatcgctgcccctcgcccccatatcggaaacaaagtgaggcctcattgcctggaagcgatggaggaatccaattggctggaagtagccctctcccactgaccgggatccgctttcttcctgcagcgtgaagacacagcgcatctccccgctgtaggcttcctcccacagaacccgtttcgggcctcagagcgtctggtgagatgctgttgccgctgctgctgctgctacccatgtgctgggccgtggaggtcaagaggccccggggcgtctccctcaccagtgagtcctcctgttcaccctcccgccaggctggaggtgggaggggccaacattgggccttagggataggcatttacagccttttgactcagtttcccggtagtgctccgctggtggggatgggaggacagaggtggtatttggtggagaaggcgcttacctgccctgggctgagcttcctgtaccccgcagatcatcacttctacgatgagtccaagcctttcacctgcctggacggttcggccaccatcccatttgatcaggtcaacgatgactattgcgactgcaaagatggctctgacgagccaggtgagccttttctctgttcatccatcagatgtttattgaacactgctcagtgccaggccctgtctgtgtgaccaagatactacctctgctggctcccctttgagtgggcagaaacaagctcagaagtcagtggtcagtgttatggccccgggcagctggaggagcccagagtcgtcctcctcccaagcctcggggtcagagaaggctcctccaaggaggtgaggtttcagttgaatcccgaaggtgctgcagatggaggggtcaacacgggcaaacccctagaagtgggagacagggtggggccaagagcaatccagcaggagacagaggtgaagggagaccctggctttttgtttttgtgtgttttgaagagacagggtcttgctttgttgctgaggctggagtacagtggcatgatcgtagctcactgcagcctggaactcttgggctcaagtcatcctcctgccttggcctcccaaagtgctggggttacaggtgtgagccaccgtgcctggatgagaccgtgtgttttgttttgtttttgttttgagacggagtcttgctctgtttcccaggctggagtgcagtggcgccatctcggctcactgcaagctccgcctcccgggttcacaccgttctcctgcctcagcctcctgagtagctgggactacaggcacccaccaccacgcccagctagtttttttttgtatttttagtagatacagggtttcactgtgttagccaggatggtctcgatctcgtcaccttgtgatccacccgcctcggcctcccaaagtgttgggattacaggc

SEQ ID NO: 90894 - DNA, 1078 bp, Homo sapiens
gtggggccctgcagggaagaacaggtgggccacatggtgcccccaactgagagccactggggcctcacccctccagtctgcttctgccacgcccccgcagggtctcggtgactgagctgcagactcacccggagctggacacagatggggatggggcgttgtcagaagcggaagctcaggtacccccggctgccccttggttggggacttctagggagcattgccccagggtgacctcagggcacaggagggggaccaaggaaagctccttgctggcctgggatgcctcctctgggtgagctgggatggcagccactcagggccgcttcccgcctggcaggacccgggatggagccaggtcgcgctggagcccgtttccccgcacctgcccccactctacccgctgttgagcacccaatccccttcctcccccacccctgtcctgccctattcccctcctcccccacaccctcgtcccctgtctgtctcctttcctatcctcctccttccccgtggcccctggcttctggcctcccttctctgcccacccctgggtttctccctctccatctgcagcctgggccttggcctctcccttggagggcctggccctctctggtcctgggctctctcttcctccatctgtacgtccgtttgtccatctgcttctctctttctgtctcagtgcccccaaccactccagcccctggtctcctcctcccctcccacgggcctgtgctgccccctcctggccgcagtgcctcactggcgtggccctggcctggtcatcagggcccggggcccagccctcccgtgcctggcaccgcagcccgggtgccggggtggccgagatgggggacacgtggtggcctagatcttgacaccacccccaacacacacaggccctcctcagtggggacacacagacagacgccacctctttctacgaccgcgtctgggccgccatcagggacaagtaccggtccgaggtcagtggaggagaagggaggggacttggtcctcccaccacactgcccccaccccgcctcacaaaggagctgcctctggttctggcacc

SEQ ID NO: 90895 - DNA, 1404 bp, Homo sapiens
cccccggcttctgtctggacattgcatcgccctagttttctttctttaaaaaaaaaaaattccaacagaagccacaggccggagcccctgggagccctcgcaccgctccccaccccactcagcggccccatcggaactgagaattgcaaaacccccgactttagctatagttaagttgccttcccccggtgtccccacgtttggtgtctggctatggcgcccccatctgactgtccagctctctctcccccacccctcccggtgttgttattaaacgtctgtggagcttctgctgcaaggaacaaaaaagaaaaaaatcaaaaaagcgacaaaaaaacacaaacagaagaggaaaaaaaagcaacaaaaaaagaaaacacacagaagagatttaaaaaaaaaaaaggaaaaaaaaaaaagacataaactggcaccagttaactttcttgtacttttttgctgaatttagcttcttgtagttttaacttattgctatgttaactatttattctcctcgttgccctgtaaggacatccgtgtatatttctgttacttcatccggtttgcaagttaaaggaacgacaatgttctctttgtttctttaagttttgccgagacatggttatgcctaatttatttataaaaggggaagtggaatcattaaagtaataataattattaataacagtaatggtagccgagtggcacgcgggggcgtgtgctctgcgggacagtccccacggccagcgacgtccaggtcaccaatgggattctttttgctcttgtcttgagaattttttcagtcctatttagctggtgaaatccctagcttgttcttgatacacgaacctatttattctcgtggttttaagtcctccctgccctctctcctctcccctgcagcagggcagggacccctctcccctgctgtctcttggggctctctcccctccgccctctgcattcgggaacacgcacgtccgcgtgggaagcttgcagcagggcgtccgagcaataagggctgggtttgtcccccaccctggggggggccaggctccagagagggggcacctccccacacaccccccccccaccgaggcctaggcccctgccacccccaagactgggaggggacttctttttctaaaacacaaaactcagcccagccaggccccctccctggaggccagcccctccccgcagggggccaggccggggctcccaggcgagggggacttggggcttccacgtccctggggggcaggggccaggccaggggggagggggctcagcccctccacccctcccttcatcctgttatttattcggaaggtttcaaatcacgacagagtccatgttggaggtgataaaaaactgtaaaaaaaaaaaaaaaaaaaaagacaa

SEQ ID NO: 90896 - DNA, 1048 bp, Homo sapiens
tgatccgcccgcctcagcttcccaaagtgctgagattaggggcgtgagccactgcgcccgacgtgaaagcgtttccggtgtgaaagcgttttttattttgtaaatgcacaggttgattttaggcctctgtttgcgtatatagtagtcatataagggatttcttgcagtaaaaacatcaggtgctttgtttccccccaatgcttattccaatatatggaatcccatcattattcccatcattagaataataaagtgacccctccccatgacgaagcccctataagacatggctaattcatcaccaccaagccactcattgccgcaggcccctggtgtggggactgggcggtgagcggatgcgacctgttatctccagcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacaggtgtggctgctggagttgcggggaggaacagaggtggtagcctcagaaatacagaggtgatgggggcaggtgggacccttgctgaggtgtctcgggggtaatcgaggcaggaggtggtctagggatgtgaggtctgatggggagatgggtataccccctaggtgaaggtctcaggagcgatggaggcaggtgggactctagcatcgaaggtgtcatctggaaacaggaaggtggaaacttggtggggaggggacagtctctcaggcctgaggtgggacactggcaggtgtcaaggctgggtgggaaggtcatcattctggttctgcccacagggcagagccttggctacgggtttgtgaactattctgaccccaatgatgcagacaaagccatcaacaccctcaacggcctcaaattacagacgaagaccatcaaggttggtgcctccttct

SEQ ID NO: 90897 - DNA, 1088 bp, Homo sapiens
tcagggaccgtgcccgcaacaccggagtcatctcttgtaccgtgtgcctagaggaattccagacgcccataacgtgtatccttggaaacctgggctttttccagagggtggggagggggctggagtccggaccctgctcatctggcccactgtgtgccctggtgcagggccaaagccgtccagaggaacaggtgccacctagtgatttctgtggggtgagaagatgcagggcagggttccaatgccaatgatcgcccttgacctaagtggcccagatctgtcagaacccgtggatgtgtacagtgattggatagacgcctgcgaggcggccaatcagtagcgacacagaggacccgccccctgagcagccccgcgtactgtggatccagctgttcggttctggtccagagacattccaggggtccagggtgtgggtcctgggctgtcacagccgtgtgtgtgtgtgtgtgtgtgtgtgtgtgtgtgtgtgtgtgtgtgtgtgtagtgggtgtgcgtgtgggtgtgggtgtgagtgagtgtgggtgtgtgtggctgcacgtgtcactggggtggccgtgagtgtgtgctcacaggtacgcggtggtgtcgggttcctgggcctgaggggcctgaactgatctcacttggctccgaaagcctttgctgtgttccctgcagcccctggccccccagccttggggctctggctccccccggcggaattgggggactgtttcctgacatcctggacaagggaagcccactagaggctggaacaggacctctccagcctcctcaccagcaccgtgcccatctcaactggacttcccgctctccttctccaccttctagtgcccgtggccggggattcaaagccgccgttccccaggtccctgggctgggccctgacagggagccgcccccctccccatggtaaccaggaagcccgtttcatgttcagttgcttttgtagaggaagcaagggctgggatggggacagctgtcaatcacaagcccttaaataaagcagccagcgcacatcccttgctgtccgtgatgtcttgggttctgcgtctgcctggtcacca

SEQ ID NO: 90898 - DNA, 1005 bp, Homo sapiens
atgtaagaaatgtagaaaagcattccataatttctcttctttgcaaatacatgaaaggatgcacagaggagagaagctctgtgaatgtaagcattgtgggaaagcattcatatctgccaagatcctttgaatacatgcaagaacacacaatggagagaaaccctatgaatgtaaagaatgcagaaaagcattcagcttgcctacttcctttcatagacatgaaaagactcacactggaaggaaacactatgaatgcaagcaatgtggcaaagctttcacttcttccagttcttttcaatatcatgaaagaacacactagggagaaaccctatcaatgtaagcaatgtgcaaaagcctttatttcttccacttcttttcaatatcatgaaaggactcacatgggagagaaaccctatgagtgtatgccaagtgggaaagccttcatttcttctagttcccttcaatatcatgaaaggactcacactggagagaagccctatgaatataagcaatgtgggaaagccttcagatcagcctcgcaccttcaaatgcatggaaggactcacactggagaaaaaccctatgaatgtaagcagtatgggaaagcgttcagacctgacaagattctttgaatacagataatgaatgtaaacaattaactgtttataataactgtatactaacaaatgatattctttttaaataagaagctataatatcccattggtgtcatgtattagatcagccttatactgttaaattgttattatttggacattgtgagtcagtataaccatgtggataaaatgccagacatctttttattcgaaaattttacttttcatgcttctgtacttacatttttatctcaaccttaatttttctttctttttttttttcccccagaaagaatctcactctgtcacccaggctggagtgcagtggcatgatctcaggtcactgcaacctctgcctccagggttcaagcaattctcctgcctcagt

SEQ ID NO: 90899 - DNA, 2851 bp, Homo sapiens
agtgttaaaaatgcaagtgcaatacttgttgattaatatagaagtacttgtaaacaaacccttcatgatgtgtttctcatgttttacaggagtctcatagaagagaaagtcaatgaaattaaagaagacagtcattgtggagaaacttttacccaggttccagatgacagactgaacttccaggagaagaaagcttctcctgaagtaaaatcatgtgacagctttgtgtgtgcagaagttggcataggtaactcatcttttaatatgagcatcagaggtgacactggacacaaggcatatgagtatcaggaatatggaccaaagccatataagtgtcaacaacctaaaaataagaaagccttcaggtatcgcccatccattagaacacaagaaagggatcacactggagagaaaccctatgcttgtaaagtctgtggaaaaacctttattttccattcaagcattcgaagacacatggtaatgcacagtggggatggaacttataaatgtaaattttgtgggaaagccttccattctttcagtttatatcttatccatgaaagaactcacactggagagaaaccatatgaatgtaaacaatgtggtaaatcctttacttattctgctacccttcaaatacatgaaagaactcacactggggagaagccctatgaatgtagcaaatgtgataaagcatttcatagttctagttcctatcatagacatgaaagaagtcacatgggagagaagccttatcaatgcaaagaatgtggaaaagcatttgcatataccagttctcttcgtagacatgaaaggacccactctgggaaaaaaccgtatgaatgtaagcaatatggggaaggcttatcctatcttataagttttcaaacacacataagaatgaactctggagaaagaccttataaatgtaagatatgtgggaaaggcttttattctgccaagtcatttcaaacacatgaaaaaactcacactggagagaaacgctataaatgcaagcaatgtggtaaagccttcaatctttccagttcctttcgatatcatgaaaggattcacactggagagaaaccctatgagtgtaagcagtgtgggaaagccttcagatctgcctcacagcttcgagtgcacggtgggactcacactggagagaaaccctatgaatgtaaggaatgtgggaaagccttcagatctacctcacaccttcgagtgcatggtaggactcatactggagagaaaccctatgaatgtaaggaatgtgggaaagccttcagatatgtgaagcaccttcaaattcatgaaaggacagaaaaacacataagaatgccctctggagaaagaccttataaatgtagtatatgtgagaaaggcttttattctgccaagtcatttcaaacacatgaaaaaactcacactggagagaaaccctatgaatgcaaccaatgtggtaaagccttcagatgttgcaattcccttcgatatcatgaaaggactcacactggagagaaaccctatgagtgtaagcaatgtgggaaagccttcagatctgcctcacaccttcgaatgcatgaaaggactcacactggagagaaaccctatgagtgtaagcaatgtgggaaagccttcagttgtgcctcaaaccttcgaaagcatggtaggactcacactggagagaaaccctatgagtgtaagcaatgtgggaaagccttcagatctgcctcaaaccttcagatgcatgaaaggactcacactggagagaaaccctatgaatgtaaggaatgcgaaaaagcattctgtaaattctcttcttttcaaatacatgaaaggaagcacagaggagagaagccctatgaatgtaagcattgtgggaatggattcacatctgccaagattcttcaaatacatgcaagaacacacattggagagaaacactatgaatgtaaggaatgcggaaaagcattcaattatttttcttccttgcatatacacgcaaggactcatatgggagagaagccatatgaatgtaaggattgtgggaaagcattcagctagcctggttccttttatggacatgaatagactcacactggaaggaagcactatgaatgcaagcaatgtggcaaaactttcacattttccagttcttttcgatatcatgaaaggactcacactggggagaaaccctatcaatgtaagcagtgtgggaaagccttcattccttttacttcttttcaatgtcatgaaaggactcacacgggagagaaaccctatgagtgtattctagttccgtttgatatcatgaaaggacttacactggagtgaaaccctatgaatgtaagcaatgtgggaaagccttcagatgtgcctcgcaccttcaacggcatggaagggttcacacttgggagaaactctatgaatgtaagcagtatgggaaagccttcagatctgccaagattctttgaatacagataattaatgtaaacaattatcataagtatactaacatgttattctttttaaataagaaggtataataaaatatcccattggttttatgtattagatcaagcttataatgttacattgttattatttggacattgtgagtcagtattaccatgtggataaaatgccaggcatctttttcctcatggaaagtttactttttgcaccgggcacagtggctcacgcctgtaatcccagcactttgggaggccaaggcaggcggatcacgaggtgaagagatcaagaccattctgaccaacgtggtgaaaccctgtctctactaaaaatacaaaaattagctgggcatggtggcgcgcaccggtagtcccag

SEQ ID NO: 90900 - DNA, 1077 bp, Homo sapiens
aaaaaaaaaaaaaattgctggccaggtgtggtggctcatgcctgtaatttcagcactttgggaggccgaggctggcggatcacctgagatcaggaggtcaagaccagcctgaccaacatggagaaaccctgtctctactaaaaatacaaaattagccgggtgtggtggcgcatgcctgtaatcccagctactcgggaggctgaggcaggagaatcgcttgaaccccggtcatgagccaagatcgcatcattatactccagcctgggcaacaagttgttgttttgaaaatccatctcaaaacaacaacaacaaaaatgctttatggaagaaagtacagaaagcgagaaagggatgtgatgaccaaagcagggaataaatgtttggagtccacggcaacttcttgggaatagagtctaggcccccactgctgtcactctcacccagcctcctctacacatgtgagatgtttcaggaccctgtggcctgtgaggatgttgctgtgaacttcacccaggaggagtgggctttgctggatatttcgcagaggaaactctacagggaagtgatgctggaaactttcaggaacctgacctctataggtaaggatgacaatattccttccctcagtccattagtgaaccagtgtttctagctcatgaatgctgttgagtcatttggaacatagacaggaaatactttgatgaataaatgaggcatggctgcagtaaatcatagacatagaatctaataattttttcacagttttatattgcttcaggactacttttctgtgtctgtattttagggaaaaagtggaaagaccagaacattgaatatgagtaccaaaaccccaggagaaacttcaggtaattggcacttaaagagaaagcagtgtctctagatgattttagtatatgataatatgttgaagagaagtaaaacaaagaactaagtccagtatcaaattcatctcttcttagaatattttctcaaaatcatatatttacatgtgactaagtctgagggctcactcctgtaatcccaatcctttgagaagtggagataggaggatagctt

SEQ ID NO: 90901 - DNA, 1047 bp, Homo sapiens
aaagaactcacactggagaaaagccttatgaatgtcagcaatgtgggaaagcattccatagttccagttcttttcaagcacataaaagaacccacactgggggaaagccatatgaatgtaaacaatgtggcaaatccttcagttggtgtcattcctttcaaatacatgaaagaactcacactggggagaagccctgtgaatgtagcaaatgtaataaagcattccgtagttacagatcctatcttagacataaaaggagtcacacgggagagaagccttatcaatgtaaggaatgtagaaaagcattcacgtatcccagttcccttcgtagacatgaaaggacccactctgcgaaaaaaccttatgaatgtaagcagtgtgggaaagcattatcttataagttttcaaacacacctaagaatgcgctctggagaaagaccttataaatgttagatatgtgggaaaggcctttattctgccaagtcatttcgaagacatgaaaaaactcacactggagagaaaccctataaatgcatgccatgtggtaaagccttcaatctttccagttcctttcagtatcatgaaaggactcacactggagagaaaccctatgagtgtaagcaatgtgggaaagccttcagatgtgccccacaccttcgaaggcatggtaggactcactggagagaaaccctatgagtgtaaggaatgtgggaaagccttcagatctgcctcacaccttcaaattcatgaaaggacacaaacacacataagaatacactctggagaaagaccttataaatgtaagacatgtgggaaaggcttttattctcccacgtcatttcaaagacatgaaaaaactcacactgcagagaaaccctatgaatgcaagcaatgtggtaaagccttcagtagttccagttccttttggtaccatgaaaggactcacactggagagaaaccctatgagtgtaagcaatgtgggaaagccttcagatctgcctcaatccttcaaatgcatgctgggactcaccctgaagagaagcccta

SEQ ID NO: 90902 - DNA, 1005 bp, Homo sapiens
tgtacacaatgtaggaaagccttcagatctgtcaagtacctgcgagtacatgaaagaaaacacactggagagaaaccctatgagtgtaagctatgtggtaagggatttatttcttccacttcctttcgctatcatgaaaagactcacactggagagaaaccttatgaatgtaaaaaatgtgtgaaagccttcagttttgtcaaggatcttcgaatacatgaaaggacacacactggagagaaaccctttgaatgtaaacaatgtgggaaaaccttcacttcttccaattcctttcactatcatgaaaggactcacactggagagaaaccctatgagtgtaagcaatgtgggaaagccttcagatctgcctcagtccttcaaaagcacatacgaactcacacaggagagaaaccctatggatgtaagcaatgtggtaaagtctttagagttgcctcacaacttaaaatgcatgaaaggactcacacaggagagaaaccctatgagtgtaagcaatgtggaaaagccttcatttcttctaattctattcgctatcataaaaggactcacactggagagaaaccctataaatgtaaacagtgtgggaaagccttcatttcttccaactcttttctctaccatgaaaggattcatactggagagaaaccctatgagtgtaagcaatgtggtaaagcctttagatctgcctcaatccttcaaaagcatgtaaggactcacgctggctagaaactctatggatgtaagcaatatggtaaagtccttagatgggactcagaacttcaaatgcacggaaggattcactgcagagacacctgtaatctcagcattttgggaagccaaggcaggaggattgcttaagctgaagaggttgagaccagcttgggcaatatggtgagacgttatctctattacataataaaataaaataggccaggcacagtggctcatgcctgtaatcccagcactttgggaggtggaggcagggag

SEQ ID NO: 90903 - DNA, 2723 bp, Homo sapiens
agaaaatcattgtggagaaacttctagccagattccagatgacacactgaacaaaaaaacttctcctggagtaaaatcatgtgaaagcagtgtgtgtggagaagtcttcgtgggtcattcttcccttaataggcacattagagctgacactgcacacaagccgtctgagtatcaggaatatggacaggagccatataagtgtcaacaacgtaagaaagccttcagatgtcacccctcctttcaaatgcaagaaaaggctcacactggagaaaaactctatgattgtaaagaatgtggaaaaaccttcatatcccattcaagcattcaaagacacatgataatgcacaatggagatggaacttataaatgtaagttttgtgggaaagcctgcccttgtctcagcatatatcttatacatgaacgagttcacactggagagaaaccatataaatgtaaacaatgtggtaaagcctttagttattcaacttcccttcaaatacatgaaagaactcacactggagagaagccttatgaatgtaaggaatgtgggaaagcattcggtagtcccaattccctttatgaacatagaagaactcacactggagagaagccatatgaatgcaaacaatgtggaaaagccttcagatggttccattcctttcaaatacatgaaagaactcacagtgaggagaaggcttatgaatgtaccaaatgtgggaaagcattcaagtgtcccagttatctttgtagacatgaagtgacccactctgggaaaaagccctgtgaatgtaaacaatgtgggaaagcattatcttatcttaactttcaaagacacatgaaaatgcacactagaatgagaccttataaatgtaagactgtggaaaagcctttgattctcccagttcgttttgaagacatgaaagaactcacactggagagaaaccttatgaatgcaagcactgtggtaaagccttcaatcgttccagttcctttcactatcatgaaaggactcacactggagagaaaccctatgaatgtaagcagtgtagtaaagccttcatttcttccacttcctttcgatatcatgaaaggactcacactggagagaaaccgtatgagtgtaagcaatgtgggaaagccttcagatctgcctcacaccttcaaatgcatggaaggactcacactcaagagaaaccctatgaatgtaagcagtgtggtaaagccttcattttttccacttcctttcgatatcatgaaaggactcacactggagagaaaccctatgagtgtaagcaatgtgggaaagccttcacatctgcctcacaccttcaaatgcatgaaaggactcacactggaaagcaactgtatgaatctaaacaatgtgaaaaaacctttggatctgtcagaaaccttcaaattcatgaaaagacacaccctggagagaaaccctataaggaatatggaaaagcattcaacaatttctcttcctttcaaatacatgcaacaatgcacagaggacagaatgcctatgaatgtaaagagtgtgacaaagcattcatatctgccaagatccttcgagtacatgcaagaacacaccctggagagaaaccctatgaatgtaaggaatgcggaaaagcgttcaattatttttcttctttgcgtatacacaaaaggatgcacactggagagaaaccatattaatgtaaggattgtgggaaagcattcagtttgcctggttcctttcgtagacataaaagggctcacactggagtgaaaccgtatgaatgcaaggaatgtggcaaagccttcacttcttctggttcctttcagtgtcataaaaggattcacactggagagaaaccctatgagtgtaagcagtgtggtaaagccttcatttcttccactgccattcgtagacatgaaaggactcacactggagagaaaccctatgagtgtaagcaatgtggaaaagcctttatttctttcagttccattcagtaccatgaaaggactcacactggagagaaacagtatgagtgtaagcagtgtggtaaagccttcatgtcttctactgcatttcagtatcatgaaaagacccacaccagagagaaacactatgaatgtaagcagtgtgggaaagccttcatttcttccggtagccttcgatatcatgaaaggactcacactggagagaaaccctatgaatgtaagcagtgtggtaaagccttcagatctgccactcaacttcagatgcatagaaagattcacactggcgagaaaccctatgaatgtaagcaatgtgggaaagcctacagatctgtctcacaacttctggtgcatgaaaggactcacactgtagagcaaccctatgaatataagcaatatgggaaagccttcagatttgctaagaaccttcaaatacagacaatgaatgtaaacaattaaatgtttatagcagctgcatactaacatgttattctgtattttttttttctttttgagacagagtctcgctctgtcacccaggctggagtgcagtggcgtgatctcagctcactgcaagctccacctcctgggttcacgccattctcctgcctcagtctcctgagtagctgggactacaggtgcctgccaccacacccggctgattttttgtattttttagtagagacggagtttcatcgtgttagccaggatggtctcaatctcctgacctcgtgatc

SEQ ID NO: 90904 - DNA, 1026 bp, Homo sapiens
gtcagcatgggtcagtcatcccttaatagacacatcaaagatcacagtggacatgaaccaaaggaatatcaggaatatggagagaagccagatacacgtaaccagtgttggaaacccttcagttctcaccactcctttcgaacacatgagataattcacactggagagaaactctatgattgtaaggaatgtggaaaaaccttcttttctctcaaaagaattagaagacacatcatcacacacagtggatatacaccatataaatgtaaggtgtgtgggaaagcttttgattatcccagtagatttcgaacacatgaaagaagtcacactggagagaaaccctatgaatgtcaggaatgtggaaaagccttcacttgtatcacaagtgttcgaagacacatgataaagcacactggagatggaccttataaatgtaaggtatgtgggaaaccctttcattctctgagttcatttcaagtgcatgaaagaattcacactggagaaaaaccctttaaatgtaagcaatgtggtaaagccttcagttgttccccaaccttacgaatacatgaaagaacccatactggagagaaaccttatgaatgcaagcagtgtgggaaggccttcagttatctcccctcccttcgactacatgaaagaattcacactggtgagaaacccttcgtatgtaaacaatgtggtaaagcctttagatctgccagtacctttcaaatacatgaaaggactcacactggagaaaaaccttatgaatgtaaggaatgtggggaagcattcagttgtatcccaagtatgcgaagacacatgataaaacatactggagaaggaccttataaatgtaaggtatgtgggaaaccctttcattctctgagtccatttcgaatacatgaaagaactcacactggagagaaaccttatgtatgtaaacattgtggtaaagctttcgtttcttcaacatcaattcgaatacatgaaagaactcatactggagagaaaccctatgagtgtaag

SEQ ID NO: 90905 - DNA, 1053 bp, Homo sapiens
cttctttgttatgccacaactatgccatgggtgttatcccccactaaacccaaaggtcaagctctctgttgtgggagaggcgcatgaagcagcagcaatagcactttagggtcttgggaaagcttctgctgttaaagagtgtggactcagtccatcatctaatggctgctgttccccaccttccctccctgtcctctttttgaaggactgctcttccaggggcagccacataatgaccaacctctgacagtgtatacagtcccccctccactcccactctttacatttggggcaacccaggcatcagtcacaacttcactataaatacacaggtctcaggccgccactgcgagaggagccgccaccatgtccgcgcatctgcaatggatggtcgtgcagaactgctccagtttctgatcaagaggactatgccgacctacagcaccaagcccagtaacttgaaggccccagctccttccgctacaacgggctgattcaccacaagactgtgggcgtggagccggcagccgaggacaaaggtgtggtggtggtcacgaagcagagatccggccagccgaagcctgccacctcctacgcgcggaccaccatcaacaagaatgctggcgtcacgctcagcagcatcagacacatgatcctcaagaacaagtaccgccccgacctgcgcatggcagccatccgcagggtcagcgccatcctgtgcagccagaagcctgtgatggtgaagcggaagcggacccgcgccaccaagagctcctgagccccctgcccccaaagcaataaagagtcagctggctttctcaccaccagcccctcatgcccgcaaaaaacaaaaacaaaaacaaaaaaacaaaacaaaaacacaggtaggtccttgcccaggatgtaaacccaggaccactttaaggaaggccctactcccatactccagctccccaattccaaggaattatcaaaaactgtcaactaaagtcagctgaacctagaaccagacttggtagggctcaacaatggaagaaacacagagcagcacag

SEQ ID NO: 90906 - DNA, 1032 bp, Homo sapiens
aagccctatgttgtagccacagctggagcctgggtcctctgcacagagactctggtgtgggtcttaacgaggtggtcagtgaattcctgatagggagacttggtgaatacagtctccttccagaggtcaggggttaggtagctgtaggtcttagagatgacatcaaaggtggccttggcgaagttgcccaggatggcagtgcagccccgggctgaggtgtatcagtcactgataccagccatcatgagcagcttcttgggcacaggcgctgagacgatgccagtgtccctgggtgcggggatgaggcgcaccagcacagagccgcagtggcctgtcaccttgcaagggacggtgtggggcttgccgatcttgttcccccagtagcctctgcgcacgaggacagtggagagcttggccaggatgatggccccgcggatggcagtggctgcctccttggagcacttaactcccagacggacatggccattgtagtccccgatggcaacaaacgccttgaacctggtgcactggccggcacgggtctgcttctgcactggtgtaatcaaaacctcgtccttgagagaggcccccaggaacaagtcaatgatctcagattccttgatgggcagggagaagagatagatctcctccagggactagatcttcatgtccttgaccaggcagcccagcttggtaacgggcatccacttcttatcctcggccttgcctctcagagctccgcggccccggccccggatgccactgccgaaatctccgcggaagccactgcggttccccatcccagggtccccagggcctctggacccccgcgctgcacctgcgtcatcagccatttggtgttttcttggagaagaagctataccttttaatatttatcttttagttatctccatgtgattatgtattatctccatatgattatatattgtgtttttactggattagcattcatgttgaacataccgcctttgtgggctttcatctgtgaaataattctcagtcatttaattc

SEQ ID NO: 90907 - DNA, 2627 bp, Homo sapiens
ctgtaatcctagcactttgggaggccaaggtgggcagatcacctgaggtgtggaggttgaggccagcctggccaacatggcaaaaccctgcctctactaaaaatgcaaaaattagccaggtgtggtggtgggtacctgtaatcccagctactcatgaagctgaggcaggagaactgcttgaacccaggagacggaggttgcagtgagccaagattgtgccactgcactgcagcctgggcaacagagtaagactctgtctcaaaaaaaaaaaaaaaaagaaataaactctatgtgatgaattttattgttttgataatagctctggtcaagtactcttcctgagcattcatgacatacactttccctgaaaatggcaaaagtgtaattctactacctactaatgattgtgaaataatcaataattataaaattattaattttaaaaagccactaattgtgcgttttgttttgtttttttctcacagaagtcatatggtagagaggctctgtgaaaggaaagaaggtagtcagtttggagaaaccatcagtcagactccaaatcctaaaccaaacaagaaaacttttactagagtaaaaccatatgaatgtagtgtgtgtggaaaggactatatgtgtcattcatctcttaataggcacatgagatctcatactgaacatagatcatatgaatatcacaaatatggagagaaatcatatgaatgtaaggaatgtgggaaaagattcagctttcgaagttcatttcgaatacatgaaagaactcacactggagagaaaccctataaatgtaaacagtgtggtaaggctttcagttggcccagttcctttcaaatacatgaaagaactcatactggagagaaaccttatgaatgtaaggaatgtgggaaggccttcatttatcacacaacctttcgaggacacatgagaatgcacacaggggagaaaccctataaatgtaaagaatgcgggaaaacgttcagtcatcccagttcttttcgaaatcatgaaagaactcactctggagagaaaccctatgaatgtaaacaatgtggaaaagctttcagatattaccaaacttttcaaatacatgaaaggactcacactggggaaaaaccctatcagtgtaagcaatgtggtaaagctcttagttgtcccacatcctttcgaagtcatgaaaggattcacactggagaaaaaccctataaatgtaaaaaatgtgggaaagccttcagttttcctagttcctttagaaaacatgaaagaattcatacaggagagaaaccctatgattgtaaggaatgtgggaaagcattcatttctcttccaagctatcgaagacatatgataatgcacactggaaatggaccttataaatgcaaggaatgtgggaaagcctttgattgtcctagttcttttcaaatccatgaacgaactcacactggagagaaaccctatgaatgtaaacagtgtggtaaagccttcagttgttccagttcctttcgaatgcatgaaagaactcacactggagagaaaccccatgaatgtaaacaatgtggtaaagccttcagttgttccagttctgttcgaatacatgaaaggactcacactggagagaaaccctatgaatgtaaacagtgtggtaaagccttcagttgttccagttcctttcgaatgcatgaaagaattcacactggagagaaaccctatgaatgtaaacagtgtggtaaagcctttagtttttctagttcctttcggatgcatgaaaggactcacactggagagaaaccctatgaatgtaaacaatgtggtaaagccttcagttgttccagttcctttcgaatgcatgaaaggactcacactggggagaaaccctatgaatgtaaacagtgtggtaaggcgtttagttgttccagttccattcgaatacatgaaaggactcacactggagagaaaccttatgagtgtaaacaatgtggtaaggccttcagttgttctagttctgttcgaatgcatgaaaggactcacactggagtgaaaccctatgaatgtaaacaatgtgacaaagccttcagttgctcacgttcctttcgaatccatgaacgaactcacactggagagaaaccctatgcatgtcaacaatgtggtaaagccttcaagtgttcccgttcctttcgaatacatgaaagagttcatagtggagagtaaccctatgtatataagcaatatggcaaagttttcagttgtcctatttcctttttttttttttttttttttgagttgaattctcactctgttgccctggctggagtgcagtagagtgatctcagctcactgcaacctctgtctcctgggttcaagcgattctcctgcctcagcttcctgagtagctgggacaacaggtgtgaacgaccatgcccacttaatttttgtatttttagtagagatggggtttcgccatgttggccaggctggtctcgaactcctgacctcagacgatccacctgccttggcctcccaaagtgttggattacaggtgtgagccaccacacccggcccccatttccttttgaagacatgaaattattcatatttcagagaaaccctataag

SEQ ID NO: 90908 - DNA, 1033 bp, Homo sapiens
agcgaaaccccgtctccaccaaaaaaaatacgaaaaccagtcaggcgtggcggcgcgcgcgcctgcaatcgcaggcactcggcaggctgaggcaggagaatcaggcagggaggttgcagtgtgccgagatggcagcagtacagtccagcttcggctctgcatcagagggagaccgtggaaagagagggagagggagaccgtggggagagggagagggagagtatcgtatagcatttctctaagatgctgtgtatcctgtcattggagagcataagacttgaagtgatcatactaaaaatgtagaaataatttccaagtattcatggtggtgttaaatttatgaagaagtaagtgtggacgaagatttgagttctgatgacaaagttacaggataaatggagaaaattatatatgaacttttaatgaactgagtttatatccccagtgctgtcagtctcacccatcctcccctatacatgtgggatgtttcaggactcagtggtctttgaggatgtggctgtgaacttcacccaggaggagtgggctttgctgggtccctctcagaagaaactctacagagatgtgatgcaagaaacctttgttaacttggcctctataggtaagaatgaaattattccctcacttagtcaattagagaacaagtgtttcttgctcatcagcaaggttccaaggtttagaatgttgaaagggaatactttggtaaataaatcagacaggataacagctcatcctagatttagaatctaataatttttctgtaatttcgaataggtttaatgatttttctgggcctgcattttaggggaaaactgggaggagaagaacattgaagatcacaaaaatcaggggagaaagctaaggtgagttgtacttacaaaagaaaatactgtcttatgagagaatcttagcatgccattaggtttaaaaaatgaataattgaaacaaataagccccatttcatatttatttattttttgaaaatttttgccaagaacgttttcttaaaaatggt

SEQ ID NO: 90909 - DNA, 1053 bp, Homo sapiens
aatacaaaactattaataatacggtactcattctttacagaagtcctatggttgaagcactctgtgaaaataaagaagattgtccatgtggaaaaagcactagccagattcctgatcttaatacgaacctggaaactcctactggattaaaaccatgtgactgcagtgtgtgtggggaagtcttcatgcatcaggtctcccttaataggcacatgagatctcacactgaacagaaaccaaatgagtgtcacgaatatggagagaagccacataaatgcaaagaatgtgggaaaaccttcactcgcagctccagtattcgaacccatgaaagaattcacactggagagaaaccctatgaatgtaaggaatgtggcaaagccttcgcatttctcttttcctttcgaaaccatataagaattcatactggagagacaccctatgaatgtaaggaatgtgggaaggcattcagatatctcactgctcttcggcgccatgaaaaaaatcacactggagagaaaccctacaaatgtaaacagtgtggaaaagcctttatatattaccagccttttctaacccacgaaaggactcacactggagagaaaccttatgaatgtaagcaatgtgggaaagccttcagttgtcccacgtacttacggagtcatgagaaaactcatactggagagaaaccttttgtatgtagggaatgtgggagagccttcttttctcactcaagccttcgaaaacacgtgaaaacccacaccggagttcaaccttatacatgtaagaaatgtggggaagccttcaagtcatctagttcctgtgaagtgcacgaaagaactcattttggagaaaaaccctatgaatgtaaacaatgtggtaaagccttcaattcttcaagttaccttcagttgcacgaaagagttcacactggcgagaaaacttacgaatgtaaagaatgtggtaaagcctttctttattccactcactttcgaatccatgaaagaacccatactagagagaaaccctatgaatgcaaacagtgtggtcgggtct

SEQ ID NO: 90910 - DNA, 1077 bp, Homo sapiens
tcccagctacttgggaggccgaggtaggagaattgcttgaagctgggaggtggaggttgcagtgagctgagatcgcaccattgcactccagcctggggaacaagaacaagactccgtctcaaaaaagaaaaaagaactttagttctactacccgataatacatataaaatcattaatacacaaccagtattaccgtgcttctaattttttacagaagccatacgggagagagactctgtgaaggtaaagaaggtagtcaatgtgcagaaaacttcagtcccaatctcagtgtgacgaagaagactgccggagtaaaaccatatgagtgtactatctgtggaaaagccttcatgcgtctctcatcccttactagacacatgaggtctcacactggatacgagctatttgagaagccatataaatgtaaggagtgtgagaaagcctttagttatctcaaatcctttcaaagacatgaaaggagtcacactggagaaaaaccctataaatgtaaacaatgtggaaaaaccttcatatatcaccagccctttcaaagacatgagcggactcacattggagaaaaaccctatgaatgtaagcaatgtggaaaagctcttagttgttccagttcgcttcgagttcatgaaaggattcacactggagaaaagccctatgaatgtaaacaatgtgggaaagccttcagttgttccagttctattcgagtacacgaaagaactcacactggagagaaaccctatgcatgtaaggaatgtgggaaagccttcatttcccacacaagtgttctaacacacatgataacacacaacggagatagaccttataaatgcaaagaatgtggaaaggcattcatttttcccagttttttacgagtacatgaaagaattcacactggagagaaaccctataaatgtaaacaatgtggtaaagccttcagatgttccacctccattcaaattcatgaaagaattcatactggagagaagccctataaatgtaaagaatgtgggaaatctttcagtgcacgcccagcctttcgagtacacgtgagagtgcatactg

SEQ ID NO: 90911 - DNA, 1147 bp, Homo sapiens
cggattgagaccatcctggccaacatggtgaaaccccatctccactaaaaatacaaaaaatttctctttcccttcagtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctctgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgtcgtcctgtgctggggctgacaggctccaaacaggaatgcgaggtgcctttggaaagccccagggcactgtggccagggttcacattggccaagttatcatgtccatccgcaccaagctgcagaacaaggagcgtgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtatatccccaatcgtggccctctggacaagtggtgggccctgcactcatgagggcttccaatgtgctgcccccctcttaatactcaccaataaattctacttcctgtccacctaaaaaatacaaaaaaaaaaaaaacaacaacaaaaaattagctggtcatggtggcgggtgcctgtagtcccagctactcgggaggccgaggcaggagactggcatgaacccgggaagggagactgggactccctctatcacccatgttggagtgtgctggcctgatcaaaacacactgcaacctcagaatcctgggctcaagcaatccccccgtctcagcctcccaaagtgttgggatgacttgcttgagctgccatgcccagcctctccctaatttttctaagccagcctgtagaggctgggaatcagccctggccattcagggaatccgtggagg

SEQ ID NO: 90912 - DNA, 3582 bp, Homo sapiens
tacaaaaaaatcagccgggtgtggtggcgggcacctgtagtcccagctactcgggaggctgaggcaggagaatggcgtgaagccgggaggcggagcttgcagtgagccgagatcgcgccactgcactccagcctgggtgacagagcgagactccatctcaaaaaaaaaaaaaaaaaaaaaagagttggggagccagatcccaagcctgatcagctcacccccaaccccaggcgggattatcgacccacctggaaactgaaccagacggagcccgtggcaggaaactactatccagtcaacacccggatttacatcacggtagctctcccccatcctgcacctccccacctcgatagaaagggaatcaccccttatctgcagcatctcaaagctgcctggggttggggttgactgccctctactttcacccttcaactcccaggatggaaacatgcagctgactgtgctgactgaccgctcccaggggggcagcagcctgagagatggctcgctggagctcatggtgagtgggtcagagccccatccgagccagggtcctcccaacctggacccctgctggaccttgaaggctgtttctggcccagttctctgctttcaggccccactaagctgaggactccgtttctttcttttcttctctttgagacggagttttgctcttgttgtccaagctggagtgcaatagtactatctcagctcactgcaacctctgcctcctgggttcaagtgattgtcctgcctcagccttccgagtagctgggcttacaggcacacaccatcacgcccggctaattttggtatttttagtagagatggggtttcaccatgttggccaggctggtctcgaactccttacctcaggtgatccactcacctcggcctcccaaagtgctgggattacaggcgtgaaccaccgctcccggccaaggactccatttctgtgtgtggcttttcctctccgtttttctccatctcctgcccaggctccctccacgctctggcgtgccatatccaggcccccctgttaggcatttacctccttccggcctggttcccatgcctacttggatcctgcctctgctggggttgccctaccagaccctcaccttcatcctcatccgttcctcccaccctttaatttcttttgacattcccacacgcccttacccagtttctggcccaaggacacccacaaacccacgactctcaccccctcctggccactctccccccaggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcaggtgaggggcagcggggtaggcagagaggaccggattgaagtctaccagggagccgggtttgggtgcggagtttcctaggctcagcggggatccatttggccataattagccccaaaccctcgggccaaccccatcccctgggcagtccccgcccagtgccagcccagtcccaacccccctggactgtgtagaggcacagccctagctcatgcccctaaaccaccaactcacctccggccccgcccatttcactttagccccgccctctcaccgcccccaggctctgtcctgcctcacccagccccgcggcttcagccccgccgtaactcccaaagtctcaggtcacatcagttctgctccatcgggactcgaaccctaagcttgggaccgacccatctccccattggctcagtcctccctgtcacggccctggccgctcctctcggctgagccttgcccctctccggcgaaaccccgcccctacaacctagccctgcctcctgacctggctcggccccgcccttctccatccaggccccgcccctctccaactcagccccgccctctctcccgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggtgagaagggcaaaattgagaaggagatcggagagaggcaagagagagggagagaagagaaacctggctttgccccaactcatctgggcccatccccttccccgcaggacctgttctccaccttcaccatcacccgcctgcaggagaccacgctggtggccaaccagctccgcgaggcagcctccaggctcaagtggacaacaaacacaggtggggccctggtcaggggtagggaaggggtggagtcttacctggggccggcaggtgggggcaatgtgtgaggcatgggatgttggccaggacccaaaaaggtcatgagggtatggggcagagtccagacccaggttaggggcttaaaggatctgaaatgggtgcggcaaaccaggaatgggtcttgaggtttgtgggtgctgtttagtcccaagaacaagatttgaaaatccccatccatgtctagttctgggagggtgttcatcacccctggggtcagattgagggtacgaggacagtggccagattgagggtatgaggacattggacctgggggtggtattcggggccggggaagcaggttaagagtctgggattgaggccctggagacagattcggggatatgcagctgtgtctagacccaggggaggaagcatcgtggggtgagtcagaggaagtctgcacctcctcactcctccttccccctgcacctctccaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtgactgagtgtgggttttttttgtctgttatttgcttgttagagggggacagaatttatgacccagagccgggtgtggtggcttgctcctgtaatcctaacaactctggaggctgaggagagagaatcacttgagcccaggagatctagactagcctgggccacaaaatgaggccctgtatgtacaaaaaatttaaaaaattagctgggtgaagtgtctgtattcccaactacttgggagaattgcttgagcacaggaggtcaaggctgcagtaagtgataatcacaccactgcactccagcctgggcaagagagccagatcctatctcttcgtgtgtgtgtgtgtgtgtgtgagggacagagtctccctctgtcgcctaggctggagtgcagtggcgcaatcttggctcactgcaacctccgcc

SEQ ID NO: 90913 - DNA, 1019 bp, Homo sapiens
ctccatcctgggcaacaagagcaaaactctgtctcaaaaaaaaaaaaagaaaaaagaattatgtgggccaggcgcggtggctcacgcctgtaatcccagcactttgggaggccgaggcgggctgatcacgaggtcaggagatcgagaccatccttgctaacacggtgaaaccccatctctactaaaaatacaaaaaattagccgggtgtggtggcgggtgcctgtagtcccagctactcgggaggctgaggcaggagaatggtgtgaacccgggaggcggagcttgcagtgagccgagatcgcgccactgcactcccgcctgggcaaaagagcgagactccgtctcaaaaaaaaaaaaaaaaaaagaattatgtggcggtgactgaaggttgaccttgatgtaggccttaatggggtttatggccagggttgggggacatttgtaggactcacctctgctcaggtacagactgacatccacctcacccgtgtgcccgcagacacccttggtgcaggaggtgcaccagaacttctcagcttggtgttcccaggtggttcgcctgtacccaggacagcggcacctggagctagagtggtcggtggggccgatacctgtggggtgagtggcacaggctgggagaggggtgtggaagcaagggcagaggggtttatccaaggctcacaaccttgccatcccattgggtacagcgacacctgggggaaggaggtcatcagccgttttgacacaccgctggagacaaagggacgcttctacacagacagcaatggccgggagatcctggagaggaggtggggggtgactgagagcactgagggggtggtctgtggtgtgttggggcccaggggtggtgagggaaatttgctgattacatgagtgtgggagacagaggacgaagggagagtgaagggcgggggagccaggcagggtgcagtggctcacgcctgtaatcccagcactttgggaagccgaggcgggcagatcacaaggtcaggagatc

SEQ ID NO: 90914 - DNA, 1031 bp, Homo sapiens
ggtgggcacctgtaatcccagctacttggatagctgaggcacgagaatcacttgaacccgggaggtggggggtgcagtgagccaagattgcaccactgtactctagcctgggctacagagtgagactcagtctcaaaaaaaaaaaaagaaaaaagaaaaattaaaaaaagaaaacacacacacatacacacacaaacccatctgtggacccttttctgcccagcacatccgggcaacgtttgatcctgacacagggctgttgatggagattatgaacatgaatcagcaactcctgctgcctgttcgccagaccttcttctggtaagggaagatcaccaggcctgagggtggggtggtggtgctcggcatggagctagggccccttacctgactctcacctgccccaactccaggtacaacgccagtataggtgacaacgaaagtgaccaggcctcaggtgcctacatcttcagacccaaccaacagaaaccgctgcctgtgagccgctgggctcagatccacctggtgaaggtcagggactaggaatgatgagtgggcagttgggaatggggaagttatggagcccaagagggtggtgggccatgtgtagagtgagggtaggggaggatttacttttccttcagatcagtgggctaagacccacagatcagcgggggaaatatttgagggtccttccatagaattgatattcatagctggtcgtatgagagtctccccataggacacatcatacaaagccattcacatctgctgtggacgtttacatacttagttttggaaattgggggtggggcattcccacttggcccatgaatcaggagagccaaatatcactgcttgaagaattcaccaaagtctgtagtaagaggagcttctatctggagtgaatatttgagagtccacccttggattgattgggtttgggtgagtctcagggtgaatgcctatgggtgcatctggctaggaacagtggtttcccagggcctctcattgatgtttgactttcatag

SEQ ID NO: 90915 - DNA, 1088 bp, Homo sapiens
gtggtggcgggcacctgtagtcccaggtactcatgaggctgaggctggagaatggcgtgaacccaagaggtggagcttgcagtgagctgagattgagccactgcactacagcctgggcaacaaagtaagactccgtcccaaaaaaaaaaagttgtgttttttggtaacaatctgacagtcctgcaaaacgattattcctgccctataatgtcacacttagtttttccacaaaagtttttaataataaagttggaattattgtaaaagtttagtaaaatttcaggtttattcttgcatctctgaaatccttttaaaaaaggctagtggtcatgtttgacttcagccaaaattcattttcacacccaaccattggcttgcacgccaaatatgtatttagagaaactgaacctatgggatgcatgaatgtgcacacatgtgtggaagtgtgggcccccaggaaggtgcggactcccgagggctcactccgtcgcctcccccagcagcaggcaaaaggaagcagtgtccatgttctctactccacccccgcttgttacctctgggagctgaacaaggccaacctcacctggtatttggggaaactggggagcttgggggggttggcatgccccgtgggtcatgaccctgccctcaatgcccctgccgctgtaggtcagtgaaacatgacgacttcttcccttacgcggatggcccccaccagttctggaccggttacttttccagtcggccggccctcaaacgctacgagcgcctcagctacaacttcctgcaggtgggtaggagccgggctagagggggcatgcagccccgaggcccgacaggctgggcgccccaacatacccctctgcctccaggtgtgcaaccagctggaggcgctggtgggcctggcggccaacgtgggaccctatggctccggagacagtgcacccctcagtaagtgtcgggcccaagaggggaagaggtttgcggctgaagttggaaaccacccctaggccgcccccctcgagtttcttctttttttttttttttttttttttttttgagacggagtctcgatttgtctcccaggc

SEQ ID NO: 90916 - DNA, 1024 bp, Homo sapiens
actcctagactcaagcgatcctcctgcctcagtctcctgagtagctgggattacaggtgtgagcccctgtaatcatgttctcatgccccctggaggaagatgctattctattcaccatcacaatgtccccctcctggatttatgtgcattcctcattagaagagatagcataggctgggcaagagatagcatggcatggtgactggatgccctcttctaggtagtgggtccaagagaactgctcaacaactggtggctacttttatctgtgtccccacgctcccaagtgccatacccccacccatgcctgtgcacccaacatccttgaccccatatacatcaaaacacagctatacacagggatggcccaggatcctctggcttcaggactcccctcttgcctgcagggccggtattaccgcaccaaccacactgtgatgaccatgggctcggacttccaatatgagaatgccaacatgtggttcaagaaccttgacaagctcatccggctggtaaatgcgcaggtcagtgcgcctaccctgtggtacccttgtgcacatgtgcgcttgcatccgggggccttgggttatgtgcatagctctcagtgctgtctttgttttctattgttctattgtggtcattctataacaaatgaccacacacttagcagctcaaaacaacagaaatacattgtcttacagttctgtaggtaagaagtccagcatgaggccgggcgcaatggctcatgcctgtaatcccagcatgttgggaggctgagccgggcagatcacgaggtcaggaattcgagaccagcctgaccaacatggtgaaacgctgtctctactaaaaatacagaaattagctgggtgtgatggtgcgtgcctgtaatcccagctactcgggagcctgaggcaggggaatctcttgaatccgggaggcggaggttgcagtgagcggagattgtaccactgcactccagcctgggccacagagaaagactctgtctcaaaaaaaaaaaaaaaaa

SEQ ID NO: 90917 - DNA, 1024 bp, Homo sapiens
cagtctgcccgtgttgtgcaggctggtctcaaaaactcctgggtttaagtgatcctcctgttttggcctcccagaaggctgggatcataggcaagagccaccacatcgacctagcactgctttttaacctgtgctctgacctgcccctcccaagcagaggggagtttggtggtgagagggctgggcactaattcacactgccttttcctccctcatccccagatgggcttcgacggcttcttctttgggcgccttgattatcaagataagtgggtacggatgcagaagctggagatggagcaggtgtggcgggccagcaccagcctgaagcccccgaccgcggacctcttcactggtagggggcttggtgagggcagggccagccatggtgccacacactcagaagggccctgggcttgatatctgctctgttgtcactgtcctggaattcctatagtctgggaacaaaggccctgcatttccttttgcattgggacacaaattctgaagcccatcctgggtgggacatggccggctttgaaaccagggaaggtctgggtgatgggccaccccttgaacttggtgtgacctgcaggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccaggtaaccctggtgtccagaaccttcgagtccggtatatacaatacaatgagctctttccatggtacaggcatcccctaacacgttctccttatttttaatttttttgagacagtcttactctgtcacccaggctggagtgcagtggtgcgatctcggctcactgcaacctctgcctcctgggttcaaacaagcacatccagctaatttttgtatttttgcactggggtctcatcatgttgtccaggctggtctcaaactcctgagctcaagtgatctgcttgcc

SEQ ID NO: 90918 - DNA, 1512 bp, Homo sapiens
aaccgtggaccagtacttttatggaagtgagtagaggatggggactggtccctgggatccccatggtccctgtaatccctctgggtcctggacattagggtggggccagtgctaccctaatatccagggtttgggctcctctgtctaggaataacccccttggctctgctgttccctgagagccttatccctgttatccacagtcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccagggtgagcctaccccaaggaagtgaaaagaggaagcccagcccagcttctgcttctgcatctctggtttctgagatttgtcatgccacgtgcaagctgtataacatgcgtgtcgctccgcctgcctggactctccatttggagacctcctatacatcccacaaagccccacctgctgtgcatcctctgggaagcctgccatgcagggggcctctttcccatatctgggaactatggcctgggagcgacccctcttgtccttccgccagaaatgtgtacacaggcaggctttcacattcccagtatcacccaccctactcccactcctggctctgaccgctgaccctgaccttgcctgtcctggcacagggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcaggtgcgacccgggacctctcttgggcccacttcttcactcactctggctcctccctcgcccagtcaaaccccgccctctccctgcaatctcacaaggaccaggcccaggcctaggcctgttgaagccctgccccttgagtgagccgtaaagccagtggcttttgagctctggcctcagccggctatgcccagcccaggctgacccagctccggctggctccgccctctcccctaataggcccctcttggtgttctggccccacccactagctcgggtcctggctcctccctaaaccgggtggcaagtggatgcctaggctgccttaaaaacaggttcattacctgtgctcagaccccatccatcctcaggctgtggaagggggaacctcattcctggagtcaggcctgctctgcgctttgacagtgctggggaggtgaacctgggttctgatgttggacccgccctctccctgctagcccaaggtggtgagttctgaaacttccccaagcttggaaataagctggaggcctctctgtttcagccctacgtgtttttgtttttgttttttgagacag

SEQ ID NO: 90919 - DNA, 1095 bp, Homo sapiens
tccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtgaggaccccagcgtcgtgggcacgggttcgggttgtgggtgtggatcggggccctgggaagcgcctgtctatcccgggggcaggacctgagcgcccctgaccctcgagcctgtcgcaggtacaagcccccgccgagcgaatgtaacccggccttggacgacccgacgccggactacatgaacctgctgggcatgatcttcagcatgtgcggcctcatgcttaaggtgggcggggttgagcttctatgggtgtagttggacctgagaacgaggcccgggggcgggtttggaatgaagcggggtgtcttgtcattgctgatggggcgggacctgagatcggccgggagtggggctgcgatgacgctgggccgagaaagccccagtctttggtgaagtcaaggattcgagtcaggttggggatgtggcagattggtctgcgagtggggccaggctttgaagcaacttggagaggagttgtggaaaaagggcagggtcttaagcatgtgggatgtcagagtctctcttggtcctgagagacgcaggccagacagtaggactagaaaccacgtatctagagtatgccatgagcaggtgggactgaggaattccgggtggggcaaggtcccagctgcatcagatggaatcagtgggcatgatctggtgtctgg

SEQ ID NO: 90920 - DNA, 1034 bp, Homo sapiens
aataataaggttacacccaagcgtgggtttctaaggcgcggaattttccgtacagaccgatttaaggctgcaaggaaggagtcctgggagcatggctttccctgagccaaagccgcggcctccagagctgccgcagaaacggttgaagacgctggactgcgggcagggggcagtgcgagccgtacgatttaatggtgagcgccttcgtcttcattccgggtcctcctcccgcctcctgagatcgacggcccagtaacccccgcctggtgttccccagtggatggcaattactgcctgacgtgcggcagtgacaagacgctgaagctgtggaacccgcttcgggggacgctgctgcggacgtacagcggccacggctacgaggtgctggatgcggccgggtgagccggggaccaggctgggatgggagcgctgaggctgggatccgaggtcgatgctgatcctcctcctcctttactccagctcctttgacaacagtagtctctgctccggcggcggggacaaggcggtggttctgtgggatgtggcatcagggcaggtcgtgcgcaaattccggggccacgcaggggtgagtgaaagcctggagaccctcatttgagtggaggggacccgtattagcgcataggtggtgacacggccacccccattacaccgtaaggatcccttccccagatgacgatcccccactccgcatgccaggctaggcagtcaccaacccctgtccttgctgttcccccaaaacctttcacctccccttcgcccttgctttaaccgacactgggaaccctgcctttatcccagtcctccaaagtccagcctcctctgagtggcaataactttctcagaaggtgaacacggtgcagtttaatgaagaggccacagttatcctgtccggtgagtctggggcctaagcacgggggcccagggtgctgccctccccctccaaacctgacctcaccatcatgctggcctcacaggctctattgattccagtatccgctgttgggattgccgct

SEQ ID NO: 90921 - DNA, 1116 bp, Homo sapiens
gcctgctgggccctgtgggctgaggcggggctttggcttttgcactgagagaagtgggagaggacttgactcgggttcccatgctccccctggtggccatgtggtgaacagatggtggcaggtgagtgagaactccagtccaggacagtggtgaccatgcagggatcaggaggcaggcggtggttggatttggagggcttctgaagatagagttgctggcagctcctgccttgcagatggggcagggttgttgacacctggctgttgggtctggggaaacacagccatcgttgcccagcagctctagtgaccccagacattgacatgggccctgtctgggagcgaatgtctgtgaagggcttccttcatctgggacacacctctcagcctgtttggctacggtgtcctccctctgtgtctgtctcctgtgactggctgactgggcccaccgtgcccccgcctccccacagcggaacggggccgactacgctgtttacatcaacacagcccaggagtttgatggctctgactcaggtgcccgaccagacgaggctgtctcctggggcaagatccgggtggatgcacagcccgtcaaggtaagcgctggctgggtggggcatagggtctctgggacgatgagtgtgggtcccatggcttacccaggttcccccctacccaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatggcggtcagcaggcagggctctgttgggtggtaggccagcgactgcaccacaccggaacccacaggcagggccagagccagcgcaccctgtggagcgaggggtagggagtggt

SEQ ID NO: 90922 - DNA, 1028 bp, Homo sapiens
aggaggcagaggttgcagtgagctgagatagtgccattgcactccagcctgggcaacgagtgaaactccgtctcagggaataaaaaaaaagagagagaaacagctcagcaagctaagaataggctggttctttatgtgccaggcactatactaagtgttttctgtgggttttctcatataggcctcatctgtgagaggtgtttctgttatgcttataattgaggaaacagtcctagagaaattaggcaccccatccacagtcagatagtcatatagccagcatggagacgaggctctgagctccagccactgtcctgtcatgttctctgcagaaccacatccctgtgtttagtcccgcacttacagacggctcgctgggcgacatgatcttcttccattcctacaagaacccgggcctggtcctggacatcgttgagggtgaggcgctagggccacagaggagaggggaaggagggctggctgagtccaaggcctgacttcggcgctcttcccccagacctgaggctcatcaacacacaggccatctttgccaagtgcactgggatgatcattctgggcgggggcgtggtcaagcaccacattgccaatgccaacctcatggtgagtgggggtggcgcttcggcccactctgcagacatgctgtgtggtgggcctatgccatgtgctgggtagacagcatgaactagacaggccaggatccctgctccccgggactgatgttctagtaggggagatagcaaacaagtgacatccacgtcagggggcagtcattgctacggggaatactaaatgatggcatgagaagagaaaggggtgctgtccaacaagaggttttggaaggaggcttctggaagtgtgagctgggagcaggggtttggggaggcatctcccaggagctatgtggttgtctcccgtgccaggagtttgtgctgctgtactagcattgagcttctggattgcaaagttcccaggagagggaacagccattgcaaaggctctggggcgcc

SEQ ID NO: 90923 - DNA, 1071 bp, Homo sapiens
tgtagcagagctccctcataagagtcactggacaaggatgaggttagaagttctgcccagaatgagggcaggggcttccttcttgggccaaattcactgccttgtggctgcaggtggacgtattggtgaccacagctggcggcgtggaggaagacctcatcaagtgcctggcgcccacatacttgggcgagtttagcctcagggggaaggagctccgggagaacgggatcaataggtgagaaccctgagtggtgttgggcaggggagctggaccaagggtcctggggcctgatgcctacatgcctcctgttctcaggatcggaaacctgctggtgcccaatgagaattactgcaagtttgaggactggctgatgcccattctggaccagatggtgatggagcagaacacagaggtggggctggggcaacctggaggggccagttcagtgggagtcaggggaggcatggcctgaaggtcacatcctctcctagggtgtaaagtggacgccttctaagatgatcgcccggctgggcaaggagatcaacaacccagagtccgtgtattactgggcccagaaggtgaggacctaagcgggagcaaagtagccagactttggcatgtgttaacttatttcatctttccagcctcctggggattcagtactgttattctcagcatcctcactcttagatgaggagactcaaacacagataggcgtggtaattttttttttttttgagacaggatcttgctctgtcacctaggctggagtgcagtggtgtgatcacagctcattgcagcctcaacctcctggggccaagcagtcctcccacctcagcctctcgagtagctgggaccacaggcacatgccatcatgcccagctaattttaaaaattttttgtagagatgggggtctccctgtgtttcccaggctggtcttgaactcctggcgtcaggcagtcctcccaccttggcctcccaaagtgctgggattacaggcgtgagccactgtgcccagccaggctaggtaattttgtctgaagtcacacagataactagtggggcctca

SEQ ID NO: 90924 - DNA, 1044 bp, Homo sapiens
ttttgagacagagtctcgctctgtcgcccaggctggagtgcagtggcgcaatctcggctcactgcaagctctgcctcccaggttcatgccattctcctgcctcagcctcccgagtaactgggactacaggtgcccgccaccacacccggctaattttttctgtttttagtagagatggggtttcaccgtgttagccaggatggtctcgatctcctgaactcgtgacccgcccgccttggcctcccaaagtgccaggattacaggcgtgagccactgcgcccggccgagggtcacttcttaagcgtcacccatggacaagatttcggtcaccaggcagagttagacacagtttcatccttcctcagccacttttgtctaatgggatagtgagcccggttcgtgccctcacaagtctccaaagccttcacatgctgcataacgctctgttcttccttcccttatagctgcagctgtcacctccacctcctctgggaagccttccctgaactcccactgggtcagtggcctcttctgggacccagggctgacgtctctttccctcctgcaagaatgtgagaccctgggtgtcatctgtatctcaaacacaccctcctaacagtgcatacggccaacaggattattcactcactctacaattcatgtagtctattctctatggtgggctccgtgctaggcactaaggatttagtggtgaacaagaccaagatgtggaccctgccctactggagcccacaatctgattgggaagatagaaagttaacaatagtggtgagtgctatcaggccttttttgttttttgttttttttggagacagagtttcgctcttgttgcccaggctggagtgcaatggcgcgatctccactcatcgcaacctctgcctcccagtttcaagcaattctcctgcctcagcctcccgagtagctgggattacaggcatgagccatcacgcccggctaattcttgtatttttagtagagatggggtttcactatgttggtcaggctagtctcgaactcctgacc

SEQ ID NO: 90925 - DNA, 1050 bp, Homo sapiens
tctgtgctgagggcaacctggtggtggccggctctggagacctgtcgctagaggtctggaggctgcaggcctgagcaggtgggcgtggatgtggatactgcctgccggaggctgggcttcctcctctgttcttgggggaccatccccaatgttggtgctgcctccgccccgtgggcctagggcacaaggagtcccagccacattcgggtgagcgtcctggcctgggccctatgcccgggggaagggtgaaattggggttcaggcccacccagggggccgcttcccactcttgggccctggttttgttatgatttggatgccccgctctcagttgagagcgaaggagaaataaacctgacatgttggtgcttgggcctggagtgtgagtgtggtttgcctgctggggttctgcctgtgcctgcttggggctgtggggctgcgggcctgcatgggagtgactgggagagatagcaagtctgggctgggggtgcatgtcagctgttgctgtgcatttgaagagggagagtcctgaggatcgtgggcatctgtgtctatgatgtcacgtgtgtgtgtgatgtgtgacgcgtgtggtgtatagattatgactcaaatcctggccatttgtctgcacggtgggaaagggtacctgctcaggctatcccatgggtgctggcgagggcaagagggatggcgtgctctccgtctggggctccagggtgtgtgtgtgctgctgtggctgtgaccccgggggcaggcagggagggaggctgggccaggtacgcacctggcccctgcaagcccaaagtccctctggtctcccatctcagcccagctcagccatgccctgagaagtattcacttcatgtttattgaggccccctggtttgcccaggccacagggtggcattgccctgggttcataggatggcatagggcttcttctccttgaaggagttggtggcggccgggatgcccacaaggaaggggtcattcttggcctgctccgtgcagaacttcagcagatcggcggccatctttggacacctgcag

SEQ ID NO: 90926 - DNA, 1036 bp, Homo sapiens
agcttcccaaagtgcagggattacagatgtgagccaccgcgcccggccatttttcttttttttaaatggagaacggggtcttgccacgttgcccaaggtgatcttgaactcctgggctcggatgatctgcccatatcagcctcccaaaattctgagattacaggtgtgagccactgtgcctggcctatttattcattctacttttgttaattgaagggccagtgtaccttgtccaggcagagctggagcggggctgcgggataggcatgtttcaggccaacctgagggtggatgcaagactgagaccaccttggtcagctctgtgctaagaacagtagatgggatcggaggagggatatgggatgtggacggggatgggcagaggcctggggctcctgtggaagcctggatttacctgaggcgggagaggagagatgggtcactctgtggggtgggggaatgagcagatcgagggttttgccagacaggatggagacccgggatgctctcatgggctggggggggccttcgaggggctctgatatccctcctcaccggcccatcacccatgaagccggcccagccctgttgaagcaccagcaactacactccagacccgtgctgaccctgctggcggatgaccggcacatcatctcaggcagcgaggaccacaccctggtggtggtggaccgccgagccaacagcgtcctgcagcgtctgcaggtgggccctccccaggggcctggagggatggggactgttgcaggcccagcccggcctgagctgtcccgtcccttgtccctctcgtagctggactcctacctgctctgcatgtcctaccaggaaccccagctctgggctggtgacaaccagggcctgctgcacgtcttcgccaaccgcaacggctgcttccagcttatccgggtctgctggagctcctgcccctgactgtccctccccccgggcttccttcctacccgagcccctggtggtgtgggggagggcgggccttgggagagcctcgactgagtgttgc

SEQ ID NO: 90927 - DNA, 1090 bp, Homo sapiens
agggtccctgcccactgggcaccctactcgtggtaacccacagagaagaactttgactggccggcagcctgcattgcgctggagcagcacctgtcccgctgggcagaggatgggcgctgggtcgaatacttctgcctggccgaaggccacgtggcttccgttgactcagtgctgctgctccaggtgagacggggtctgtggggggccaggcagggtgggccagggtggccctgacaacatcaccttgctccctttccagggtgggtcactctgtctgtcgggctcccgagatcgcaacgtcaacttgtgggacctgcggcagctggggacggagtccaaccaggttctgatcaagaccttaggcactaagcgaaatagtacccatgaggtgaggagtcaggtggggataggaggtatgaggcctgagtagggcatcttggttaaggccccaggttttggtacaggaccgcatagatttgaatctgacttttctaaccttggtgtgactttgagtgagatgtgtgacttctctgtgcctcagtttctacttctgtccagtgggtgattaggatgaggatgaaggagatgcattatgcattaatgtggacatgcattaagctcaggctttttttttttttttttttgagacggagtctcgttctgtcacccaggctggagtgtggcatgatctcagctcactgcaacctctgcttcccgggttcaagcggttctcctgcctcagcctcctgagtagctgggactacaggtgcatgccaccacacctgtctaattttttttttttttttttgagatggagtctcactctgttgctaggctggagtgtagtgatgcaatctcggctcactgcaacctctgcctcccaggtttaagcaattctcctgcctcagcctcctgagtagctaggaccaccatgcccagctaatttttttatttttggtagagacagggtttcaccatgttggtcaggatggtctcgatctccagacctcgtggtctgcccgcctcagcctcccaaagtgctgggattacaggcatgagtcacctggcctttatttatttatatttttat

SEQ ID NO: 90928 - DNA, 1338 bp, Homo sapiens
caattctagagaaccttccggaatagtctgggaacatggtcaaggtggaaggggctcccctagagagggtgggggtgtagttacttcccagttggccagaaaactgggccttgcagacccccttagcattttttccctttttttccttccctgctttctacttctttggggagccccttgtgttttggagtctgactggagtctcgcatcctggggcctgctccatccatccctcctgggcgccagaccctccatccaagccctgtgtctttccatagtcagggtcaggccctgcatctattccaaggggcactcagtacacattccataaattagctgggtgtccctgcacgcccaccccatgaaactcgagcaggtctctggaagccatttgttaaaaaaaaaaaaaaaagttttaaaaataccttttaattttctggtaattccagttctttgaagcatcctctgctgggtcttggggtgtgtggatggattggctgtctgatgggattggtaacccctcgctactcaagatggggggatacaaacaccttcagggaaggggagcctggttcttctcgttttcctttttttttttttttttaaaaaaaaactatttaattttttaatttatttttggttgttttttgcacaatgaagtttcagcttctcaaccttctcccctacccagggctgtggacccagactggccttgagccacagtccctctttccctcctcaccctcttccccctgcgggctcccgggtctgtccatttgttactgtgctgtgctggggattggcgccgaggtggcgtgagattccacttgtgtagaactttgttgagtaaagatcagtttcttgtgaactccttagtctgtggcttcctgtgtccttggctttggtagtgaagaaatgtcgggggcaccggggatacttgagagtgggaagatagacgaatgtgaaagatggaagattaaatttgtaacatatatgaaatgtgcagctcattctctgggacttcagctcactaagggtgagccattagtgtcacagcccaggttcaagatgcccctctgccgtactctaaactgagtggtaaggggtgaggccttgccgcactcttatcatcagctgaccctgggtcaaggttttcatagaaggttcagcccagccccaggccgagggtaatttaattaatattagttacaattactcaggcaaatgagaagtagtttcagctgtggggggaaaccacaatcttcagaataaaatctttcttttttttgagaccgggtcttgctccgtcacccaggctggagtgcagtggcgcaatca

SEQ ID NO: 90929 - DNA, 1050 bp, Homo sapiens
gacgagtccctctgccattccagccatcaccatcggccgcttgggctacgtgtgcccccaggaggtggcacccatgctgcagcagttcatccggccttggtgtgtgtccacgtgtcaagcctgctgtgtggtgggcgggactggcccaaccccctccctcgcctgtgcatttccagccccatctgcctactgactccctgccctgccccacccccacagatgcatgtcccaggcccactcactgatccccagtgacccagccctccacagatgcatgcccagcctgccctctgacctccagctgctcaccttcccacaggtgcacgtccctcaggaacatcagggacaacgaggagaaggactcagccttccgcggcatctgcatgatgatcggtgtcaacccggggggcgttgtgcaggttggggcagctgggctctgagggcaggcgcgggcgctgggctcgggcggcccctcacctgggatccgtcacgtttcaggactttattttcttctgcgatgctgtagcctcctgggtgagcccgaaggatgaccttcgggacatgttttataaggtgaggctctgtctgggccctgatctagttccgggagcaggcaggggtgagaccatctggtaacaatggggcctggggatgggggaagaggcgcactccccttgttctgcccctgcctacccctcaccaccaccctccccacagattctccacggcttcaaagaccaagttggggaagataactggcagcagttctctgagcaattcccgccgctgctcaaggagaggctggcggctttctatggggtctaggtgatcatggagactgccaggtaaggagactgcagctggcaagtcagcactgtcttgggggccgaaaggtcccaggccatgaccttcctcctccccctgcaggtttctgtctgcgtcgtcgtcggagggattactggggagtgcgctgcatccggaagtcgctgtgccctggttgaggggggttagggaggagtgagtgggactcaaatccagatgccttccccg

SEQ ID NO: 90930 - DNA, 1071 bp, Homo sapiens
tctcaaactcctgacctcaagtgatctgcctgcctcggcctgccaaagtgctggagattacaggcatgaaccactgcgcctggccctaacactgtgccactttatatcaaggacttgcacatccgtggatttttatatctgcagggacctggaaagaatcccccacggacactgagggatgaccgttggggcactgccatctcccatttgcagatgtgggctggaggctagggaggttaaggaacagctaggagctctagaactggaaagtggcagaggctggacatgcaccagggactgtgccccctgagctgtcctggttagaaggaggggagcctagccacactgatcttacttgaatccccaggactcgatgcctgaggtccggcagagctcctttgccctcctgggagacctcaccaaagcctgcttcatccatgtcaagccctgtatcggtacgacactcgccttgtccctaacccatgaccccagccccggcctcaagtgatggagagcaatacccggggatgactgtgaccacattgggatgtattcgtactgtctgatggggcctgctggactaggtcctgcagcttaccctggctggccctccttctcagcacccctgtttctccccaccagccgagttcatgcccattctgggcaccaacctgaacccagagttcatctccgtctgcaacaacgccacctgggccattggtgaaatctgcatgcagatgggtgagtgccctgcaagtggcaacacgcgccccccattagcctgttctcaacctgggggcgggagcctagctctgactgacagcttccttcaaggcaagtctcttgggggtcgtcaggggtggagccaagcagaaaggtcatttgtgattggcttctctaaagaggagggataggagggctgttctgattggaccgttttgtgtagttggctaaaagactcattcggattggttgggtgactttggctttttttttcctttgacttgggcagcgtgttgtcaccttagcgactccagagaagcctctgttgtttggagggtgtgggtctgt

SEQ ID NO: 90931 - DNA, 1950 bp, Homo sapiens
cagctacttgggaggctgaggcaggagaattgtttgaaccaggaggtgaaggttgcggtgagccatgatcgtaccactgcgccccagcctgggcgacagagcgagactctgcctcaaaaaaaaataaagataacccggggctttgggatgagaggcttctgttgtttcccctcctgtgcctgcctttacctggctctgtgaaatgagtctgggccagtgatttaaactctaagcctcagtttccctatatgttgtgtgcggctgactcttctctccatacggtgggtgtggctgggcccaatcaaactgccccctcttggttccctttccttgtaggctgcatgcagggcatggtgccctacctgcctgagctgatcccgcacctgatccagtgcctgtcggataagaaggccttggtccgctccatcgcctgctggacgctgagccgctatgcccactgggtggtcagccagccacccgacatgcacctcaagcccctgatgacagagctgctcaaacgcatcctggatggcaacaagagggtacaggaggcggcctgcaggtgaccctggacccctgatcccacagcccccactctcccccggccaccctctgggaagtgatgacacctgtgactgttgatgtggaactgatttatcgcgtattcgtactggctgatcctgagttgccctccccaactgcccatggcccagtgtcacctgccatggtccactgagcccccgcttcatcctccctcccaccagtgcttttgccaccctggaggaagaggcctgcacggagctggtgccctacctcagctacatcctggacacccttgtctttgcctttgggaaataccagcacaagaacctgctcatcctctatgacgccattggcaccctggccgactctgtaggccaccacctcaaccagccggtgagaccccagagcggctcccgcctcccgatccccgtgcccctgggcatccagtgacctggtggcaaccccgtgttgcacgccagggacgtggccgtgacctcgacaggcagacagacagacccggccccgccctcgccctgctcccagtctagtgggggagaaagacagttatgagacagcgtggtaagtgctgtgcttcgggaaccaggaggtggtaacccaggctcccggggggtggggtggggcgggcggtgcttggacaggtgagaagaatgaaggcctcgaggtctggccagatggcaggcctttcagggtcccatgagccacggtgaggcgctcaggcctcatcactcgggcaacaggtacctgagtcacagtctgccaccccgacccagggagcgcccatttcgtgctccctctccaggaatacatccagaagctgatgcccccactgatccagaagtggaatgagctcaaggacgaagacaaggacctcttccccctgctggaggtgagtgggctcctgcccctcacccgaaacccatcctgcccaccctgcctgagttctccccacctgccttcctccctgccagtgtctgtcatcggtggccaccgccctgcagagtggcttcctgccttactgtgagcccgtctaccagcgctgtgtcaccctggtgcagaagacactggctcaggccatggtgagcaaccctaggcccgtcacctgtgcttctgcattggcctgcctcgggcctgctccacttacccgtgcccctgtcggcatctgtgtctagatgtacacccagcaccctgagcagtatgaggctcccgacaaggacttcatgatcgtagcactggatctgctcagcggcctggccgagggcctgggtggtcacgtggagcagctggtggcccgcagcaacatcatgacattgctgttccagtgcatgcaggtgggtggggaccctggacagtgatgacacccagcagcctgcgtgggctgcccctggt

SEQ ID NO: 90932 - DNA, 1170 bp, Homo sapiens
cctaggctatgattatagagcgaggattatcataatattggaataaaaagtaattgctacaaactaatgattaatgatattcatatataatcatatctaagatctatatctggtataactattcttgttttatattttattatactggaacagctcgtgtcctctgtctcttgcctcggtgcctgggtggcttgccgcccacagggttagaccctgcttcttaagaaaaaaaaaaaaaaacctttctctggaggcaggagtggtatcatttatatcctaatcatagcggcagagactagattccgataattccccagagggaaatggatcaatttgcacctagcagtaccatcatgctctgcagggtctgctctgtggctgattggggggctggtcactctgttggcacctgtttgcctcctccccaagctgtgcctccccccaacttttgccacggcccctgcatccccataaacagtccctctctgtgcaggttgatccccatcttggtgaatgggatgaagtactcggaaattgacatcatcctgctcaaggtcaggcagggcccacccagcatgggtgggcatgggcgtgggtgtcgcggctgtggtccccaaagtacttaacagtctgcctgtcccccagggggatgtggaggaggatgaggctgtccccgacagtgagcaggacatcaagccacgcttccacaagtcacgcacggtcacactgccccacgaggctgagcggcctgatggctccgaggacgcggaggatgacgatgatgatgatgctctgtccgactggaatttgagtgtgtgcccctgcctgggggtggtggtggggtggcaagccctggactccctcttgggaggtgactagaagctgaggcagaagctgattagaagctgatcgtggccgggcgcagtggcttacgcctgtaatcccagcactttggaaggctgaggcgggcggatcacgaggtcaggagatcaacaccatcctggctaacacagtgaaaccccgtctctactaaaaatacaaaaaattagtcgggcgtggtgtcgggcgcctgtagtcccagctactcgggaggctgaggcaggaaaacggcatgaacccaggaggcggagcttgcagtgagccgagatagcgccactgcactccggcctg

SEQ ID NO: 90933 - DNA, 1989 bp, Homo sapiens
tgcacggcccctcccagttttttttgctaatttatctttacttcatagcttgcttccagctcccaagggtgaggattttgtgttttgctctgtgctgtgcctcagggcctggaacagagttgactcacagtaaggctcagggtgcctactgagtcaaggagtacccttctacctatgtcaaggccaggagcggtggctcacgcctgtaatctcagtgcttttggaggccaaggcaggaggattgcttgaggccaggagttttaggccagcctgggcaacatagtgagatcccatctctacaaacaattttaaaaattagttgggcgtggtggcatgtgcctgcagtcccagctacttaggaggctgaggcaggaagatggcttgaggccaggagtttgaggctgctgtggactattgattgtgccacagcagtccagcctgggcaacagagctaattctatctcttacaaagaaaaaaaaaaggaggggggatgtagagggcgtacatgggctagggaacagaaaggcagcactgggggtgtccagtgggagggggaggtgctaggcagcccctgcccagcctcaggcagcgtcctttcccggccgccccaggcattctcatcaccaccatcgcttccaagggtgagctgcagatgtggcccgagctgctgccccagctctgcaacctgcttaactcggaggattacaacacttgtgaggtaggcaagaagccatggatggccagagcgagtactggggggctgggaccaccacccaccacccacgtttgtctctctgcccctctgcactcagggagcctttggagccctgcagaagatctgtgaagactcatcagagcttctggacagtgacgccctcaacaggcccctcaacatcatgatccccaagttcctgcagttcttcaagcactgcagtcccaagatccggtgggtgcagctccctgggggcttccagggagcctggagtgggcagggtcagggtgacccacgtgtctgctccccgccaggtcccacgccatcgcctgcgtgaaccagttcatcatggaccgggcccaggcgctgatggacaatattgacaccttcatcgaggtgggccgctgggctgggggtgggcagggcgaggactgagggcccctacaactgaccctgttcctccctgcagcacctatttgccctggctgtggatgatgaccccgaggtgcggaagaatgtgtgccgtgccctggtgatgcttctggaagtgcggattgacaggctcatcccccacatgcacagcatcatccaggtgtgcatggtcaaggccagcccaggcgggcaggcagggggccggtggcaggggtcagggagccacccccagccaggccaggcctcagcttctcccccctaccacagtacatgctgcagaggacccaggaccatgatgagaacgttgcccttgaggcctgtgagttctggctgacgctggccgagcagcccatctgcaaggaagtcctggcctcccatctggtccagtgagtgctgctgctgcccactgtcctaccccagcttcgaccccttgctatgcctctgccttcccttctggtcacctgctgtgcttctctcagtccacatccttgtcagtttacattcagtatatatttatgtgtaagtggtaagaatgccactttttgaagacttcaaaattaggtaactgataggtggaaagaaatgaaaaatcaatggccacatgtggtggctgacacctgtaatcctagcactttgggaggccgaggcgggcagatcacaaggtcagaagatcgagaccagcctggctaacacggtgaaaccccatttctactaaaaatataaaaaaatagctgggcgtggtggcaggcgcctgtagtcccagctgcttgggagggtgaggcaggagaattgcttgaacccaggaggctgaggttgtagtgagccaaggtcgtgccactgcact

SEQ ID NO: 90934 - DNA, 1061 bp, Homo sapiens
cgccgccgcctgtggcccgtttccacatcccccctcccgcgctcccgagcccgcgactgcgcggccgaggatggcgcagctggcggggaccccgcacttgggcgggcgtggatcggaggcctccgcctgtccgccgagggcgttcccgtcgtcatgcggccaccgcggcctcaggggctccacctgggtctcacacggagccccagagacccagcgctgaccccggcccctacctccgcagcttgccttgcgccatggactggcagccagacgagcagggcctgcagcaggtcctgcagctgctcaaagactcacagtcgcccaacacagccactcagcgcatcgtgcaggatgtatccttccttccttccggggctgggggagccgggtagatgcgtgcagtttccaaaggccagagagagaaagagagggactgactcccctagtccccagattttttctgctgtgcggaggatctgccctggacagagaaggattacaattcctgggtcccatttccagagctgcggggattgttatagaaaatgatgaaaattcctaatgttcatcgaacgctagcatctactccattaactattaaagtaggccctggcccaacggggtggctcatgcctgtaatcggagcactttggtaggccgaagcaggtagatcgcttgggcccaggagtttgagaccagcctgggcaacatagggagaccccatctctacaaaaaatacaaaaaatagctaggtgtggtggcatgcacatgtagtcccagctacttgggaggatgaggtgggaggatggctagagcccaggaggtagaggttgtggtgagctgagattgtgccactgtactccagccaccctgggcgacagagccagaccctgtctcaaagaaaagatatataggccaggcgcggtggttcacgcctgcaatcccagcactttgggaggccgaggcggacggatcacctgaggtcaggagttttgagaccagcctggccaacatggagaaaccctgtctctactaaaaatacaaaaattaagccaggtgtg

SEQ ID NO: 90935 - DNA, 1038 bp, Homo sapiens
gaggccaaagaaacggcaactctttggtcacgtgaccggaccttgtctcagcccgggtttcccaagtgccagggcacgtgtgaaggttgaaccttccgattggctcggcgggaccagtttgaacggagtacgggagccgcggcggctcacctacggccgcgtttttcttttttttttttctttctttcttttttttttttttttttttttttaattctctctctttggctccctccttccgcgcgagtctctggagaagccgcagcgcgagttgccgccgctgctgcccggggccgggtaagtgggcctcactcagagcccgaccctcttggccccggcttgcgtcgacccccgccgggcaccgagcctgcgccgcgcgcggcccgggcgtcggggccgcgcccgaccgggaaaggccgggaagccggttgggcccgatcctcctggcagctagaacgggccgggcgggggaggggggaaccgagcagagcttagggggtggggcctcggagccaggccatgtcggggctcctcaagaagagggccagtgggactgctggggtcgggctggaggggatctgattgggggaagcgtctggggactgcttggggcctgattgggggacgtcgcgaggatcgggtgtgtgtaggggcctgtttcggtggggcttggttgggtctgattgggggaggccgcactgaaaagttgagcggggtggggggaggggagctcgttgggtcctgacagggaggggcgtcagacttcggcctagagggttttcttggatctgacttcgaggcgttgctgggatccgttgaggggaatgccccggggggtgtttacccaggccgaactgggggaggctgcaaggatcggaccagggggttactgacacgaggtggtggggggctcggccgaacttgactgggagaggcaacagagatccgtcagcaggggttactgctgacagggtcggagggaatttcagggagaggcttggccagacctgattggggaaggcgactgggatcggtcca

SEQ ID NO: 90936 - DNA, 1737 bp, Homo sapiens
cttcaggtgatctacccgattctacctcccaaagtgctgggattacaggcctgagccaccgcgcctggtcaaaaagggggtggttctaactttcatcttagggtagctgtgaaaatgaaaggagatgatacatccacagcacttggcacagggcttggcatacagtacatgctcaataaagggagctgttgccacctcttgtggtccctgctagggagggtgaggccttggcgtggaaagtgagaacagagctggtccctactgaggtggacactcttcttgctccctgggagggcaccgcgggcccagggcaggcgctgagtcgcgtgtgctcctctctgattgctgcgcaggtcggccggctggcggagctgggcgcggcgtcaggacgggccaccaggccgggctaggaaggtgtagtgggcctcagcgccgccaagggcggtcccggctcctgtaaccgttgcagtcttctgtcccttcacccaggtgggcaaacgcagaggcgggaacaaactagccctcaagacgggaatagtagccaagaagcagaagacggaggatgaggtgagccagcttggtgcagggggtccacccacattgcctttcccttccagcttttgcgcccagccttctccctccctgtctggtatccaggccttttatgagtgtgcctggcagggtaggagggctgtcaatgggtccccagataacttgactttataatcttcagctcaaacccagagtcttctgggtgacactgggaatgggtcacctgtctcagggcagtcctgaccctggttcctggcacccccgtcctaacccgtatcccctttccacaggtattaacaagtaaaggtgacgcgtgggccaagtacatggcagaagtgaaaaagtacaaagctcaccagtgcggtgacgatgataaaactcggcccctggtgaaatgacgcccctcccccacctgcccatggcctgggactctctgcgatgtacataactatttaatgcagcggcagcggcgacagccttccctgagaggacttaaaagcagaaggaaaccgagatgcttcccgcagccgtggacgattctccaggactctttttttaccttgagcacttgcctcgtgagacttcatagaacagtggtttactgtcccccccttctcacctcctcattctctctggctctttctgtcttcctcttctcaccctcctccctccccttagccatcacttctgggaagtaaagaacttgacttagtgccggagctgtgtgcttggtttgtcttctttgcgctgtcggacctaagccttccccctgttgctggcattgtacctgtcaaagcctgggcctgacccagtaaggagcgggatatggaagggttaggaaggacaggggcacatcccctcctgtaggcctggactttccccaagacctatctcccctcactgctgcatctctaccgtgccaccttaggctcactttctcttcacagttccattttggcttggccaaagctgttgcattgtgcattcagcagacacttaggagcatctattatgtgccagggctctgcaaggctctgggacaacagctgggagcacgcagaccacaccctccctgcccttacagaaggagacagacacaaacaaaaaggggaagcccttttgcagctagggaggaggcgggtatgtcttttaggtgacatttgattagagtcctgagggaggtga

SEQ ID NO: 90937 - DNA, 1916 bp, Homo sapiens
ctgggcgtggtggcgcatgtctgtaatcccagctactcgggaggctgaggcaggagaatcgcttgaacctgggaggtggaggttgtggtgagccgagatcgcgccactgcactccagcctgggaaacaagagggaaactccgtctgaaaaaaaaagaaaaaaaaaaaacgaaacaaaaaaacccgcgagacgggggctcctccccctagccccgccccttcgggttggttccctcattcgccccgcccccgctgcgggcgctggagggcctgaccgctcttcccggcatgcattgttcgggacgaggcgagtcgggcgccaagcgcggggccggagcggccttcccggagtcctttgcgcggcacctggcgacaaaatggctgcccgagggagacgggcggagcctcagggccgggaggctccgggccccgcgggcggtggcggtggcgggagccgttgggctgagtcgggatcggggacgtcgcccgagagcggggacgaggaggtgtcgggcgcgggttcgagcccggtgtcgggcggcgtgaacttgttcgccaacgacggcagcttcctggagctgttcaagcggaagatggaggaggagcagcggcagcggcaggaggagccgcccccgggtccgcagcgacccgaccagtcggccgccgccgctggccccggggatccgaagaggaagggcggtccgggctccacacttagcttcgtaaggagccgtgggggtgggggcgggcgccacggcctgtcttggcagcgggagtcggggcccgtgaagggggatcgggaccgaagtccactttccgttctgaatgaggggcccgtccgggtcacccgctgagggtgtggaacttggattcccgacaactggggtctaggggcgggagtggggactccaggagcttgcccgtgggaactgggagctgaggaattgcctaggaatcagcactgtggagaatgaggaaacgtggatatcaggattcctgtttgagtggtacccggaccttgggtcatgggaccaccactaattgtgaggaaagggagtaaatttaagtctggactctgagctatatgtgttagactcagaccacgtactatgtaaggacaattacttatctaggacaattgcttgacttccttgtatcttattcgaccaacctccatttattgagcaatttacctcgtgctaggcattgtgctaggtgctggtatgcagtggtgagcttacagacaagatcgctgctttcctggagcctctgggtttgcctaccctcattttccctagttgcaaaaatagacatcatagcatctcttgatgtggtgagggttttatgaggtgatcctggaaaagtggttagcacagagcctgtcttccaggaagggctaaactggtggttctcaattggggcagttccctccacccccacatttggcaaagtctggagacatttttggttgtcagaactgcgggagggggtgctagtgacatctatgggtagaggccagggatgctgctcaacttcctaccatgcgtggggcagcgccctcccacccccaaacaaagaataatccagctcaaaatgttattagtgccaggttgagaaactctggattaagtaaatagggcatatattgatttttggctctgagcttgccatgtctgtggtgttaagatcaagtccctgtagtgtggaggaaaaagtgttgagaataacaagactgggggctctagttctggatccagcatgtgattttgggcaaatgatctaacctctgcaagcctcagtttcttcatttgttaaaaatgggcgtgggttgggtgcagtggctcacacctgtaattccaacattttgggaggtcgaggtgggtggatcgcttaagcccaggagttggagaccagcct

SEQ ID NO: 90938 - DNA, 1062 bp, Homo sapiens
ctaccgtgaagaatagagggaaaatgatggacataaagttgagcctatggagtcaggccaaggaggaccgggaatctaacttcaccgaaagggcatggactgggtgtttggctggttgctaaggtgaggttggcgctaccggaacataagagtgattggtgtaagtaagaaaagacatagccaatgaaaggagagctgcaagacctagggcccaatcagtgaaagggagtagcctagaccgtaccgatgtgttcattaggtagggggaacccttggaaaattatagaccagaggttgacaaagtgaaccctggaagcaaagaatagtgaaaatataatttatatttctcctaaaaggcaagtaatgaggaaattaactcatgctcctagcttcgctaggaatgtgatagagaatttcccctgtaggttcttcgtatggtgcgctccgctggatcacgtgagccagttccaaaatggcggcaggggtggccgggtggggggttgaggcagaggagttcgaagatgctcctgatgtggagccgctggagcctacacttagcaacatcatcgagcagcgcagcctgaagtggatcttcgtcgggggcaagggtggtgtgggcaagaccacctgcaggtaaggaggctgcggcgggggccaggaggcgtgtaggatataccactgggcgaaggggaggccaaggaccggcttttccaccacgaccggggcatgggggctggcgggggtctttgggtttcactctctggaagttacctggagcaaatgagaaagacctcaatgcagccctagcaccctctgagttggaccatccgtgttggggctcaagtgccgaaccacagtgaactcagcgcccgggggacggggaagcacttagatatccccatcagctggaccgtacctgagtgaatccagagttgtgggtgagggcggcaccagaacaagcaatcctagtttggtgaaccttggtgttttatgcccaaggcgagagtgagggtggaaagcgagggagagagcacgtgatgagactgtcccaggcagctacag

SEQ ID NO: 90939 - DNA, 1003 bp, Homo sapiens
cggcggttgcagtgagccaaaatcacgccattgtactccagcctgggcaacagagtgagactccatttcaaaaaaaaaaaaaaaagaaagaaagaaatggaaaagctagtatttgaccaaccccaggaatctgcttatgggcctgagcctttaaccactgggaggtatcaggagtcatccctcgggtgtttagtgaacccccaacccaggaggtcgccgcaggtaagctatgagccctcccacatcccccctgcagatgtgcaacatgctgggcctgggggacatgaacgcagaccagctggcctccaagctggaggagacgctgcccgtcatccgctcagtcagcgaacagttcaaggaccctgtgagtggtggtctggctggcggtgagaggcccgggggctgaggacaggggcagaccccgcccctcactgtcctctctcgtgccctgtaggagcagacaactttcatctgcgtatgcattgctgagttcctgtccctgtatgagacagagaggctgatccaggagctggccaagtgcaagattgacacacacaatataattgtcaaccagctcgtcttccccgaccccgagaagccctgcaagatgtgtgaggcccgtcacaagatccaggccaagtatctggaccaggtgtgcccacccacccagcactggctcagcagaggcacctctgcccctttattctctgatcttttgctccaccatctggccctctgccctctagcctcctgccctttgcccccacatttcagatccttcacccttattccggccatagaggactgtggctggcctggcctaggtccctgtgaccctggagagcagggggtctagcccagtgatctctgaccatagtgatgcagctcccacttatgacaccttaagctcctgccctatattctctccctgactctggaagctttctagctttaccgcttctattgatccacactctgtctctgccttcctgccccctgacca

SEQ ID NO: 90940 - DNA, 1046 bp, Homo sapiens
ttcacactcaccctccaccctccccaccccctcggggcagagtttgcacaaagtcccccccataatacagggggagccacttgggcaggaggcagggaggggtccattccccctggtggggctggtggggagctgtagttgccccctacctctcccacctcttgctcttcaataaaatgatcttaaactgctgtattgttgacattgggaggtgagggtaagcacctttatgtacagttgcacaggttgtgcactggacagaagtgtcacatctagaggggcccattcacaacagagacctaatagagatgcatgtttattgtggcaactttggaaggagggtgtcttgggtgagagatacctttgtctcattctgtgtgggttaaggtgtccctgttgggcctgtgaagcctggaatggaagacagaggcattttcccacttccttggaggctcagagcgtgggaactgggaggccccttggccagccccaggctggtggggagcagagcagattaggccggcagtgggcccggcactgcctgctgtttggtttgggaattagtgggcgccctggggagaggccaggcctgccagactggggattaacagtctccaccccccaattcctgcccccatgggatggcatcagcccctcccagcaaagggctgcagcaagggggctggttagtgggcagggtgacagaggactccggctggaggggctcctgaagtctcatcctgactccagagcggtctcaggctgtgggcacacaggcctggaaggcacctagtggacccccttatcccctgcccttcgctcctccctctgccactgcctgggctgctattgttgtccccacttgggagactcaggatggggtatgaccttgagagtttacaagttccaagccagagctggctaggggggacagaaagggggttcctgaggacacacgtgagtcggtgttcaggccgggcgcggtggctcacacctgtaatcccagcactttgggaggccgaggtgggtggatcacttgaggccag

SEQ ID NO: 90941 - DNA, 1050 bp, Homo sapiens
ggctgctggatggagtgcttgagagtagaagaagctagcaagggaagatggtggctgaaccagcttgggagctgtgggatgggaagaagtggacagcaggggctgttccggggcatacctgctaagggtgcggagggttgtggctctgacagctgtggagccggtgggaccagggcacacagccccaggcatgaggggcaggcagagagggctctgtggccatgtaggggcatttctggctggcggggaggtctgtggctaccactgggacaaaagagaagccagcccggaggtcagcccactgctgctcatccccggcccacaggcagaagcttcatgaggcagatctggagttgcagaggaagcgggagtacattgaggagctggagccacccactgacagcagcagtaagtaggacctagtgaccagagggtggggagatcccagagcccagcagcgtggagctgatgggccacctcttccgccagcagcccggcggatcgaggagctgcagcataacttgcagaagaaggacgcggacttgcgggccatggaggagcgataccgccgctacgtggacaaggcccgcatggtgaggacgctgggtgttcccacaagttgcctgccctggcttcttactttttgtgcctcctattgagtcaaacctcctgcttgcacatctgtgcccccaactcatacctgtcataccccaccataagacagacttctgcatgattccccactgctactgattgtcacattaaaatactgcacagctggctgggtgccgtggctcatggctgtaatcccagcactttgggaggtcaaggcaggcggaacatgaggtcaggagtttgagaccagcctggccaacatggtgaaaccccatctctactaaaaatacaaaaattagctgggcatggtggtgggtgcctgtaatcccagctactcaggaggctgaggcaggaaaatcatttgaacccgggaggcggaggttgcagttagctgagattgtgccactgcgctccagcctaggcgacagggcaaga

SEQ ID NO: 90942 - DNA, 1141 bp, Homo sapiens
cgagactccatctcaaacaaacaaaaagccaaaactaaccaaacaaacaaacaaaaaaaccccgaaaaactgtcccatcctagttcttcccatttctgcttcccgctttccagcagtcccatcccagctgttcgaatccactcttgtagctccgcccctgcctagccccacccactatcccagcttagagctccgtccactttaaccctgggccgggaacctgaacccgtagtaggtcctcggtgctccaaccccatggtctggctgggctcttccccagggctctgtcccgcccctagctccactctccctgagccccagcgagcctgcgaggtgactcgaccctggccctgctctctcctcccgggtctgcagggagacgctcctgcggcttcagctggagaacaagcggctgtgcaggcaggaggcggccgaccgggagcggcaggaggagctgcagcgccacctggaggatgccaaccgcgcgcgccacgggttggagacgcagcaccggtgagcgcctggggacctacctgcgcggagcagggacagagggggccaaaagtgggcacaggcactaagcggccccccaccctcgcaggctgaaccagcagcagctatccgagctgcgggcccaggtggaggacctgcagaaagccctgcaggagcaggggggcaagactgaagatgtgagtgtcacccaccacctcccagcctggccctcccttgtgccccgaagtaaccctcctctctctcccatgctgcccgatgccccatacaggccattgtaagtaccatgggcccaggatggcaccccctaccctcaccctgggaaggaagaattagggcctctctggatcccccactcaccttgcctcttctctctcccagtccattttgctgaaaaggaagctggaggaacatttgtaagtcgcagaaagagggaactcctcgtgggggcatggatttgatattagtggggagtttcttaggcatgtgccaccatgcctggctgattttttatatttttagtagagacggggtttcactatgttggccaggctggtctcggactcctgaccccagatgatccacccgctttggcctcccaaagtgctgggattacaggcatgagccaccg

SEQ ID NO: 90943 - DNA, 1019 bp, Homo sapiens
acagaataggatgagatgagcagggaaggagaagtgaggtggagagaggatgggacctacagattcagagtgggaggcctctgaacttgtccacagttccttgttcctccctaggtcagcaatctgaagatggtcttacggagcctagtagagtactcccaggatgtgagtaactgtaaagggattcagggggttgagttgggagaagggtgggcccatgagcccctgacacccccttctccccaggtcctggcgcatcctgtgtcagaagagcatctcccagatgtgagcctcattggagagttctcagacccggcagagctcggcaagctgcttcagctggtgctgggctgtgccatcagttgcgagaaaaagcagggtatggggagcttagggggtccccagggctggcctgaggaaatcctccttcctccccacctcacccctgggtctcagcctcccccaccttgatccccagaccacatccagagaatcatgacgctggaagaatcggttcagcatgtggtgatggaagccatccaagaggtgggtgggggcactcagtgtgcaattggaaaatgtcaggagaggggacatctctagggcagagagaactgggcacaggtcctgccctggtaaggtctggactctgcctggaactcagctggccagacatctctgtctcatgtgtctgccagctcctcccagctctaagtcgcaatctagcaggctcaagggatctggcttccctctgtgttggaggcaggagggcagcctctgggctggggttattgggcagaactggccttgacgggaggatggagaggttctcaggttggatagtagatactttgaaggctggcctcagatatccagttcattacaatgccccttcccactcctcagctcatgaccaaagacactcctgactccctgtcaccagagacgtatggcaactttgacagccaggtaagagatttgggggaaaggtgttccaggcacagggatcagcaaatcca

SEQ ID NO: 90944 - DNA, 1050 bp, Homo sapiens
tgacacacatggagacaaacacaataggctagaaacataggggcaagacagacacagagtgaactatatgtgagacaagcaggcaacatgtgcatgctgataggagagacagtcactttcagcaccagcaccccgagagccacacgagagatatgcagacacaggcatgcactatcagatcctgacacgcaagagaaggcaacacacacacaccccagatctccaactcagaagatagagacaagacaagagagacaaacctagggacagagatgatgtgttcacagtatggcagagagtccctggcaccctggcccaccactgttgcacacacatcagagatgctcccagggacaccaagccgaagccttagaggtacacaccatctcaccaggaacacacacatgtgggacctggcaacagattgggtagatctgggcagactgacacattcacagacatggtctggccagacagtcacacccagtgcagagaggcacagacaggccacagtgggacattcataaacacatcggcacagaaagaccatgacaaaacctgtttgcacacacacacatgcacacatacaaacggagatcagtaacaggcaacatacagatcagccacagaacacacacatggaaacaagccacagacctcacacacagagaccacacacacacaccaaacacaaaccagccacagacctctttttcacacacacacacacacaccagatcgtatacacacatacatacagaccagccacagacctctttttcacacacacacaaatgcacattacagatcgtatacacacagaccagccacagacctcttttacacacacacaaacagatcatatacacacatacagaccagccacagaccacacacacaaacacacatacacaccgacacaagttagccataggaactttgaaacaacctacacgtacatacatctagaccatgtgcaacccatcctatagagctcacacacacacagagtggaacagaactctacacagataagccctacatagacct

SEQ ID NO: 90945 - DNA, 1047 bp, Homo sapiens
gcacctccttccatgcgtaccccgaggtcctttgagcccctccccctgcagccccgccgagccacccggcccgtggccgctgtttacaaggacacgcgcttcctgacagtgacgcgagccgcctcctccccttccccacgctcgaggaggggggcgcgggggcccggctccggcgacggccaatcggagcgcacttccgtggctgactagcgcggtataaaggcgtgtggctcaggctgagcggctgggaccttgagagcggccaggccagcctcggagccagcagggagctgggagctgggggaaacgacgccaggaaagctatcgcgccagagagggcgacgggggctcgggaagcctgacagggcttttgcgcacagctgccggctggctgctacccgcccgcgccagcccccgagaacgcgcgaccaggcacccagtccggtcaccgcagcggagagctcgccgctcgctgcagcgaggcccggagcggccccgcagggaccctccccagaccgcctgggccgcccggatgtgcactaaaatggaacagcccttctaccacgacgactcatacacagctacgggatacggccgggcccctggtggcctctctctacacgactacaaactcctgaaaccgagcctggcggtcaacctggccgacccctaccggagtctcaaagcgcctggggctcgcggacccggcccagagggcggcggtggcggcagctacttttctggtcagggctcggacaccggcgcgtctctcaagctcgcctcttcggagctggaacgcctgattgtccccaacagcaacggcgtgatcacgacgacgcctacacccccgggacagtacttttacccccgcgggggtggcagcggtggaggtgcagggggcgcagggggcggcgtcaccgaggagcaggagggcttcgccgacggctttgtcaaagccctggacgatctgcacaagatgaaccacgtgacaccccccaacgtgtccctgggcgctaccggggggcccccggctgggcccgggggcgt

SEQ ID NO: 90946 - DNA, 1316 bp, Homo sapiens
ggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagctgctgcttggggtcaagggacacgccttctgaacgtcccctgcccctttacggacaccccctcgcttggacggctgggcacacgcctcccactggggtccagggagcaggcggtgggcacccaccctgggacctaggggcgccgcaaaccacactggactccggccctcctaccctgcgcccagtccttccacctcgacgtttacaagcccccccttccacttttttttgtatgttttttttctgctggaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtgtgtgtttgttctttttattgaatctatttaagtaaaaaaaaaattggttctttattaatttctgttgtctttttttccaagctgggagggcggggggaaaaaaaaaagcactggtttgcccccagctcagtgctgttggtggctcggtcctgtatgtgtccccctcgtcggttcggcgcaggcatcttgtggtcccagcccaggagtcccacccttcccgcgtccccagatctccagggttggatggttggggcgcgggacgcggtccagggacccaggagctgaaggcagggtgctccggccgagacttggagtgcgcaggcgcgtccccgcccagccgcgcgcgccggggctttccccgctgacgcagcggaagcgctgcccatacaaggaccgattctgcccagtgacgcgaccgcggtctctgggcagattccgggaatcccctcccccgctctgccgggcagggccgcggcgccgggaagggggccgggattttcccgggcaggcggctgcccgggcacggaaagccccaggcctgggtccagagcgcccgcggtgggcgggcagcgctcctgggctccgggagccacccctgtgccaccttcaagacactggcgcctaggccccgccgcgcccacgccccctccgtctgacctgaccggggcggagggttgctgctgcctccgctg

SEQ ID NO: 90947 - DNA, 1051 bp, Homo sapiens
gtattagggaaaggtgtgagtctgtgttggtgtgctctgtcctttcgtcctcccctgcaacccccttccttcttcaggctcaggcttgggaaactgaccctgtggttgctcatcttcgccacacggtggcggtcttatcacatgcttagtgcctgctcttttcctgcttgcgctcaaggcggtttcggaggggtagggtatgccgtttgtcccttgcaaatcccaggatgccctacatccagaaatctggccatgcaaggcaaagcccacattttgtcaccagccagcctgggttcaaatgccgtttaagagctgtgatcgtctctgggtctcttcagcagtaaaatgggactgcaaacccagatcaccatgcacgtggtaaaatttgtaggagataagttatgtgaagctcggggctgaggcccctgtgtagggcccagttcctagttcctaagacggcttcctcgagctgaaaggaacccagcccagtgtagtcttatggggaagagggtggggacccagtcttaagagcagaaccaagaatgagagcctgagctacgtgcagagtgcagagtccctgctgtgagctctgccccaccccaggctggaaaggttgcctgtctgcccctggggtgggagggtggcagttaggctagaaggcaggtattagcagcaaggcagggttcccaggggtgcagtttaatattgtgtgcgttcaggaaagtagttttgctactctatgccccaatttcctcctacagaacagggctaatatgctcatttaatccacagatccactattaatgctggtacccacctaataccctctaagggtcactcatctcccttggaatttaatctacactcctccccaaggcccctgctcagtctcccttgacatctgccctgttgtggttcactccattccagacaggctggcttcctgctgttctttcacaggctcacctggctacatgaattttgccatttaagagctgctcccaaggccgggcgcagtggctcacgcctgtaatcccagcactttgggagg

SEQ ID NO: 90948 - DNA, 1258 bp, Homo sapiens
caggctgctttggcccgatcctgactttagtgctggccgcctttgctttccatccgctatagtggcctcctttgtccttgcgggggaaaccgaggccacagccttgcagcgcaggcctgatcgcccgacttcccgccccctgctcgtgcgggcctcactgtctccttctgggctgggggcttgcgacaccgccctccggccgactcgctcgtggggtgctggtggcagtggctgggtcactcgtgctctggtcaggagagcgggtctccggcagcctccgggcctcgtagaccgggtacccgggagggtgagggttagtgctgtcgcctccgccgtgctgactcagtcatagggcccagcacgcagcgcgaccttgggttgggaggacaaagtgtcttcccgggcgcactgaccgggcgggggtctcagctttcagtcatggcctccggtaacgcgcgcatcggaaagccagcccctgacttcaaggccacagcggtggttgatggcgccttcaaagaggtgaagctgtcggactacaaaggtgagcgccgcccggagggggcccaggtagaagcggggccgtgcatgagagaagctgggccctaactcctctgtgtccctcctccccagggaagtacgtggtcctctttttctaccctctggacttcacttttgtgtgccccaccgagatcatcgcgttcagcaaccgtgcagaggacttccgcaagctgggctgtgaagtgctgggcgtctcggtggactctcagttcacccacctggcttggtatgagcaggggccaaagagggaggttgcagctaagctcacaccctcaggtcctagcagtgtggcttcgtggccattgctcaacctctggaacctgcgtttccccatcgtgaaaataatggaaacattgccgcccaagtctttaaggatgatgacagtaattagcatttgacaactagttgcctggtatatagagttgcagatgcaactcagatgcaactctatctactctatgtacttagttcccaggagggaggctgtgctgccctatttcatgaagatggaaactccagttcaccgaagtgaagggctgtaccccatgacacagctagaggaggatggggactcttaacacaggctctctgctgggtgatgctgcaagttacaagtacatgtgaagccacttagctggagctgtgcctctcaaactcagtcttcccagccatggggatacagtccttgcacccaacccag

SEQ ID NO: 90949 - DNA, 7429 bp, Homo sapiens
aagcggggctacctggtccaggggacttagaatgtgtacagaagcagggaccgcaagtacagggcctgaatccaagtggcagttggggacccagtgatgcggtgacccgtgtcctgggagtggggtgatatttgactctctagttccccgttaggctgggtcttcgaagctacgtctcagtttccctcttatttccccctcttcccaccgggccacgcaggcggggccccagagaccgtgaagcagagcttgcaaagtgaccccgtccaccgaattccccaagctgagtgttcggccatagcccttcgggactacaattcccaggagggcgcacggcagcgacgtcggcgtcggctgcgtaagcgtccacggcggcgggagcgccaggggcgtgttctgcccgcggattggccggaagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggtgcgcccctagggccagggaggggaggggcgtggtacggaggatgcgggaaacgggagtcgggattgcactgcaccaagggaggggatgtggtcgtggtgatggcacctaaagaagcagtgatgatagaacagggatgaatggcaactttcacgggctcagtgattggaccccggctgccagaaaactgacaccccttctccccaggccccatggtctacgccatctgttattgtcccctgcctcgcctggcagatctggaggcgctgaaagtggcaggtgagcccgaggtgtgcgtctggggaagggattcctgggtatgtgcaggggcaggtgagaactgaaaggggagggcaggaactgggagaaccagctgttccccttctcttccaaacctcctcccagactcaaagaccctattggagagcgagcgggaaaggctgtttgcgaaaatggaggacacggactttgtcggctgggcgctggatgtgctgtctccaaacctcatctctaccagcatgcttgggcggtgaggggtccccgggaggggcagccagcatgggctgaccaagctttgttcctagaatgagattaactgggctctgttccccaccacagggtcaaatacaacctgaactccctgtcacatgatacagccactgggcttatacagtatgcattggaccagggcgtgaacgtcacccaggtgagttaactgtaagttgtccccatttggtcatctcaggataaaatggggacaaaacaggagttcgagactgcagtgagccatgatcatgccacagcactccatcctgggtgacaaaggaagccccccaactcaaaaatggaggcagggcgcagtggctcacgcctataatcgcagcactttgggaagccgcggcgggtagatcaccggaggtcaagagttcgagaccagcctgaccaacatggtgaaaccccgtctctactaaaaatacaaaaattagctggacgtggtggcaggcgcctgtaatcctagctactcaggaggctgagacaggagaatcgcttgaacccaggaggcagaagttgcagtgagccaagattgtgccattgcactccaacccgggcaacagagcaagaccctgtctcaaaaaaataaaaaataaaaaataaactaaaaatgggagaccaggcgcagtggctcacggctgtaatcccagcgtttcaggaggctgaggcaggcagatcacctgaggtcaggagttgaagaccatcctggccaacatggtgaaacctcatctctactgaaaatacaaaaaattagcccagcatggtggcgggtgcctgtaatcccacctattggtgaggccgaggcagaagaattgctcgaacccgggaggcggaggttgcagtgaggtgagatcgcgccattgcactccagcctgggggacagagcgaaaaataaaaataaaaataaaataaaaaataaatgtgggcaaaaatgtgcagtgtgcagattcagcatcagatacgtctggagtgcctcgggcatattcattgctactgttgatttcgtgctcctgtttctgccctaaatgtgtgccacactgacgaccacagtgtagcccctagtcccgtctccatctaatctctccctcatcctaaaggctcagtctccagaacaaatcctacattgtctacctgtcacctctgtcctagcccaggacaccccccactccctggacacctgctgagtgtcgtctctcgtccctcaccctcctatcccctccaatctgttccccaagcagcaacagaaggtagtctttttgaaatgcacatctcgacatttagttttccgatcacagtggaaattaaatcaggaaaattcacagtcgagtggggcagaattacattaaattaccagagaaaaacataaatcagcattgcctcgaatgctctcaatgaaagaatggaccgttctgagagaataacaaggcaaaataaccttgacgtaggaattgtatgctgggtatggtggctcacgcctgtaatcccagcactttgggaagctgaggtgagcaaattggttgaggctaggagttccagaccagcctgggcaacatagcgagactccatctccacaaaaagaagaagaaagaaaggaattatagcaaggtagaccctgctgaggagggacctgaggaccaggcccaaatgcagagctggcgatacagtaactggtgtagacagacaagggccctacccgtaggcgttcagggcctagcctgggcagaaagatggtcagctggaggttgggcgcagtagctcacgcctgtaatcccagcactttgggaggccgaggcgggcggatcatcaggtcaggagttcgagaccagcctgaccaacatggtgaaaccccatctctactaaaaataaaaaataaaaaaataaaacatgaaagatggtcagctggtaaacaaaaaataaaggttgtttctgaaaacagtagtgctgtggagataccactttctcccagcagctcttggaccctctcttcggtgctgcagccaaaggcccccatgcatgggcccagcatcatgaacctggtcccagctcagggcctttgtactggctgttctcacacctagagccctcttccccagatctctgcacagttcacttcctcacctccttcaagcctttattcaccactacacctagctaactttttattttttgtagaaacagggtctccatatgttgcccaggttggtctcaaccacctgccctcaagcgatcctcccacttcggcttcctaaagtgttgggattacaggcttgtgctaacgcactctaccaatttttttctagtgttttctgccacctcagttcctagaacagtatgtggcatgcagtaggtgctaaataagttagagtaaaagcagcgtgatagagaaagcctcttcaggaggtgagttttttctttattttattgtatttattttatgtttttataaagatggggtctcactgtgttgccaagcctggcctcaaactcccaggatcaagcgatcctcccgcctcagcctcccaaagtgctgggatcacaggcctgaacaactttgcctggtctaggaggagatgttcgagttgaaatccctgattgatccatcctggggacgtgctggagaagaggattctgggtagcaggaagaacgtgccagggctgtgaggctagagcattggtacagttgtttgttcaattaatatgtgtctgttgctgtggcaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtcagtaccctactagccatggctggcttccaccatcccactatataggggccaggcatggccaccaaagggaaggagggagattccaggtgcctgttttgcccacaggtggcccgggaccaggccgtgaagaaatggcagttcgtggagaaactgcaggacttggatactgattatggctcaggctaccccaatggtgagcagacacgtgaccatggtactaatgttgaaatggccagggctgagcacacttctgaggttttctttttttcctttctgtcatttatcattttattttgcttattttttgtttttatttgttatttttgtttattttttgagacggagtttcgctctttttgcccaggctggagtgtaatggtgcgatctcggctcaccgcaacctccacctcctggcttcaagcgattctcctgcctcagcctcgcgagtagctgggattacaggcatgtgccaccacacccagctaattttgtgtttttagtagagactagttttctccatgttggtcaggctggtcttgaactcctgacctcaggtgatctgcctggctcagcctcccaaagtgctgggattacaggcatgagccaccgtgcccagcctattttttgtttttatagagatggggtcttgtcatgttgcccaggctggtctcaaattcctggagtcaagcagtcctcccaccttggtctttcaaagtgctgggattacagccatgagccaccacccctggccctttttttcttctttttttaaagagatggggtctccctatgttgcccagcctggtcttgaattcctgggcttaagtgatcctcctgccttggactcccaaatagctaggattacaggtgtgaactactgtgcctggctggaggttttctaaattgctctggtcaccctactccacagtgaaagaggccaagtgttagacagtggtgccatttgtttatggccacacagccagtgagtgatagagctgaattccaggccataggattgctgctgtcttccccgcttcccactttgctgtctttctggagccccagtgatggactgagacccaaggtgggcatttgtccctttgttaaggggaaggggaccaggcgtggtggctcatgcctgtaatcccagcactttgggaagctgaggtaggagaaccgcttgagtcctcgagttcaagaccagcctgggcaacatagcgagacccccatctctataaaaaatttaaaaaattagccggttatagtggtgcccacctgtagtcccagctactctggaggaggaggctaaggtgggtgggttgcttgagcccaggagttggaggctgcagtgagctatgattatgccactgcactccagccttggtgacaagatgagatcttgtgtcaaaaaaaaaaataatgttagccaggcgtggtggctcacacctgtaatcccaggactttgggaggctgaggcaggtggatcctttgaggtcaggagttctagaccagcctgaccaacgtggtgaaaccccatctctactaaaaatacaaaattagctggacgtggtggcacacgcccgtaatcccagcaactcgggaggctgaggcaggagaattacttaaacctgggaggtggaggttgcagtgagccgagatcgcataattgcactccagcctgggaaatgagcaaaattccatctcaaaataataataataataataataataatatttaatgacaggctgggccaggtggctcatgcccgtaatcctagcattttaagagacagaggcaggtagatcatgtgaactcaggaattcacaaccagcctgggcaatatgacaagaccccatctctacaaaaaatacaaaaattaggtgtggtggtgcgcacctgtagtcccagctacttgggaggctgaggtgagaggatggcttgagcctgggaggcagaggttgcattgagctgtgataatgtcactgcactccagcctgggtaatagagcgagaccctatctcaaaaaaataaaaaggctgggtgtggtgtttacacctgtaatcccagcactttgggaggctgaggtgggtggatcacctgaggtcaggagtttgagaccagcctgcctgtccaatatggtgaaaccccgtctctactaaaaatacaaaaattagccaggtatggtggtgggtggctgtagtcccagctacttgggaggctgaggcaggagaatcgcttgaacctgggaggcggaggttgcagtgagccgagatcgcaccattgcactacagcctgggtgacagagcaagactccatttcaaaaaataagtaaataaaataaaaatgtttaatgacttgttcttggaggtcaaggagatgtctcagaggcagtctccctgcactgcccttttagcagctcttggccaggtaaaggtcctgtggcaagaaggtgcttcagaccataggaggtgccccaggtactcaggaggaagccttagaagagcggcaaggaggccgggcgtggtggctcatgcctgtaatcccagcactttgggaggccgaggggggtagatcacgaggtcaagcaattgagaccatcctggccaacatggtgaaacctcgtcactactaaaaacacaaaatttagctgggcatggtggcatgcgcctgtagtcccagctacttgggaggctgaggcaggagaatcgcttgaatccgggaggtggaggttgcagtgagctgagatcgcgccactgcactccagcctggctacagagtgggactccatctcaaagaaaaaaaaaagagtggcagggagcttgaatgttatggtgcaacttggactgtcaccattgcccaccctaccccagatcccaagacaaaagcgtggttgaaggagcacgtggagcctgtgttcggcttcccccagtttgtccggttcagctggcgcacggcccagaccatcctggagaaagaggcggaagatgttatatggtgggtgtcatggatgtcctgggggtgctatagggaaggaaggagggaggccagcgttcagccctgcctgagagggttgctccctgtgtaagtggtcactgtcatcacctctctcccacagggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccacacgtaggggatgtacttttgggacagaagcaaggtgggagtgtgctctgcagccgggtcca

SEQ ID NO: 90950 - DNA, 1060 bp, Homo sapiens
gtgctgcttcacctcaaaagcgccgcctgggacggaagggattccagccacagctgatggccaacccagcagcccagccccgccccccatgtcttccgccccggggccacagcacaggctgggcctggggttttggaggcctgctctctatcagtgggccctcagctcctctgcatggcggacttacctgccccaagcctgaccagagggttggtctgcaggaggctggatatgaggagttgggcctccgtaggtagggcctcatccccctcgggccacaggatgtcatctgcaaaacaaaacggaacttaggggcggtttttgttgttgttgttgtttggacacaggatctcactgtgtcacccagctggagtgcagtggcacgatcatggctcactgcagccttgacctcctgagtgcaagcgatcctctggggggtcgcttttgaaatccctggaaccctgagcctgtccatctctccgtgcacaccacactctgcccctgtacactgccaagccacgtaccactgatgacctgtccaaatagctcctctggtgtgtctccgaagaagggcacacagcccaccaggaactcgtagaggatgatccccatagcccaccagtccactggcttgccgtagccttgacgcaggatgacctcgggcgcgatgtactctggggtcccacacacctgggggcaggctgtcagcccacgccccagccagaggagggccctcaagggagagctgtgccccccaccaggccctgggttcccgaggtcctgcagggtcactccaccctcagcgacccccatgcccgcacacacacctgtttgtccaggaactctcgggcgtccttctcgatgtggccttcatataagttggtggtgaggctcatgagccccatcttggagaggccgaaatctgtgagcttgatgtgacccatggaggtgataaggaggctgtaggcacaggtggggatctcagggatgaggcccgtccattctgcctcctggcctcccgagggacagagggagtgatgggaaagatcaaagctcactt

SEQ ID NO: 90951 - DNA, 1984 bp, Homo sapiens
cagtgagtctccgcctaaaataaaaaagtaaaagaaaaaagaaacaggtttagagagggaagaggcatagagggtcacagaggtgtctcacccaggctaactggtttgagctggaggggccttttccccaccaccctccactctgtgatggagactccacccatgagtactcacccagacaatgtggtggacactatagacatccgtgtcacccatgtagacacggatggcacgcagtgtgaagccatacttcttgcccgagcgctggatggtgatgggggagcggagcccactgacagctggtgagtagtcccggctgggtgaggagtcccgtgaggatgggttggaggacagagatcgtggagacatgggactagcaaggggtgaacttccatgtgggtccactacagacacacaaccatggtcagaaatcagaaccaagaagatagacatctccctgtatctgctcctccctcctcccaaggcagtggcagagcagcctctcattggtccagcctggagccaatcacggtggacagggaaaatgcagcattttcattggtctgtcctgcctcaaatggggggcagcccctcccctgccaggtggggcccagcattacctgcaggaatcatgacagataaggcagtggctgaggctgatttgatgactttgcccccagttcgagaaggcctcttctctactgccacatcccctgacatctgctggtgccgcgcccggcgcagaaccaagtcattggtagcccttgggcctgatgcatccccatccttcgagggtgggcagaggtcacctgggcgtggacggtcagctgcaacagaaagcaagtgtgttaggaattagtccaaggccagggatttcccacatactgtttccctgcctggaatgctctttccactttttacccttgatggatggtgagtttcatctgagcaggtaacctgcatgcctcactgctcctcatatagagacatagtctgtatcggtctgtatcactgactgaccatggtattggggtgtttctaatgttaagaatcccaaattgggctgggtgtggtggctcacgactgtaaccccagcactttggtaggccaaggaaggcagatcacttgaggtcaggagttcgagaccagccttgccaacatgaagaaaccctgtctctactaaaaatacaaaaattagccgggggtagtggcgcgcgcctgtaatcccagctactcgggaggctgaggtgcgagaaccacttgaacttgggaggtggaggttgcagtgagccgagatcacgccactgcactccatcctgggtgatggagtgagactctgtctcaaaaaaaaaaaaaaaaaaaaaaatcccaaattgcaatgtgaataggacctgagatctttcataaacagcaccaggctcgtgggatgctcactatatgaccagtaggacattggggaagattggggaaggcagcacgatagggcactcactggcctcggagtccccggcgctggaggtgccttccccttgagtctcctctttgggggcccgtgcatccagggatcccgcggggtcggagctgggccggggaggcctgcgcagccgggcctcatcctcgtcctcttggggggcgctgaagcggctgggctccagcagcgccgagaaacggcggcgggcgcccaaagggggactggcctctccctccaggaaactggcctcggacgcggagaatcgcttgctgcatggagggggcgtggttatggaagacacgcccccttcgaccccgcccccaaactccgccattcccctgctcacatctccggagagccccctctccaggtcttctcacgcagggtcaggccgcccagcccctcccgcttgccggccaccttctcctcggggcccttggtgctcggctcccgcttgctgctccctgcagctgctactggggtcttgggctcgtgctgcgacagctgctccat

SEQ ID NO: 90952 - DNA, 1130 bp, Homo sapiens
gcctccgagtagctgagaccacaggtgtgtgccaccaaacccaactagttttttaagttttttgtagagatggggtctctctatgttgcccctaatcttgactcctgggctcaagtgatccttctgcctcagcctcccaaagtgctgtgattacaggtgtgactcatcccagcccctctttttttgtttgtttgtttgtttgtttgtttgagatggagtctcactctgttgcccaggttggagtgcagtggcacaatcttggctcactgcaacatccacctcccgggttcaagggattcttctgcctcagcttcctaagtagctgggactgcaggcgagcgccaccatgccaggctaatttttgtatttttagtagagatggggtttcaccatattggccaggctggtctcaaactcctgacctcgtgatctgcccgcctcggcctcccaaagtgctggggttacaggcgtgagccaccgcgcccagcccgcagcccctcttaattgtcctcttccctttgcttgttggtcatttgttcccgccacctttcccgtgctcttcccttctccatcctcatctgtgcccctcccgcctaagttccacccactgctcaaagaccaggctgtttacggctgtgcccacctctcctggccctccttggcggagggtcgcttgttcctccgagccattttagccttgtagctgctgcgccttgcgggaccaatgcggatagaggtattttcgaagggcgttgtggtcactgctaccttgttgccactctgggggaagaatgcgggaaaatgctctgctaggggctgctcaggcctcccccaccctccgcccagggtgcctccttccctgcactcaccttaaggatcagctccacgacctcaggatgcaccatgccatgcacaggctccccattcacgtgggtgatgaggtccccagcacagagtcctgcctcctgggctgggcctccttcctccacatgctgggaaaagagcaccccatagggacagggttagtgggattggtaacaaggaaagctcctaaacttatatgcaggacacttagctctgcatgcattagaatcctcataacaccttgtgaaatagttattattcctccc

SEQ ID NO: 90953 - DNA, 1755 bp, Homo sapiens
gcgtggtgcgctcctccaccacctccaacacccagcgctcccggccccggggggcctcgggcacggaaggcgccaggggtgcgggttcctgcaaccccttggagtccgcgcccagaggctgaggcaccacagccttagccccgggccgcgcaggctctacgacaatgggtaccaggggtgtgcccgcctcgccagagctgctgcgccggcctgtctcgtgttcctgcaccgggctcagcgccgccttggccacagccctggccatcccgccagtgccatcctccgtctgcacgctctgatgccgcgtgcagccgacgtcccgctccagggtccggccaccgggggtcgtcgcgcggggtggggtgcacgcctcggcgccccccggggattccttctccttgctcgacactggtggcctggaggcaccctcgggcagcaacgggtccgcgcccaggctcaaaggtgactcctgtcggcccaggcggcggacggcgacctgccggggcgcgccaaggccctcgactgggggcgtctcaccgtcggactcggcaaggctatgcagcgccagctcgccatggaagtccttgcggaaatccgggtggcccacctcgaggctgtgtttgcgcagcgcgcccttcttgtccgcactcaaagaggctcccagcttctcggccgactgcacgcgcttgaggagcggcgagcgagggggctcggcactcttggggcgcgggcgcacgacgggaggcgatgagtgcagtttggccgggaagctctgagtagtgtgcgagctgcccaccgtgtggcccggcagtggcggcggtgacgcctgcgtgggggacggcgtgtgtgccagcggcgatagagggatgttgccggccgacttgcatcgcgcagagcggtactggcgatggagctttggcgacagtccgtgcagcgtgctgggccgaatgtggtgcgacgccgacgacgcaggcgagttgggcgtgctcgaggctggggagctgctctgggatgaggcgcctgcgggagacaggaggtgaagcgagtgagtacagcccaagcaccagccaggccaccccgcgctgctcggtccccgcgcaggtgcaggaggtaatacctaggtaggcggagtcaggcgtggagcggtagctgtgcgtgggcgagcgcgccggcagcccgtgcgtaggcgagcccgggagactatcgctggatgacagcgagcggttcagcgacgacagcgagcggctagtatgcagcaggttcgactgcttcgtgatcttccggaagagggagctgcgcttcttgctgcgggacagggagggggccaagcgtccttgacctggacgccagagctcagggctcctcccatttcacggcctcacaacggtaaccacccaccccttctggcccttccctctccagctacaacccacctatcaagataaagaacttcctttagctcagtgctgcttggctcctcccacttcagtccccacccaccccctttggccactcctagtccaagctagaaacaagcatccaaacaaaaccaacctgttctgccccgcccacctctctagctcctccctcttccactacaatccacctatcaagatagaacttcctttagctcctcctacttcaggccccgcccaactttaggccactcccaattctggctacaaacactcatccaaacaaaaccatttttttttttttttttgagacgaagtttcgctcttgtcgcccaggctg

SEQ ID NO: 90954 - DNA, 1492 bp, Homo sapiens
ctcaaaaaaaaaaaaaaaaaaaaaaaaaaaaaaagaggaagaacaaaggtcccaagagttggacccaggttgtagggctggaataaaaaataaaatacaaacttgtgcctgatccagaaacccgggcgggagttgggtcagacagaagagcgtgggctgggattagctaccacgaaaaggaacggtggccaggctccaggagacgctggagcgccgggcccgtcgtgggcgtggtctgggcagactcagcgttgccttttgcctctccaaaacgcagcatcgcgtctcgggggaggagtctgtaccctcgtgatgtccccgccccggttcccaggcaagtttagggaagtgaaaggcgccaggtgccagtcctggcctctgatgtaacccagcgccccgcagtcccgacacagattcctggatctcagccccatagcagctatgatcccgctgctgctggcagcgctgctgtgcgtccccgccggggccctgacctgctacggggactccgggcagcctgtagactggtgagtgcgcagcggggggcctaccatcgccccggggtccggctgcggtcactcaaccgggatggctacctcctcggggaaccctggggtgccttctcttccctctctcctatttctgtgcattctccgacctccaggttcgtggtctacaagctgccagctcttagagggtccggggaggcggcgcagagagggctgcagtacaagtatctggacgagagctccggaggctggcgggacggcagggcactcatcaacagcccggagggggccgtgggccgaagcctgcagccgctgtaccggagcaacaccagccaggtgaagggggccccgggccaactaggggcgaaactctagggctgccctgcctgggaggaatttcacgttgcctccgtttatccgcccgcagctcgccttcctgctctacaatgaccaaccgcctcaacccagcaaggctcaggactcttccatgcgtgggcacacgaagggtgaggcctggattgggggctggggagagactcgggtcccatttttccaaggtaacccctgacgtgcatggggtggtcggggagatctgcactgtcagaccctgggcatctattccccccaacttttttttttctttgtttttgagacggtgggagttcgctctgtcacccaagctggagtgcagtggcacaatcttggctcactgcaatctctgcctctggggttgaagcaattctcctgtctcagcctcccaagtagctggtattaaaggcgcaccatcacaccaggctaattttcatatttttagtacagacgaggtttcaccatgttggccaggctggtctcgaactcctggtttctacctcaagtgatctacccgccttggcctcccaaagtgctgggattacaggaatgagccaccctgcccagccgagttcctatgcatttttccaagctaacccctgacctccatagtg

SEQ ID NO: 90955 - DNA, 1098 bp, Homo sapiens
aagactaaccctgtgtccaaagccaagtcaaatatcaagggttggggggttcagggtttgagggtccaggtgctgggtaaaaacagacattgggtctccaaagaaggagagacttgggggtcttccctcagttaactttcctggaaaaggcagaaagggtattctgggaagaagctgtgggaccccctgtccccctgattgaggctccacagccctccccctccccagtaaacagcaacaaccgtgctgatggcgggacttggcacgagctccccgccaagcattatcagacaccccagacgttggaggctgctatcaggtgggggcccaggccagctagagctctgtcctccggtgaaggggagggctgggagttgggtcttcaaattagcctggcgttcaatttgcctgggttgggacctcccagggtctcagccctgcagcaggaggaagcccctgacaactggcccaccattgtctactggggacccttgggtggcactgcatgggactgcatggaggctggttcagtgccagctgctttagtgcgatgggggcagccaagggaaaagtgaccctctctcctcctgggtgggataggaccgttggatcaagccacaggcagtacctgacctgcaggagaccagtgccctggctctgggcctggctgctccttgattctgcccaacatgaggagaggatctgagtttctacaacaggaacctccactctggtgccctgggagcctgggaaggggacatggatacgtattacagacacataactcatagtcactcattggaagactgaggcaggaggatcacttgacaccaggatttcaagaccagcctgggcaacataaaacctatctctccaacaaaaagctgtgagtggtggtgcatgcccatagtcccagctactcaggaggctgaggtgggaggattgcctgagcccaggaggtcgggactgcactgaactataatcacaccactgcagtccagcctggggcacagaaagcaagactctgtcgctggaaaaaaaaaaaagttgggtggccatctttattcctggcagatcaacctgggtgacacaaacaaa

SEQ ID NO: 90956 - DNA, 1036 bp, Homo sapiens
cagggtcagaggcactaaggcagtgagtgcgctgtgcctgcggggccggagaaaagtcacctgatcagtctcgcttgcagctcgcactagccggggggcgacatgggtgttggggggtagggctgatgagggtccgagaagggagggcacagtgatcttgcggactggaccgaggcgaattccccttcccagcctcgcgtcccgagtttgactggcaggacccgctggtgctggaggagcagctgaccacagatgagatcctcatcagggacaccttccgcacctactgccaggagagactcatgcctcgcatcctgttggccaatcgcaacgaaggtgggcgggctggtgggtgccctgagactgctcctccgcctggagccatagccaccccacctcaaggcccctctgtccttggggctggggcttcctgtggcctaggcctgggcctgaatttgggcactggtccctttgcagtttttcatcgggagatcatttcggagatgggggagttgggtgtgctgggccccaccatcaaaggtaggaacaagtatctctccacacactgcagaaccctctgtattctgaaagcctcttcctccttccctccctccctttcttccttccttctctttcttttcttttccttttctttcctttcttcttcccccccaacagagtctggctctgttgcccaggctggagtgcagtggcacgatcttggctcactgcaaattctgcctcccaggctcaagcgattctcctgcctccacccctctagtagctgggattacaggtatgtgccaccatgcctggctaatttttgtatttttagtagagacagggtttcactgtgttggccaggctggtctcaaactcctgacctcaggtgatccgcccacctcagcctcctaaagtgctgggattacaggcatgagccaccacgttcagccttctttttgagatggagtttcgctcttgttgtccaggctggagtgcagtgatgcaatcttggctcactgcagcctccacctcc

SEQ ID NO: 90957 - DNA, 1539 bp, Homo sapiens
gggcctggtggaaggaagacagtctctgaggtctggaactcaagggtggggctgtcccctgagcctattctgtccctatctcaaagatagcataagtggccacctggacccccgccagaccctgggcttcacctggagatctgatccctggccagcctgactgtccccctctgtgaccaccgtcatctccctatgctttctgtgttccccagtccagcccaaagtttaaagtccaccaggttcctgctggccatttgcagtggctcacacctataatcccagcactttgggagggtgaagtgagaagatcccttgagcccaagagttcgaaaccagcctgggcaacgtaaggagaccccatgtctattagaaaaacaaaaaaaggaaagagcctatgtgacctgcgctaagtggacgttggccctcttccgtggtgtctcggaggtgttcagctgcttcaagatgaagctgaacatctccttcccagccactggctgccagaaactcattgaagtggacgatgaacgcaaactttgtactttttatgagaagcgtatggccacagaagttgctgttgacgctctgggtgaagaatggaagggttacgtggtcggaatcagtggtgggaacaataaacaaggtttccccttgaaacagggtgtcttgacccatggccgtgtccacttgctactgagtaaggggcattcctattacagaccaaggagaactggagaaagaaagagaagatcagttcatggttgcatcgtggatgccaatctgagtgttctcaacttggttattgtaaaaaaaaggagagaagggtattcctggactgactgagactatgatgcctcgtcacctggggcccagtacagctagcagaatccgtaaacttttcagtctctctaaagaaaatgatgtctgccagtatgttgtaaaaaagcccttaaacaaagaaggtaagaaacctaggaccaaagcacccaagattcagcgccttgtcactccacatgtcctgcagcacaaacagcggcgtattgctctgaagcagccgcatattaagaaaaataaagaagaggctgcagaatatgctaaacttttggccaagagaatgaaggaggctaagaagcaccagggacaaatcgtgaagagacgcagactgtcctctctgcgagcttccacttctaagtctgaatccagtcagaaataagattttttgagtaacaaataagatcagattcgcaaaaaaaaaaaaaaacccacaaggccctgtgtgaccaggcctctgctgacctttccacctcatctctggccactcatgtgatcctcccagccagacttagctacttgaaattctccagaagtaccaccagttctttacacatctgttccctctcccagcactgctcttccccacagcctcctcctgcttaactcctcacacccttccagtttggccaactccttcctgattccctgggtccccctccccatcttggcattgtgatcatgactttggggtaacctgtctcttgaaag

SEQ ID NO: 90958 - DNA, 1012 bp, Homo sapiens
caaactggaagggtgtgaggagttaagcaggaggaggctgtggggaagagcagtgctgggagagggaacagatgtgtaaagaactggtggtacttctggagaatttcaagtagctaagtctggctgggaggatcacatgagtggccagagatgaggtggaaaggtcagcagaggcctggtcacacagggccttgtgggtttttttttttttttgcgaatctgatcttatttgttactcaaaaaatcttatttctgactggattcagacttagaagtggaagctcgcagagaggacagtctgcgtctcttcacgatttgtccctggtgcttcttagcctccttcattctcttggccaaaagtttagcatattctgcagcctcttctttatttttcttaatatgcggctgcttcagagcaatacgccgctgtttgtgctgcaggacatgtggagtgacaaggcgctgaatcttgggtgctttggtcctaggtttcttaccttctttgtttaagggcttttttacaacatactggcagacatcattttctttagagagactgaaaagtttacggattctgctagctgtactgggccccaggtgacgaggcatcatagtctcagtcagtccaggaatacccttctctccttttttttacaataaccaagttgagaacactcagattggcatccacgatgcaaccatgaactgatcttctctttctttctccagttctccttggtctgtaataggaatgccccttactcagtagcaagtggacacggccatgggtcaagacaccctgtttcaaggggaaaccttgtttattgttcccaccactgattccgaccacgtaacccttccattcttcacccagagcgtcaacagcaacttctgtggccatacgcttctcataaaaagtacaaagtttgcgttcatcgtccacttcaatgagtttctggcagccagtggctgggaaggagatgttcagcttcatcttgaagcagctgaacac

SEQ ID NO: 90959 - DNA, 1023 bp, Homo sapiens
actggccaggaaccagctgattcagaagaagctggcagacatgctcactgagattaccctgggccttcacgcctgcctgcagctcggccgcttgaaggaccaggacaagtaggggctgtgtggtgggggcggggggatggcagcggtggctggaggaccttgtgtccttcctggagagaaaggtccttcctgcctggtggccctggggacctgaaccttctgctgtccctcttgtccttgatgggctgggctgaggacagccccactggtccctcattgggagcttggctgcatcagggaatccccaccccgggctaggtttgcttggagcatcgggatgccaggatccccagtccttgttaccctcatgtgccactcccagggctgcccccgagatggtttctctgctgaagaggaataactgtgggaaagccctggacatcgcccgccaggcccgagacatgctgggggggaatgggatttctgacgagtatcacgtgatccggcacgccatgaacctggaggccgtgaacacctacgaaggtaggagctggacctcagagggctcactgaggcctcagtgtctggggagggggtacagggaggtgggacggggacaggtctgagtccaactccacctatcactaagtgacagtgtgacctggggcgagccttacccctctgtccctcatctggagttactcacatggggactgtggaagtgaagtgcttcatgcagcacacagaggccccatcaggccttgcgaggggctcccagctctttctcccacatgctcgggaggagggatgttcctgagacaggtaagctccgaaggcagcccaggggtgaggcccgactcctagcaggctggtggacgcaagggagtgagcgaagctacacgcaggaatcaacgctccattttgttaagagacaaaagtcatcttcagatgacggtgtttgcaccctgtaactgatggtgatttacatgggggtccagaaccccttgcttggtgggaagacag

SEQ ID NO: 90960 - DNA, 1008 bp, Homo sapiens
agtggtctcgatctcctgacctcgtgatccgcccgcctcggcctcccaaagtgttaggattacaggcgtgagccaccacacccgtcctagcttttatatttttaatagagatgggttttcaccatgttggccaggttggtcttgaactcctggcctcaagtaatccacccaccttggcctaccaaagtgctggggttacaggcatgagccaccgtgcccagcctattttgtcattttcataagataaattgcagaaatctaagaaacccacttaacacagatgtcttgtgatacctcttgtttgattttccgagaacacatcttattgtttaacaggtttcggatctgacagagaaattagaggagaggatctatcagatttataatgaccacaacaagatcatccaggaaaagctccaagagttcacccagaaaatggcaaagatcagccatttggagacagagctcaaacaagtctgccacagcgtggagactgtgtacaaagacctgtgtctccagcctgaggtatgagtaaactcacagggggggcgctgcctgaggaagaggacagggatggcccagccaagagtaaatgtgaacagaaaccaggcacccagccctgaccccgccaggccacagtccctgcaaagcccttggtgcactcaccatcttgtttgtgatcccctataacatggtgtgtctgagctgagaagccaaaccgttgtcatgtcccactgttgtatgagcagctctgtggtgacagaaaggacaaagtcccttgcacccctgccactcagaaatcatcccctctgcccacagccctggcacagaccggcactgctaacctgggtttcttttttacagcagagcctaagactcagatgggggccagaccactctaggggaaagtccccaccacgtcccggcaactcacagcccccagacgtgttcgtttcttctgtggctgaaactacttctcaggtggttaccagtaaaccggcctgacac

SEQ ID NO: 90961 - DNA, 1046 bp, Homo sapiens
ttttgtttgttaaagttaattggtgaatgcaggcccagggaagcctatgattcattagcatcctgattaatatgcagctgctgtgtattaagaaaaatgaaatcaaaagggataaatccccaaaggagaggttggaaaaataaagaagctctcagcagacatctgatgcaggcctttgtcctaccatgaaactcgaattagctgaattcaagtgatttttttttttttttactgtttgcttagctgccatgaaaaccggttccagcctcatcccttgagccttaaaaaggagcagctctgaaccattagcagctcaagcaggttgtgaacaatcacacaaaaagaaacacctggtgctctcatcgattttaattttagggtctgaaactgttgagagcatccaggagaggctgagacaacaaggtgaactgggtacgaggaggtgtgggagccccaatgtcagtgctgcattcatttagatattcagcaaactgatgaaacctttggggtgctgcaaaacaaatgagtagggtgtagtctgcaccctcaaggtgtcgtgcgctggaggggactgatgttcataaactttggcagctttgtgaccagcaaggcctaggtatagcggggggtagagaagcaaaagttccaaatgttccattatgaaggaggcaggaagggaaagtcattccaggcaaaggctgacatgtttggggaaattgtggtaggtccccaattgctgcagatggaggggctgtagaaaacagtaaggctagatcgggcttggtggctcacgcctgtaatcccagcactttgggaggccaaggcgggcagatcacgaggtcaggagttcgagaccagcctggctaacatggtgaaaccctgtctctactaaaaatacaaaagttagctgggtgcagtggtgggcacctgtaatcctagctacttgggaagctgaggcaggagaattgcttgaacccgggaggcagaggttgcagtgagccgagatcgtgccactgcactccagcctaggtgacagagcaagactc

SEQ ID NO: 90962 - DNA, 1041 bp, Homo sapiens
aactcctgacctcgtgatctgcccgccttggcctcccaaagtgctgggattacaggcgtgagccaccaagcccgatctagccttactgttttctacagcccctccatctgcagcaattggggacctaccacaatttccccaaacatgtcagcctttgcctggaatgactttcccttcctgcctccttcataatggaacatttggaacttttgcttctctaccccccgctatacctaggccttgctggtcacaaagctgccaaagtttatgaacatcagtcccctccagcgcacgacaccttgagggtgcagactacaccctactcatttgttttgcagcaccccaaaggtttcatcagtttgctgaatatctaaatgaatgcagcactgacattggggctcccacacctcctcgtacccagttcaccttgttgtctcagcctctcctggatgctctcaacagtttcagaccctaaaattaaaatcgatgagagcaccaggtgtttctttttgtgtgattgttcacaacctgcttgagctgctaatggttcagagctgctcctttttaaggctcaagggatgaggctggaaccggttttcatggcagctaagcaaacagtaaaaaaaaaaaaaaatcacttgaattcagctaattcgagtttcatggtaggacaaaggcctgcatcagatgtctgctgagagcttctttatttttccaacctctcctttggggatttatcccttttgatttcatttttcttaatacacagcagctgcatattaatcaggatgctaatgaatcataggcttccctgggcctgcattcaccaattaactttaacaaacaaaatgcgtggtgtcctctctgctggctttcccggttcctaggctggcttctgttgccgaaccctggaccgaggccagagaatgcaagtcagcccaacacagcacgtcgggtgtgcatggcctgcgcccggattgggcagcgggctgggggctgtgaacacagcgctgcgttcatctattatggtctgtccttcta

SEQ ID NO: 90963 - DNA, 1055 bp, Homo sapiens
ggaggcttttatggggggtgtggggggggtggcctttagcagggcagatggaggaagtgccttgtgccataagacacaggaaggggatgagggaggatgtttcccggccatgatgtactggggccagctcctaccggcttgaaagagccaattctacacatctcttcccaacttggcatttagcgtcttcatgttggtagcctgaaattggctaatggtgggaggctctgcaccacggaaattggcaaacactacgaatcagggcttcccccccatcacacagccagttgctaaatgcttacaagcacatcactgctgtctgctttccagcttgtggtggtttccggtaggtggtggcttctctggcagagacaagaacatgagttctgtgttgtccttgtttatctgagccactttcggtggccagggacatccacatgtccaggatacagttcaactttctgacccggaactcggggtggggtgagggtctggagatggttctgtgggagtcattgtttcagcagcagctgtggaatgaatgagctcacctggagaaggagtgagaggagggtcaggacagggccctgaggactctaggcagaaagcaagccagcttccctctcctcgcacattcctctgctggaaagcaggccacgcgtgaaatggtttataggtgtgtgctgtcaattggagaccaaaaaaaaagggaagcaatggttgaagtcgtttgtttgctaataccttactgcggaatagcatgtttagaccaggatctgtgtagtgaagagacacagaccgctgcaaatcatttagagacttcaaggagctccacaggaaccctgggccaaaaaacagatagattaaaaccagtgcaggggccagttaatagatccagcagcagatactcagcaacatgattaaaatgttaacacgtttccagagagaaaaggagaggttgaggaactggctcatcagcttccattcaaaccttcccccttcctggctgtacttcagcaaaacattgttttgcccaagcgccagagattctgttg

SEQ ID NO: 90964 - DNA, 1029 bp, Homo sapiens
cagcctgggcgacagaccaagatcttgtctcaaaaaaaaaaaaaaattgttatggagtatattttccaaggcagagtggatgaagttagaagcaccgaataaatacaggactctgagatccgtataacctgggcgccccgtggaacccaggagcctcacaggggcacacaagcgcacccagagcgcgccgtcctgctcccaaggggcgccgactgcgcgcgcagcccgcggaccgcgaaactgctgcttaacggtcggccccgcccagttggccgcgcaagttctcaaagagggcggggccgggagcacgcgtcacaacacactcgtccgcgggagcgcagctggccaggggcggggtcggcgcatgcgcagagggtgcgagcttgaaggcgggaaaatacggaatggagcgacagggagtacgcggcgcttgtttccttctcgcgcgtggggcgggcggacagataggcagggaacggctgcgatcccagccatctccagcggacccgagcccggccgcttgtcctttgccattggggctccctctcatcaggcctggcctcaaatttcctgactgactgaacccggccctgactgacgcactgacgggtctgatttccacacatggcgcgtggccggaacggagtagagaaaggcacaaacacccacgcaccgcacccgtttctttcatttctttttttttttttttttgagacgaagtatcactctgtcgcccagtctggagtgcagtggcgtgatctcggctcactgcaacctctgcctcccgggttcaagtgattctccttcctcagcctcccgagtagctgggattacaggcacgcaccaccacgtcagctaatttttgtatttttagtagagacggggtttcaccatattgctcaggctgttctcgcactcctgacctcgtgatccgcccgcctccgcctcccaaagtgctgggattacaggcgtgagccaccgcgcccggcctcatctcttttctcctacctcttctcctttctcgaagga

SEQ ID NO: 90965 - DNA, 1041 bp, Homo sapiens
gaggttgcagtaagcccagattgcaccaccgcactccagcctggacaacagtgagaccctgtctgaaaaaaaaaaaggggtgggaaatgctcgttgactgacctgatgttgctctgtcctgcccagatccagcggaggccctgcagctcccaatggactatgtccagcgggtcaagcggacccactctcagggcggctacggctcacaggggtgaggcaggacttacctggtatggaagggaaggaggctggggacccctgggccattgcatggacttcccaccttccctcctgaaggtacaagtataactggaagctggacgaggcccggaaaaacctactgcgaacccacaccacatcagccagcgcccgtgcgctctaccgccttgcccagaaggtgcggttggcccaggcgggggccccagtggggagagggtgctgtcaaagggaccttctgacccatacctgggcctggctcggttgtcacccctagaagcccttcactccggtcaagtacttctccatcgaccgcgtattccggaatgagaccctggacgccacgcacctggctgagttccaccagatcgagggcgtggtggcggatcatggtctcaccttgggccacctcatgggcgttctgcgggagttcttcaccaagctgggtgagcaggggggcaggggtgggccatggtggtgaggcagcgggcaggtgtgttgatcaccagcattatcctccaaacccctgctctcctgcccgccccccacttcctgcaggtatcacgcaactccgcttcaagccagcctacaacccatacacagagcccagcatggaggtgttcagctaccaccaaggtcagggtaggccctggtactggggtgggagggaggtctcaggctactatggtttggcctgggtccccccattgccatgcctgtaccccacctcccaagctcaccacctagacccagaacctgtaccagcagtgcccagaaactcaacacgcactgcccgtcttttctgtcctgcctctgcaggcctga

SEQ ID NO: 90966 - DNA, 7407 bp, Homo sapiens
gagctggctaagaaagccttgcccagcccctccacctagagggaatgggagggagagaagctgagggcagggtcccggtcccgcgtggagacagctgcgctcccgcggtttctttaaacgcccagatgggcaacgacgcgcgcggacgagggcggggttgggttcaggtctggtcacatgacctggcctgaggtgctcgcggcccccaccccaccagtgggcgtcccccccacgcgtggtcgaccatcattggtcggtggtgaggccaatagaaatcggccatctgggaacccagcgttccgaggcgcagcctaacatagtgaaccgacgaaggtccaatggaaaaagacggccatgggcatagaccaatgacaaagtggcaggggcgggcccaagggctgggtcaggttggtttgagaggcgggtgggtataaaagtgcaaggcgggcggcggcgtccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggaggtaacgcctggtcccgcctcgaggccgccccgacgacgcggccggcccccgatcctggatctgcgttgtcgcccgtaattaccgtttagaggtccaacacggtggcctcccgggactagagccgcgggcgatttctcttctgcgtccctggggagcgcggagggcgtagcggcctcccgcggcgggagttagggttagcccgaggatctctgaaggcacccgacgtgtcaaactagaggttggaatggggagtgtcggggatctcctttcctgtccccagcagcttgtggctctcggcagatgtttggtgtggggggggattagcacagccgctctgacctacccctctaatcccccacttagacgggtggacttcccgctggatcgaatccaaacacaagtcagattttggcaaattcgttctcagttccggcaagttctacggtgacgaggagaaagataaaggtaagagcctaggagtgggtgctcagatccgggaggacttcctggcagaagtccttgtctgtacacacacagccgggacagtccccttggaggaggacaggtggaggaagtgggggagtcttctctattctctaagtcgagggtcctcgcgagtcaaggcccaacggtgacctcactaccgtcccgtctcaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtgagggcctgcttcctggtgctgatctctgtcccattagttagagggagacccagaccccattgactttcttaataatgattttttttggaaggggagctaaaagaataagtcccagcaacaatttattgcattatgatcgcagatctaggctgttaatttaatttgcgtgtttgtatatagttatttcccaatcttactaatgaggattttgagttctagagcactgattttttttttttctcctttaaacttaaggctccacccacagcccattcaggacagaatcagggtctgagtttctcttctcagccttgacagacccgagttgaagaaccaggtcttccttttataaagaggggtgagagcctcgagatgatgggtagtctctgactcttaactggatctgcttcacacctaggtcccgacatctgtggccctggcaccaagaaggttcatgtcatcttcaactacaagggcaagaacgtgctgatcaacaaggacatccgttgcaaggtgtgcctgggggtggtggcaaatggctgtcatggggagattcagaggtcagcctcattggggggtggcccccgctcaccttcttccttcttcaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggttggtgtttgggcaggggctctgctctccacattggagggtgtggaagacatctgggccaactctgatctcttcatctaccccccaggactgggacaagcccgagcatatccctgaccctgatgctaagaagcccgaggactgggatgaagagatggacggagagtgggaacccccagtgattcagaaccctgagtacaaggtgagtttggggctctgagcagggctggggctcacagtggggagtgcaccaaccttactcacccttcggtttccttctcccttctgcagggtgagtggaagccccggcagatcgacaacccagattacaagggcacttggatccacccagaaattgacaaccccgagtattctcccgatcccagtatctatgcctatgataactttggcgtgctgggcctggacctctggcaggtgagacttggaggaaaaaggaggatccctggggtacctcaagtgcataagatcacccaagaggaaagggacagggtaggcaccccaggtgagtctgactcaaaaatggtacttcttgtaaacagtacttcctggtctgtccctgtgaagtcctcacagcaacccctttaaggttatacttgctgtgcaccaagtacttccccaagtacttttatgcaaatcaacttctttacccccaaagacctagaaggtggtcaggtaacccagttagttagctggggctgggcacagtggctcacccttacaatcacggtactttgggaggctgagacagaggattgcttgaggccaggagttacacaactcaacctagcttggcaacacagcgaggagaccctatctctacaaaaaaaatttttttttttgagacagagtttcactcttgttgctgaggctggagtgcaatggcacgatctcagctcactgcgccctccgtctcctggtttcaagcgattctcctgcctcagcctccggagtagctgggattacaggcatgtgctactatggatgccaggctaatttttttttttttttttttttttgagaccgtgccttgctctgtcgcccaggctggagtgcagtggtgtgatctctgctcactgcaagctccgcacgaccccccaggttcactccattcttctgcctcagggtcccgagtaactgggactacaggcaccccccaccatgcctggctaatttttttgtatttttttttttagtacagacatggtttcaccgtgttagccaggatggtctccatctcctgacctcatgaaccacccaccttggcctcccaaagtgctgggattacaggcgtgagccacctcacccagcctttttgtagagacagggcttcatgttgcccaggttggtctcgaactcctggcctcaggtcatctgcccgcctcggcctcccaaagtgctgggattacaagggttagccaccatgcctagcctctacaaaaactttaaaaattggcgagatgtcatgcatacctgtagtcccaactaccaaggaagaaggatgatcacttgagcctggggcatcgaggctgcagtgagccatgattatgtcactgcactccagcctcggtgacagagtgagaccctctcaaaaaaagttgggacttggccggacacagtggctcacacctgtaatcccagcactttgggaggccaaggcgggtggatcacaaggtcaggagatggagaccatcctggctaacatggtgaatgaaaccccatctctagtaaaaatacaaaaaatttgccaggtgtggtggtgggcgcctgtagtcccagctactcgggaggctgaggcaaaaggatgacgtgaacccgggaggcggagcttgcagtgagctgagatcatgccattgcactccagcctgggtgatagcgagactctgtcccaaaaaaaaaaaaaaatgctgggactgaatttttgtctgttttggtcactgaaataccttctgtgcccaagacagttctggcatgtagtaggtacctgaaaaatacctgaataagagagtgagaaacaagaaacaggtgcagagaactgaagtcagtggcccaaggtcatgggggtaggaaaccacaaagctggggtttgaacctgggcagtacagcacctgagtctctccatctttttttttttttttttttaagacagagtcttgctctgtcacccaggttggagtgcagtggcttgatctcggctcactgcagcctctgccttccaggttcaagtgattctcatgcctcatcctctcgagcagctggaattacaggcatgcgccacgacgctgggcttttttttttttgagatggaatttcactcttgttgcccaggctggagtgcaatgatgcaatctcggcggctcaccacaacctctgcatcccagattcaagcgattctcctgcctcggcctcctgagtagctgggattacagggatgcgccatcacagaccccgggctaattttttttagtagagacagagtttcactatgttgcccaggttggtctcgaactcctggcctcaagtgatccgttcgccatgacctcccaaagtgctgggattacaggcatgagcccgtcccgtccctggctgtctctccatctttccatcttttttttttttttttttttttttggagatggagtctcactctgtcacccaggctggagtgcagtggcacgatcttggctcactgcaagctccgcctcctgggttcacatcattctcctgtctcagcctcccaaatagctgggactacaggcacttgccaccacgcctggctgattttttgtatttttagtagagacggggtttcaccgtgttagccagggtggtctcgatctcctgacctcgtgatccgcccaccttggcctctgggcgaggattacaggcgtgatccacctcacctggcctctccatctttttaactgcagtgtcagcggtgttccttgtcttctctgcagatgcaggcagcagaatatagtggttataggaacacaggtggaaaccctgtccaaagcaagggctatcgggtatcacctctgaccatccttcccattcatcctccaggtcaagtctggcaccatctttgacaacttcctcatcaccaacgatgaggcatacgctgaggagtttggcaacgagacgtggggcgtaacaaaggtgaggcctggtcctggtcctgatgtcgggggcgggcagggctggcagggggcaaggccctgaggtgtgtgctctgcctgcaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctccctcctgtgtctccttctggggaaagacagacttaaggaaacccagcagtggtctttttggggggggggggggtttccagtatatctcctttttcagctattgctagagaggttgctgagtgttccacaagattccagggacccttatttaccccataaccctcaaaaccaacgggggaatggctgttgctgctgtaaatactccacatactaacttactgaatccttgaacctaactggtaagttttggttctgcttatttatttatttttaagatagactctcgctctgttgtccaggctggcgtacagtggctcaatctggttcaccctgccccttaaactggcctttttcatgcttctattcctttggggtcctgtggctcagcccaacccctctgggatgcctccaggactggtagatccaagggagaattctgtatttaatgtagtgaggctttgaaagttaacatctttaaatacttctggggtcagattaggtatagtacaacaaagtactcctgcccggagacccaagaatgaaaattgtaggttcattccaaaactccagatccctaaagaatgaatgaggctacaaaatggcaccttgcccccgcttccaacttaaggttttttttctgtgcttggtggcctttcaggtatttctagttttgagtaactttcactttgactgctctacaagggttcctgccaggatacccagaccagaataaaactcatttgggggccgggtacggtggttcacgcctgtaatcccagcactttgggaggccgaggcgggtggatcacctgaggtcaggagttttgagaccagcctggccaacacggtgaaacccaatacaaaaaattatccgggcgtggtggggggtgcctgtaatcccagttactcgggaggctgaggcaggagaattgcatgaacccggaaggcggaagctgcagtgagccgagatcgcgccactgcactccagcctgggtgacagagactgtttgaaagaaaaaattctcatttggaagaggcaaaatgaggtttttacagaagaaatacaa

SEQ ID NO: 90967 - DNA, 1035 bp, Homo sapiens
cctctacatccttcccgcctgcccccacctcaggcatgtcccatcccccacctgccgccagagaggacaagagcccatcagaggaatccgcccccacgacgtccccagagtctgtgtcagggtaaggcgggggcagcagtcccagcttgggccctgtcctcctagcacattccagcgtccacataagtggtcccacacacctggagggagggcaagccgccagaagccagggtccgatttctctctcttgaatttgcagctctgttccctcttcaggtagcagcgggcgagaggaagacgcggcctccacgctaggtgggtgggtggtccccagggcagaggtgactgggtgccccagccatcagctgggccttgtctgggtgcgggagggcctgggagctgccctttcctcttcctggtgacctaggctttgctgcttcctccacagtgacgggctctgagtatgagacgatgctgacggagatcatgtccatgggctatgagcgagagcgggtcgtggccgccctgagagccagctacaacaacccccaccgagccgtggagtatctgctcacggtgaggtggggcttccgcctcccggggaggccttgagggagtacccgggcgtcactgccctgatgggcggttgggaaggcaaaacctgccctgaaaagcctttgggtagtgattctagccactaaaggcttcccacaggaggctggatgtgagtgatgggtgggcctctggagggcagggccgaggcctcatctgtgtcctgccagggcatggaggagggtggcagcaggaggtctgtgcattagaactaaacaggacccctgacagggaattcctgggagccccgagccggaacacggttctgtccaggagagccaggtatcggagcagccggccacggaagcaggtgggtgtgcacatgccgcatctgccctccaggtacctgactcacattacactccaccccgcagtgctcctaggagcccggcgtggtgtctgactgcaccccttcctactacc

SEQ ID NO: 90968 - DNA, 1661 bp, Homo sapiens
gccaccgtgcccggcttatttcttggctcacttaaaagcacatcatcagctcttccagggtagggcttgtgtcgactgctatgttgtgtttggccagaacaggctcctctggatatttgcctgactgaatgaaaaagcaagggctgtgatgacctggggagaggaggggaccagggctgtgaattaccttcccttccccaccctctcctgcagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagagggtaagaggcctggctgaggggtgactgcaggtgggcaggacccctaccctctcctgctcacacttaacctatcttcccacagttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaactagccctatggtctgtgcctgctggggctccccgcgcccacctgtctgggtcttggggggctggctgggcacaggcaggcatggtgacgggtgcctggaagggggagaggagtctgtgagtccctgcagattgaggcttccggtgtctcctcccccagtgtgtcatttccaggcagtggaccccagcccaacgttacaaggactgcttctccccggcccccaccatcatcaccacagtctgttttggctatacttccccccccaccagccttgtaattggctaattactggagatgaatgttggtaaacagaagccttcttctcttctgccatctgcttctccattatttgcccattgtacaccccccttttcctcccactgaagccccagttagtcagcagggcctagagtccctgtccccttttgagtacagccaagtgggggattccccagctcttaagtattgggggaggaaccaggggacccagagaggca

SEQ ID NO: 90969 - DNA, 1085 bp, Homo sapiens
agtggaaccaagaccccacgctcaagcagccccttgcccaccaggctgccagcccggcctcccatgccaagcacgccagacatctgagcctgctcccccatggcttgggtgagacaccagcccctcagatttcacagcaccctgggagagaaaatgcctgtggatacgccggtgacatggctaggaaggggctggggcggctgcgagacccagggcgatggccggtgcttggctctgtgtgattgtaggcccaggttacgacagttccagtgtgccaggatggctggagaggggagtgggcatggtgtctccaggctgccagcccttcatggtgggcagggaaacccttcagctctgggcaggtggctgctgtcggctggtcagtggggtctggcctgcccctccctaacaatcacatctctgtttttacaaatctttctgcttccatggtttgccccgctggtctctgtttttatgacaacctctttcctttgctgtctttttctcggtctgtttttatcggtctctggtgtattctgcccttttccatctctctttctccatctctgtccttttgtatgtctctgactgtctctgtctctgattccagttttggccccatctctgctcccccctccactggcgtctcggactctctctctctctgtctctctggcctgcctctctctctttccctctctctctctcccttttctttttttcaaaccagaattggcttcgattttaaagtcaataaatgattgagcaggaacgagcttggagcagcggggccctggcggggaaaggtactgtgggcgagggggaagggcggggggaaaaatctccttctagaaaaagcatcgaaattcagggcggccgggtggggcggttcctggagctgctggagtccattgtagccacagtcctgagtctcaggcggagagaggggtggggggtggatggatggacccccatccccatcccaaccctgccaagaaacagagacacaaccaggatgtgaactcacgtacaccaccatcaccgccaagatggggatgtaagtgtcctgttcacaccgatgtcca

SEQ ID NO: 90970 - DNA, 1007 bp, Homo sapiens
ctatttagtgagtggagacccaggatgctgctcagtcccctacaatggaacccctcaaccctcgccgaccacaaagaatgatccagccccaaatgtcagtagtgccaaggttggaaaccctgccatgcatccccagatacacagtaacacacacaggcacagctaacccttgacactcattacacatgcacccacatacacagtcacacccaaacaagacgccagctgacagtgtcacacacacacactctccctcactaggacccaggcattgtcgcatatataccccatttcccctgccaaacccaggcacagtcggcgtgccatgtacacagtccagtgttaccccagcacacagggacgagagccacacccccacacatattcgcacctgggccacacctggcagtggttggaaatggtgcctgagagctgagacctgccctggtggcacctcccctctgcttgtcagccacaaccagctgtctttgcgcagcagctacagccaccccagcttctcaggatagaattgggagccccaaatccctgccctggtttgtagaagcctggggtgagacaaagcctggaaaaaccacatgcccatccctgcccaggacactcgcagtcttctagactccgtggtcgagggctccaccctcacctccttgctcctggcagccaccgagagaagggatggggacaaagctaggttctttttttttttttttttaaacagtctcactctgttgcccaggctagagtgtagtggtgcaatctcagctcactgcaaccttggcctcccaggctcaagcaattctcatgcctcagcctcccgagtagctgggattacagatgtgcactatcacacctggctaatttttgtatttttagtagagacagggtttctccatgttggccagactggtctcaaactcctggcctcaagtgatccgcccgcctcggcctcccaaagtgctgggattacaggcgtgagccactgtgcctgg

SEQ ID NO: 90971 - DNA, 1011 bp, Homo sapiens
ggagctttcgagcacaggtactcgagccctgcgccccaacggggagctccaggtgggtccgtgagcccgctctggtgcccacacacatggctccaggcccacgcgggtacacacctccccagcctgcacacgcgtgtttcacatgagtcacacacctgccaggccgctcagggcatctggcttcaaagcggcattcaggttgttgcgggagccggcagggaagggaggcctaattccacctcccccatccctctcggaacacccgcctccccatatgtccctggggcacaggtgggacatcccagaactgccgctgcccagtggcgcccctgcatgtgctatatttatatttgaaatttgtacctttatatatactttttatatgtaagaaccgctcccccctcttcccgctccacgtttgtacttggattttaccacccccactaggcttcgacccaaacctgcaaaaaccatttcgccaggcagggatgtagggggaggcgggagcagccctccccctctccactgcggacggacatcccacgttcttaaagaccggggaccccccctcccccaagggccggactgcagctccgaatcccgcagccccagaaacacaatcgcgggggtgggtgctggcggcgagacgttgctttttggtgtgtgtttgctgttaccgcttaaattaaccctgagtgacggcttgcaattcgccacaaagaggccatttaatgccccccaccaccccacctcgggagaaatttccacttgcccccgagtccagctcgggccgcacgctacccgccctccaggccttcgctccaggtgcgcccgggcggtggaggcgagttccctgcgcgcatcatggacttcaggagtgagggtgggtgggttttggaggggtgggagcagaggcaggggggtgtgccgggactccccagacgctccactgcccaatcatagctctttgatatcccagcccggctggagaaagttagatggtactccagc

SEQ ID NO: 90972 - DNA, 1029 bp, Homo sapiens
gcggccctatcggggcaggggtctactcttgctgagctagttaaggccctggctagagatggcctgtgaggactttagccacctttgagtagagctgcggtgtcccctgcccctggcttcagccttccctgctcctttcactgtgctggccagcggggagaaggagaacaccacttgagcagatcagtggggccctggctgcagctgccccggccgcaggcctggctcctgtgcctctgagcctgggtccagatttcccatgtctctgccttttgtcctggagctgagctgagcatgtcaggggccggcggtcgcggcattgtgggcctccggctgaggccgccagccgtaagatggctgccaaggtctaaaatggctgccagcagcgcccggagcagcgcccggaggcgcgtggcaggggctgcactcgcaccggatccttgctcccacttgctcctttacacagagctaatagtaataacagcaataacgttttggggctgtgtcctgatttagaaggatttcctgtctgtcgcgctctcctggagccctatttgtctctgcctcagtcgctggcccacctccatctctttgtcgggttccctctcggctgtccctgggctgggtacgcgcatgcgcatccacacgcgtgtgcacgggcacatgacttgccatctccacttggtctttcgcagtgggtaggggccgctcccatggggtggactgtgaagcttcctccttcttcccctgattccactgatccagctctggagggcttggtggggaccaagttgtccctaggatgagtggggttcatagcagagagacccctgggcagcagagtggggaccacgtgaccctcgctgagctctgcacatgggtcctgaggttgtgcccttcctgagccatgatttagagcaaccacaggactggggtctgaggaggccctggggtgggctgcctgctccgtagacctcttggctgtcactcccggactggctggggctcaaatcagacccagaaacccag

SEQ ID NO: 90973 - DNA, 1031 bp, Homo sapiens
ggccttccaccttcagcgtctcggcaaagcgtcaggagtccccagcggccggtgagcagggaggaaggagaagaaggggagtcccagggttttcctccctccccaccaaccacccctctctgtttagggccaagttctctgcagcctgtggtccccctgtgacccccgagtgtgaacactgtgggcaacgacaccaggtagggctaggccaggggaggcaaaggagcaagagggtcttgaaggtcatagtccctgctcacctgtccccggtgcgcccccagcttggtggccccatgtgggcagagcccatccatgacctggattttgtgggccgtgtcctggaggctgtgagcgctaaccccggccgcttccacacctcggagcggatccgaggggtcctgagcgtcatcactgaggtgagagccgggctgtgacggggaagggggctccacctgtgcccgtccatctccactcatgcccatcctgtcccccatcgcaggagctcccggacgtgcctctgtactacaccctggaccagctgagcagcaccatccactgcaacacaccaagcctcctgcagttgcggtaagagcccctggggtcgggaggagcctgtcccagaccacagggtggcctggggcaagtccagggattctcatgcatagaacttgcgagggggtggggagaacccggtgcactgtctcattcctgtaatcccagtaccttgggaggctgaggcaggaagatcacttgaggccaacctgggcaacgtagtaagaccctatctctaacaaataaataaataaatatatatgtacacacacatacatatacacacacatacatacgtatgtatacacacacacacacacacacacacccattagcctggcatggtgatacatgcctatagtcctaactactcaggaggctgaggtgggaggatcatttgggccaggagtttgatgctaaagtgagctatgatcatgccactccagcctgggtgacaaaatgagaccctgtctctttaa

SEQ ID NO: 90974 - DNA, 1018 bp, Homo sapiens
acacttgtaatctcagcactttgggaggccgaggtggatggatcacttgaggtcaggagtttgagaccagcctggccaacatgttgaaaccccatctctactaaaaatacaaaaattagctgggcgtggtggcacatgtctgtagtcccagctactctactcgggaggctgaggcgcgagaattgcttgaactggggaagcggaggttgcagggagccgagatcacaacactgcactccagctggctgacagagcaagactccgactcaaaaataaaataaataaataaataaatgactgagccaggacttgaacttgggaatctggccccggagttcagacccaaaccactgtgctgtacgagttaatatgtgtaggggacagagaaggtacctggcgtgggaggctgaggacctggccctctttgcacccaggatgctgatgtaccagcaccagagggtgtcggagaggtttgacgtcatcgatctggacccctatggcagcccagccaccttcctggatgcagctgtgcaggctgtgagtgaaggaggtgaggtggggatggcactggggtgggagcagggcttggggtgttggagggttctcactgcccagcccctctctgcagggttgctgtgtgtgacctgcacagacatggcggtgttggcggggaacagcggggagacgtgctacagcaagtacggggccatggccctcaagagccgggcctgccacgagatggtgaggggccctctgccagccagccagggagaccgggggacaggtggttgtctgagtcccttcccaatacactttccccctcctcagacctgctcagcttcctccaggctgatggccagatgcatcccaggctgttaacgacaggcgtgtcttcaacccacatagttcctaagagcatggctgataatcatggtcatttggggacagtggctttggccaggacaggagtgcatggccacattattttagttttctgtattaaaacaacttttcaaaa

SEQ ID NO: 90975 - DNA, 1638 bp, Homo sapiens
gtccctacctcatagatatgtaggacatccccgggcccggaatgcggctctctgaccctctctgtgccctcccccgccccccgaaccaggcttggcgggcggaggcgccagcggatgtctcatgcaaggatcgtctctgtggctaagcctcactttccgctccgcccgggtgctctctagagcccggtttttcgagtggcagtctccagggctgccgaatacagcagcgatggagaacggcaccgggccctacggagaagaacgtccacgtgaagtccaggagacgacagtcaccgagggggctgccaaaatcgcctttcccagtgccaacgaggtcttttataacccggtgcaggaattcaatcgggacctgacgtgagcaggggtcagacgttagcctggcatcggctagtgggtcagtgtggatggcgggggcggggtatgagctagtcctctgtctcccaccagatgtgctgtgatcaccgagtttgctcgcattcagcttggggccaaaggaatccagagtgagtggaggtccaggcttctggtgggcgggggtcacacaagtttatctccctgcctgggctcttctgccgcccaaatccagaggggcttcagccacatagcaggccctgggttctgctccttcagcctttccgcagggatttcagggacgatattttggagattaaggggaggtttctcagaggggaccttgttattctctgacttgtgcctctgggtggctgcagtcaaggttccaggagagaaggacacgcaaaaagtggtcgtggacttgtcagagcaagaggaggaaaaggttgaactgaaagagagtgaaaacctggcctcaggagaccaacctcgcacagcggccgtgggggagatctgtgaggtggggcctgagcataggagctggcagccctggaatttagcgggagacagagggctcctggagggggagagctataggaggtgggtggtgggggctccttggggcccagaagaggatggaggtggagatgtgagggaggttttctgcttactccaacaggaaggcctgcatgtgctggaaggcctggcagcttcaggcctacgttccattcgatttgccctagaggtgcctgggctcagatctgtggttgcaaacgatgcctccacccgggctgtggatctcatacgccggaatgtccagctcaatgacgtggcccacctggtacagccgagccaagcagatgcccggtaggttctgggcatcacagcctagctctgggacaagcctgcctggggtcaaattctggctctgtcacattctcactctgtgaccttgagtgagtgacttagcctctttgagccccagtttccttgtctgtcaactgagaaaattagttttacaggggttgctgtgatgagtaatagataattatggtatgatccatactctgtgccagaaataagtagcatcctggtctctgttttaacttcttacactccttttattcattcaaatgagccatagtatatccagtgtctgctatgtgtcaggcaccgttttcaagaactggaaatgcatcaggaaacaaaacatgcaaaattggtgaccttcgcaagagttggcaaactatagcctgtggggct

SEQ ID NO: 90976 - DNA, 1004 bp, Homo sapiens
cagagccttttgggctaggctaggggggatgtgggggcaggtcaggaaaagctggtgtgaccagaaggtatatactaagatgcgccccccaccgcccccaactcaagtgttaaggggttccgtctttctcacacctcatccctgaagcctctagagtcctgaccctaccccttgggcaagcctctgccaactgttcaaaggcactggccagtgggtgtttgtgtgggcagctggagacagtctggaacacctagcttaggcatcttgtttatcacaaggtggcccttgcccacccccaccttatatatctacagggaggcagcccagcagacgttacctgggtattttaggatcctgcattctttctctaccttttgtggccagaagctggtggttcaagcctagtggatgggacctcacagcaaccatcgtatatattagtaccatggcctcccaggcaccaactccttgagcctgagttctgtgtgccatctccctgggggtgaagaattagagggaatgagcatgtaaaactctgttgatggtggtttggaggctcccgacggggtgaaggcagggcacagagaagagttaaggggatcaaatcaggcactcacaccctggcccagggatctacctctgggacactcgtcctgggccaggccctgtgccgagctcgctggtcggatgagctcattgatggctcaccaccaccagttcaacttaggccttctctggggtccagacgaggaagctgaggctcggggtggtgtggcttgtctcagatcacatgagcagacagtggctgaactgggattgtctgaccctcagcccaaacccatagtcactcaagtggccttccaggagggtgactgaaggagctcctcgttctggattccctggcgggcgttctcctccgtccaggccttcccttctgctcaccccgggggatgggtcaatcccctttgggacagactgagtttccatggtgtccccggggaatg

SEQ ID NO: 90977 - DNA, 1558 bp, Homo sapiens
ggtggggaatctccactgtctggttatcatgaggtttgcgggagaggttggcgtctggggtgtgagtggacagtgctgtgaaggctctggggaaaaccccagcgatcactgcctgttaatcccatgaaatgtgcgaggtctgggagatggtgagaggcataagatgtcttctactcccagggagtttgcggcccagcacggggccaggggatacgactaacagcagctggcattcatgagcaccgactacggggcgagcgccgatcggcctgtgttctttggttgtttaatccttgaaatagccttgtgaggtggctgctgctgtcagcccattttctagatgggagactgatatggggggtgagcagtattgagggtaattctgagtgacaagctctataagggatttgagcctagtacaatagtaggattcaaaatcttaggtcctgcgtggttccctagcacagcccagcaggcccctctcccaggatgatccccatccctccaccctcctttgtgttagcggcaccagggtcacctcagggcctttgcacttactgttgttccctccacccttggttgccgccactgctgccctgtcttttgggtatgatctgattacacgcagggagtgggatgtaactccgaagggtgggcttatggttggagttggtggggagggagcgggcaggctgcgagctccatgaggacggaggcagagcttctgccaggctctccaaggagctggagctgctgcctgcaaagggaggccagattgccgagggctgcgaggaggagcgagtgggaggagggagaggcagcacgcggagactgctcattcccggagatggtggttgcagggagaaggggctagagaatagctgcagttgggaggattgggaaaggaagaatgaaaagaatgaagaaggccttccttggggattagagagagggcaccccagaccctgaggtggaggtcctcagacaggcagaagaccctgtttctggagaggacacatccagtagctcaggtaaagagccccagctctgggctcggccggtccggggttcccgtctggtctctgccttgcttctctgaacaccagttttcccacctgtgaaatgggtctagtcacagctgcctcacatttttgcctgattcgggagccagacggcctgggtataaacctgtgcctgccattcaccagctacatgttccccacctctggcttcacctctctgggcctcattcccatccatgaaatggcaggcaggctcatttcttcctcagaaactgtaaagaagagtaagttaaatgagcctgtctgagccctggccaggtatgggcccagtcagtgaggcttgagtaggggacactgttactaatcctattccaccatggatttaacaatagtcattcagggaaagagataacgaattaaatctgtgggtgtataagaaaaaaaatacaggccaggtgcagtggctcacgcctgtaatcccagctctttgggaggctgaggtgggcggatcacttgaggccaggagttttgagacc

SEQ ID NO: 90978 - DNA, 1815 bp, Homo sapiens
ttccatgccagtaccctgaagagataccatatatgtacctggtgcttgcaatagctggcactcagaggtagcacactgtgtcctagccactcttccgagcacttaagcatattcagttactcttcaagtacatatgaataagtatgcctttgccccctcctctttgcaagggatagcgtgtggccaccctggtctgcagctagcttagcagatttgaccacatattgtaaaagtgagtctgtaccaggacagatagggtagagggctctgtgtggtttagcaccatggtagattccatcgtgcggatgtccctccagcaggggaggtctttggggccagggctaggccagcacccacatttgccgcctgaccccgtccctccgtctctgtctctccattcctccctgcccctcgtgcagccgctgccatggcccagacactgcagatggagatcccgaacttcggcaacagcatcctggagtgcctcaatgaacagcggctgcagggcctgtactgtgacgtgtcagtggtggtcaagggccatgccttcaaggcccaccgggccgtgcttgctgccagcagctcctacttccgggacctgttcaacaacagccgcagcgccgtggtggagctgccggcggctgtgcagccccagtctttccagcagatcctcagcttctgctacacgggccggctgagcatgaacgtgggcgaccagttcctgctcatgtacacggctggcttcctgcagatccaggagatcatggagaagggcaccgagttcttcctcaaggtgagctccccgagctgcgactcccagggcctgcatgcggaggaggccccatcgtcggagccccagagccccgtggcgcagacatcgggctggccagcctgtagcaccccgctgcccctcgtgtcgcgggtgaagacggagcagcaggagtcggactccgtgcagtgcatgcccgtggccaagcggctgtgggacagtggccagaaggaggctgggggcggcggcaatggcagccgcaagatggccaagttctccacgccggacctggctgccaaccggcctcaccagcccccgccaccccaacaggctccggtggtggcagcagcccagcccgccgtggctgcgggagcagggcagccagccggtggggtggcagcagcagggggtgtggtgagtgggcccagcacgtcggagcggaccagcccaggcacctcaagcgcctacaccagcgacagccctggctcctaccacaatgaggaggacgaggaggaggatggtggcgaggagggcatggatgagcagtaccggcagatctgcaacatgtacaccatgtacagcatgatgaacgtcggccagacaggtgaggtgccgtcctgtcccccatcccaccagccacccctgctcctcctgccactcgcgtgccactctctccctgcagccgagaaggtggaggccctcccggagcaggtagcccccgagtcccgaaatcgcatccgggttcggcaagacctggcgtctctcccggctgaacttatcaaccagattgggaaccgctgccaccccaagctctacgacgagggcgacccctctgagaagctggagctggtgacaggtgggccggtctcgccccagatctctcccctccgcagctttggagccggctggcctgggctgggctgggcagctggttaggagcccccagcacctcagtttccctatctgtgctgtagtgttggtaacagccaccctaagggtgggggcgttggtgagatggaggagctgatacagcaaggcctggcctc

SEQ ID NO: 90979 - DNA, 1353 bp, Homo sapiens
tgggggctggggtaggcgaggccgtggggactacccattttatagctggggaaacaggctccgagaaattgcacaaccgacctcaggtggccggcagtggcgtgcctggtgccctttctcctcttccgcctctgttgctccctttggtcctctggggcctcagagaggcaggtcctaaaggagggggggtctcctgggggcagaccgagggtctcggaggatagaatgagaggtttccagggctggcagagtgtgtgcgtgtgtgtgtgcagaagttttgctttcaaacaaatgaagatacaagaggcagtaggacctgggttggaacccaggggagcagactggggggctgttgcccctccctccatctccccacacccaccccaccccacagcagggctcctggcccccacccccctgtacataatttttaaaacctttttttagcgaatgaaatattgaagtataagattccttttatttttcaaaccaatggggctgtgtctattgtccccctcggtccccaggggtggggggccttggaaggcagggcggtgttggggggctggggggcaggctgaatgtgtgtgtgtgggtgtgtatgtgtggagtgtgtgtgtgtgtttccatggtaggactccagtcccagctgctgcctaggctcctgtgggtcctgtgggtccccctcccctgttcaccttccccaacagggctatagtttaagggtgtcccaggccttggctggttggctgggcccagctcctgggggctgggcagggcagggcagggccgggtccacttccattgttagcagttgtttgcagaattttctcttttaccattcctctctttttgttctcgcccagagtgggtggttttttgttgttgttttagattttcatgtgaaggcagttttttttcttttttaactccccatccccctatgcagggtgtcatttcaccatccacatccacatccttgtttgtgtttctggccctcgtcctccctgcctctcatctgcctccccaacccccacctacccactgctcccaggggtctctccaggggcagggggattttaggagatggggtgggggccagcccctactggacccttgtaatctgatttggagaccatccccccgatgggaccagcagccccgccggcccactgggggtccctcttaacatctgcttgttgcgggggtcagtcatgagtgccagggtctggctggggtcttggcactgtcttcctggccggggcctgaaaccttagcccccagccggcctgagtgggggatattgacacccccagctaaagcacaagcaccttagtcacccctcctctcccc

SEQ ID NO: 90980 - DNA, 1069 bp, Homo sapiens
agggaccccaggaggtgccccctggctcccaggactgtgtgtgggtccggggggtgggggggtggggagaagggtcgggcagggggtgcaggggaggaaactcctcaccaggagagccaaagacagggttgtgccttaccccaggagccacccctgtaccccccttgccctgccattcaccctccacccctacccctgggcggcctgctgctttttccttctcttcctcccctgccctgagctgcatggttcccccaccctgggcagccaggaaggaatctgaatggagaatcaccaaccaccagagaaaaaagactgtggggccctcccctgccaactccccttccctggccgcccactcaacccacacctctttcacgcaggacaggctgcccaccctgtccacgtgaagtgccaacgccctccccaccctgggccgagcccccacccctccctgggcccccaagtgagattgcacatttaactactgtaaggagaggagcggcgttggcaaatgtgaaccatgagaatatcagtgatactgatgagaataaactaaacgcctttgtaacagccttgccgcatgctcgttacttgggggcccagggaggaacacacacctgcattgtgcccagcagacccaggttgctgactgcaaactgacagcctccgattctaacacgcatgcaagttaccccaacagatacagataacgcaacatatgagctggtcctacacacacacacacacacacaatttttttttctttttttttttttgagatggaatttcactctgtcgcccaggctagagtggcgcgatctcggctcactgcaacctctgcttcctgggttcaagccattctgccttagcccccccaaatagtggggattgcaggcacccaccaccatgcccggctaatttttgtatttttagtagagacagggtttcaccatgttggtcaggctgggctcgaactcctgacctcaggtgatccacccgccttggcctccccaagtgctgggattacaggtgtgagccaccgcgcccagcattttcttttcttttt

SEQ ID NO: 90981 - DNA, 1060 bp, Homo sapiens
taaaaaaggctgacattttatttccaggttggcacgtgtataaggcacaggggcaaatggctttggggtcctggaactggaaatggagacaggtgtgtctcaggtgtccctgcctccaccaccccctaagtgcacttgagacaggaccagtggtggtggttccagcccagggtcctgaagggtcccactggctctaggggagagccatggggacagctccccaggcgggaccctctactctccagctacccaggagggaccctctcctcctagggggcgaggccagctccaaagtgcttggtggctccccaggcttaagggaccagcctgccagggagggctggggtcagagagagaatagtaagatgagaacgaggagaagcacccccactagcacggcgatggcacaccactgtcggcggtctgggaacgagaaggtcaggggtcacggggagagggtaccacctacaacctgcccccaccaggactgacccctcccctgaggggactcaccactcgtcatgtgggatactttggccaacttcctgaggaccccgtccatgcgggactgggtgtggtccatctcttgggcgaaggcatccagcatgctgccaagaacaggatggcatcagccccagatggcccagacacaccagggtggccgagagcccctggcccacccccagggtcctggcctcacatgccctgctcgtccagctcttctccaacgcggccggacatgtgcttcagaacctggatgctcccagacaccatctccagctgttgatcctgttcatccatgatcagctgcagagcgaaggggtgggagatgctgttgaaaacgaccccagaaggccaggcgctatggcttatgactgtaatcccagcactctgggaggccgagacaggcggatcacttgaggccaggagttcgagaccagcctggccaacatggtgaaaccccatctctactaaaaatataaaaattggccaggcattgtggtgggcgcctgtaatcccagctactagggaggctgaggcaggagaatcactggaacct

SEQ ID NO: 90982 - DNA, 1105 bp, Homo sapiens
gtggccacaggggatgttcaggctggaaccagggtcttcccctgtgtgaagggaaacttgctgcccacgacccactggggcctccagacgggagcatgtgggtaggccgtgagctccacccccggcccccctcccttgggccaaggcgctgatgcatcggcggggctcagagaaaggagcccacccagaaagctcagcgtggagtcgggggacgctcctcctcgccagggttcccgtcccctttccctgctgggtaaatcgcattctgtctctttaaggagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcccgttgtccggagtgcacctgctgcctgttctgtccctcccgggagcccccgccgctgtcgccgtcgagtcgccatggaagtgcagaaagaggcacagcgcatcatgaccctgtcggtgtggaagatgtatcactcccgcatgcagcgcggtggcctgcggctgcaccggagtctgcagctgtcgctggtcatgcgcagcgcccgggagctctacctctcggccaaggtggaggccctcgagcccgaggtgtcgttgccggccgccctcccctctgaccctcgcctgcacccgccccgagaagccgagtccacggccgagacagcgacccccgacggtgagcacccgtttccggagccaatggacacgcaggaggcgccgacagccgaggagacctccgcctgctgtgccccgcgccccgccaaagtcagccgcaaacgacgcagcagcagcctgagcgacggcggggacgctggactggtcccgagcaagaaagcccgtctggaagaaaaggaagaagaggagggagcgtcatccgaagtcgccgatcgcctgcagccccctccggcgcaagcggagggcgcctttcccaacctggcccgcgtcctgcagaggcgcttctccggcctcctgaactgcagccccgcggcccctccgac

SEQ ID NO: 90983 - DNA, 1887 bp, Homo sapiens
agcgcccgcgaaaaccgtggagagaagccgccgcccgggctgctgagaggcccggagagggactctgtccccggggagccatcgccttcagtgtgcagggacggcaccgaggagtctgagccgggggcgcgggcgccttccgcagagacctgcgcccacaggtgctgtcttagtggactgggacgtgaacctttcgctctccttctggactgggagaagggaggcttgggtgttgtgttttttgttttgtttgtttgtttgtttttaaagatctcctcagggtcggacttcattttgtactgtgggctgtgctggccctttcaaggtttttcaagagttggttttgcgtttccaacctcggagaattccaggcactccccttccccctccgctgacatacttgtataagcggtcatcgttgcgtcatggggcaggcgtggggagcttcctgtcgccttgcgtgggtgtggggcctgggaggaggtcctggggcgtgcacccgccctgggcagtggggaggagagtggcctgagttacttcacccccgcgtgctgctggttaatgtcccgcgtctctgcaccttcgggtgggagcggggactgatctactttcacattctcaagtttttctcatctgcattagaggtgcccagtaggttcccaggttccagcgtgcccctccctcagacacacggacacaatcagccgagaagttcctggtctgaatcacgagaatgtggaggggtggggggtgtcagtggaaaggcataaggctgagctgagaccagttgctggtgaaactgggccaatctggggaggggaacatccttgccagggagtttctgagggtctgctttgtttacctttcgtgcggtggattctttttaactccgtctacctggcgttttgttagaaatgtcagataggaaaataaaaaccatttgagtaaaaaagccggtgctgtctggttttctgctgtggtgggggaggggcggggttaaagcgtcaggggctggcagccgctcgctggggccccaagaaccggtctgaccggttaccacgtgggcgagagagggttgggcccccttttccttgcccgggcattccctaactggtggagccccgcctcccccagatttgggggttcccttgaaattgtcctacaactccgggacagggagatcggggctttctgagttgagacaatagtgctaaacacactgccccaagcggagctggggatcgattgcacgcactttgaagccttgaaaggtggtagatctcgcccccaccccctagaccaaactgaatcagctgtggccggggccctacagtatcaggtggagctgagcgggtgagctttgaagggctctttagtccccagttcccgtatcttcctcgaggaatcgttgtgtgtctcaggcagggacgtgcagcctcagtttcctcatctgtgaaatgggcctctaagcagcttctccacccggcattaggtttttaaaaatgcccattagagccctagttattttcttgggtcactccccagctctagaataaccaccccgaaacgagaaagccctttcaatataccccacgtaggtttaagagtggggttgtgggcgttgccccagggcgaagggagggggcctgtcgggaagacaaaggagtcgcaggtgcggggagtggtggcggcggcaggcgccgggaaagcgctcgccccgccccgccgacggctggctctgccgccgcaggcttcccatgaccccaggggaactgaccccgtggccacagggtagaaggaggggcaagccggcctcagaacgtctgctggtggaatctgggagctttggctcccctcccgcccaacccacaccccctttcctctcct

SEQ ID NO: 90984 - DNA, 1062 bp, Homo sapiens
cccctgaaccgaggcaggtcagtgggttggggggagggggtagtacccaggttcctgcagctgctgcctggccccctctgtcccctctccatggaggcctctccctttcttcttccttagtgtctcctccgccctgccttctcctcccctctcctctcctctgttctgcttgtccctgagcaccacagggctgcccacctgtgtccacatcggtgtagcggcccagggagcgctcagaggcgcggtggctgcggtcgcggcgccgctggtggtgccgctggttctcctcgggcgggacccgctccagcgagtaatcgtccaggcgtcgggccttggggcccagcacggaggctgaacgcttcatggggctggtgtctgagatggtctgggggaggggacaggccggtgggctggggtcagcagctagcaccaagtggtcccggtccttcctgccccattgtggcagcctggtggtggccttcggtgactgcggtgtgaccatcctggggcaggggccaggggatgccatggggccttggctccccctgatcaatcagggctctgggtgtggccaggcctctgagggtggagcctgaggattcctctgtccctcagagacaggactgctccttttgagcccatcctgggttctgaccagaaagatctgatcctcactctccagtcctgggggcccagccacagttgggcaggctcaggctggccagagggaagccctctccacatccagggtgcaaacctgggagccctggactgccgcactcatccctgccccagcttgctctcctgggagggtgagaagcctccgactgtggctggctgacctatgggctcaggaccaggtgcccggcatggcagctttgggtcctcccggctaacggggctgtgctcgctgcccccacaagtctgagtccttctggtgaggcccaagctagggagctctgggtgggggtgggggatacccaggcactggaggctctgggggcccactcttttccctggtgcttcatccctgggtcaagccctgacacacaggtttctctg

SEQ ID NO: 90985 - DNA, 1043 bp, Homo sapiens
tgaagtaatctttttttactgaccttttcttccattttttttcctcctcttttccattgatttgaaatatctattttatcattctctgcatctttctctctctattttttcggctcgtgtggatttcttttttctttcttctgtttctccccacctctcttcctttggttctctgttcccattcccgttttgtttttttgtttttgtttttgtttttttcattttcggtgctgccaggggccgcatgccttacctggacatgtatcagatgctgagacacatgtctccgcccctgggtctggggaagaagtgtccggccagagtggcttacaaggtagactacccttgccgaccaccgacgtccaggcactgggtttttttttcttcttcttcttctttttttttagtgctgaccagaaacacccggccgactctctttttccaacgtttctcttcttttttgtttttgattcttttttttcttttctcgagtcaactgatcatgaccatcccttgattctaagcagcacactgtgtccgtcctttctgatgagtgtcttcgtgttttgagactccattatggccgacatgccggggggagggggaggggagcgcccaggtccccttgcacctggtctcccaggtaccaaattggaaacaaacacgcttcttcagggagtcaaaacccatgcttcccacttctgcccacccagagcggcccccatgcccaggctggggcaggcgccttgcagagaggggctttagcccccgaaagcaggcgaggtcccgggtccccgcccctgccacgcacacctgaagctgatctctgacctagggccttggggattcgagaccttccaaggagcaccaagaacctctcttcccctcccttccttcccctggagtttcgtccccagcccccgtccctaatccccccaagacaccccaacatgcctctccattgttccagagtgggcaggcggccgcagctggacccctggacggtggcacactgatgcaggccatgcacgctgccttggcgg

SEQ ID NO: 90986 - DNA, 1045 bp, Homo sapiens
cctcccaaagtgctgggattacaggcgtgatccaccgtgcccggccagtctttgtctctttgtatctctctctctccatctctctctgtttctctcttcctcttccccatctctccacttgatctctctctcactggacctccttgtgtgagtgagcatcacctctccattccccagtctctttctgtctctgtctcatttcctttccccatcttctctctatccctctctccatctgggcctctgtgtacatgtctttgggtctgtctgtccgtctgtctgtctgtatccttctcactcactcattcattccctcggtctctgcccccattctctcttggtccccggggtccccacagatgctgaatctctttgtcgccgtcatcatggacaactttgagtacctcacccgagactcctccatcctgggcccccaccacctggatgagtacgtgcgtgtctgggccgagtatgaccccgcagcttggtaagaagtcaccccgaatcctccagccacaatactcacctctccctggaactggaacacgggctaggtcaggccccagactctggagcactgaactcctggggtcctagcaggggtctcacaggttcagtcaggagagaagatataagaatcatcacccttgcataccccagattaaacacgtagggtgccaaccctgcccaaaccctggactttctgggaaatgagggagggcgtcaaccatgagatgtcctgaagagccctctcctcctacgagtctctcctgtctctcactgtgaagtctccagatggtgaggatgcattagccaggctccagggagaaaaccaacagcatcccagcctcagttctcttgagagtgtggggaggagggctggcctacccttggcagacaggattggcagcaacatcagagtagcagaactcagctcccactgggacccgtgaacctgggagtgagaggacatacaggccaggggaggacgcagagcctcaggggcccatgcatctttgtggccacaaagggagtgggcgctccc

SEQ ID NO: 90987 - DNA, 1024 bp, Homo sapiens
gtaacagagcaagaccctgtcaaaaaaaaaaaagagagagagagagaaaagaaaggaaaagaaagagagagagaaggaaaagaaaagaaaaaaacatatcagtgtcctcaaatcccaccctagaccaactgaatccaagtctgctggggtggggcacgggcattggtattttttcaaagctctctgtggacttcagtgcacagccaagaatgtgaattcccttctctcagctcccagtaaaaggaggtggtccacctggggcttgcctggccagctccagagcccaagtgctcaacgtgtgtgctccacctcctggggaggcgttggtacccagtcagggctgggtgtccgagtctctgatttctccctgtcctcaggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctggtgagtctgtggacactgtgagggccgtctgggctccctaagcctggcttcctttcaggggagtgggtttctgtggaatgtggctgtgtcgaaggcttgttccctccaaggcttctctgaaccagcctgggatcaggtgaccctgagcgtctcaaactcagcactgttgacatttgggggtggctgattctttggggtggggccatcatgtgcactgcagtgtatggcagcatccctgtcctccccccaccagatgctggcagcacacgccacccgttcctcctgttgtgacaaccaaaaatgtctccggacattgccaggtgcccccagggggtgggggtggggttgggagtgggggccagaattcccccatttgagactcaatgaaatatttcagctgggcgtagtggccgatgcctgtaatcccaacacttcgggaggctgaggtgggagggtcacttgagcccaggaatacaagaccagcctggacagcatg

SEQ ID NO: 90988 - DNA, 1401 bp, Homo sapiens
ttcgtctcagtgcatttggttgttgggagaaacaaaaaccatctcgatttttttcctgattggatgattcggatatattttctttttcttgttcttttgttatttcttccccatccccgttcctttttcctcctttctttttcttttcttttccccattgtgggtggggctggcagggagggcttatgcttttgagttgatgccttttcctccctcccaccctctctctcccaacattattcctttttcgagtttttcctctgcatcattgcattaatagtgctttctctctccctccttatttggggtctggcttgcttttttcctgttggttggcttcatgtaggggcctctgtgagtggtgacagctctgagccttttggggtgggtggatggtcacccctcttcctccatctccccagaataacttcatcaacctgagctttctccgcctcttccgagctgcccggctcatcaaacttctccgtcagggttacaccatccgcattcttctctggacctttgtgcagtccttcaaggtgagtcctcgtccctgctgctggcccagggctgagaagacaggtgaccctcatgctctggctgaatgtagaagtcagattggaagtgcctctgtgatgtagtcgtgcagagaatctgttatctccaaggctgttgtcaaacttcctgtccctggtgtgtcttcagagctgtaagggcctcatcctagagcccccagagatgcccaccagccctggaaggactctggcacgtggcatatggccacccaacccagtggggcagagcactgggacaagggaggaagacagtgcggctgagggacccccagcactcttcttcattgccttttttcccaccaggccctgccttatgtctgtctgctgatcgccatgctcttcttcatctatgccatcattgggatgcaggtgagtgtcgtgtccctaaggttcccagagcctcccaaggagggcagccacccttagaaaggggtgggtcagaggagcctggttcacagaagcagccatggaggttgagctgggtttcccagaagccactggaggaatggcagcccctggtcgtcaccctccaattccacaggtgtttggtaacattggcatcgacgtggaggacgaggacagtgatgaagatgagttccaaatcactgagcacaataacttccggaccttcttccaggccctcatgcttctcttccggtgagaaggggacctgctctgataattctgtttccgtggggtggggtgcctgccttcatccttctgttcccatagaggatgtaccctcctcttccaatgcaagacgtgccctcctccttctcttctggcaggggcgcgccctcacccttcttttccggtagggggcgtg

SEQ ID NO: 90989 - DNA, 1084 bp, Homo sapiens
ctcttaccacatacagtcaggtgggggaggcaggcatcggtcaaataaccccttgactccacttaaaattatacctgcactgcgagctgaaggatgagcagcattaacaaggcagagagagatgcacagagcattccaggcccaggacagcacatgcaaaggccctgtggtgggacggaacctgtgaggggtcaggatctgcaagcgagggaatgtggctgatgcaaagacagccgagaaaggctggcctggagacagccgaagaaggcagaaggggacaggacccggggctggggagggcggggctatattgtggaatatgggctttctcctaagcaccaggaagggcctgggaggataggaagcaggggaggcgcgactggtcatgtgactagacaagctcgctctggttgcagggcagggaacagcttgacaggaggctgggctggaggtgggcaccaggaatcgcagcaagagatgacagtggaggagagagaacagtgggagggttgtcctctgcaggacccagggaaagatcaggtctgaactgagatgaggtgcctgggagcagtcgggtctggcttaaaactgggagataggctgagcacggtgactcaagcctctaatcccagcactttgggaggctgaggcaggaagatcacctgaggtcaggagttcgagaccagcctgaccaacatggtgaaaccccatctctcctaaaaaatacaaaaattagccaggcgtggtggcaggtgcctgtaatcccagatcctcaggaggccgagacaggagaatcacttaaacctgggaggtggaggttgcagtgagccgaggtcgtgccattgcactccagcctgggcaacagagtgagactctcttaaaaaaaaaatactgggtgatagaggtgagcgagtgcaaggaaaggaccaggttgggggaagagaataggtgtgggcatagcaagtttgaggtgcctttaggacatcccgaaataagtcagataggcaggtgttgtgggggctgcagcttggagctgaggtctacaagtagtaggacttttctggagcccttaggtgggtggtct

SEQ ID NO: 90990 - DNA, 1006 bp, Homo sapiens
gattctcaggaggcgagaggttgtagtaagccaagattgtgccactgccctccagcctgggcgacagagtgaaactctgtctcaaaaagaaaaggaagaaaaagaaagaaagaaacgtgaagtgcttggcacagaacctgccaggaaaccaggagtttgaaaatggtggttgttaactattactgctgttgttattgttattgtgaatgggtgtgtagttttgttagccagccctgagttacagtcaatttgagggaaagatagggggtgggtgtttgggtccttctgggacaattaactcccaacctggagtagggagaggcatgtcctggcaggcaaggaggtctcagttgcccctttctgcctcccaggtaagcccactagttctgaggccagggcttggccaggctgagacaggaaatgccagatgcttgggcgggcaggtccctggggtttagggggcagagggcatgcggcagtactaaccagtgctgtctcagctgctgcccccaagtggctggggtgatgtgggtttgccctgtgtgcaatggataatgactgtgtttcttgtcttgtctcttttcatgcctgctcttaaaactgtatattggcgcaacgccgtctgaaaaactcatccaatcaaaatgcactatgaaattcatttgttcatccatgacatggtctgtgtgttcatacaccaatgacttatctcccaacccaccgccaccaccacccccactccccgcccgggaaccgaaacccattggttttttggcactggttacaaatcaacctaaaaaatgctgaacacgcctccccaactgcccccgcccgcccgctccccctcatcttcaacatctgcatctagaatccggttggtcttacttctttctgaagtctaaatgccttacattaactgtgaacgcatctcctcgcgtcggcattgcatgccacaccctgcctctccaacgtgggatgcctgacgctctcctcaaccctccgctct

SEQ ID NO: 90991 - DNA, 1038 bp, Homo sapiens
tcataatttcaataactaactttttggagcccctatcatgagccaggcataaattaagtcttgggtctcatgattttgtgaagtaagcactagtattacggctattttacagatgagggcaccaaggcacagaggggacaagtaacttgcccaaggtcacacagctaatttttaaaaagaaagaaagaaatctacttaacccatagattcacaatattgtttggccctgggacatttaatatcgaaaagcctttttatctcctacagaattaaggaccgtatttcttcaacctagcttggggatcaagatacttcaagagggtcgtttgggagtgataggaactttgctaaacagggcatgtgaatgtcttctctcaccgaggtcccctctgccttcttggggttccaggacccagagagggcccccacctggaggagtttaatagtttgttgtgtaggaggccttgggggttggagatctcagtagtggtaggtaacatgagattatggaagaaaagggtttgtgagcctgtggtctgagtggacctctgcacgcccatctgtctccaacagccttcgccgcctgtgccattacatcctgaacctgcgctactttgagatgtgcatcctcatggtcattgccatgagcagcatcgccctggccgccgaggaccctgtgcagcccaacgcacctcggaacaacgtgagtcccacagagcacaccccttcctagcctggctgctctgcctcaggccactttctcctgcatccaaaatgctcataggtagggtgggatgttggggtcacccctaggcatagcccttatggctgctggttgagaggggaagctctgattccttggggatgctcttgggagcaagacattccttgaggcagtttctctgtgagcctggtggggtggaggtggcccagagtgactggggctgaaaattgctggattctctaatggaggcgtgagactagcaggatatggatgttgcacattctctacatggaataggggggttactggggcag

SEQ ID NO: 90992 - DNA, 1045 bp, Homo sapiens
agcagtaatagtaagcactcaggaagtgtcagctaatactgttagtaatactctcatcaataaacataaaaagcaataaggacccagcttgcccaaatcccacagatggttcctgctccctctcttcttcagaggaagaaactatctccccactttcacccccatagcctcagctggccagacccccattctgaaccaggggagtactgctaattccattattaatagacacatcaaacaatctggccgggagagacattattcatttggctgataaagaggttctaaggctctttggaaataaaagttcatgaagattcatgcactttaagagaaaaaaattcaagatcagtcattcatctgctttaaaaaaagtggcaaagataaaactttatttgagaatataaaataataaaaagacattttcgttctctgttgtgacaaagccagtggccttcggaggtctgccttgtacatttttcctcttcttcagtcattccttgaggctttttgcaaacgtaccctgtgtttttcattctccagcatattgataattttttttttttgagacatggtctcgctttgtcatccaggccccggagtacagtggtacaatcatggctcactgcagccttgacttcctgagctcaggtgattctcccacctcagcctcccgagcagctgggactacaggtgtgcatgaccatgcctagctaatcttttgtattttttgtagacacagggttttgccacattgccaaggctggtctccaactcctgggttcaagcgatcctcccacctcagcctcccaaagtgctgggattacaggagcgagctaccttgccaggccgatcatatttttttcctttttattcactttgtcttctcctcattcctaccttcatctgtctttcagtggctcactccagtgaaaagtggactgacgcacattctatttcatataattcaatggctgctggccccagatcccccataccaggtggccgagcccagtggccctgcagggtggacaaaatgagggtg

SEQ ID NO: 90993 - DNA, 1005 bp, Homo sapiens
gaggctctgctttatcctgccctgtggtgtgactcccagaggcatcagatgtggctgggagtgggagacatggaaaattggctcctgcaacagagaactatcagccttcccatcaattggttacttctaattctgttatttttcaggggcactgtcttctcataagctccatctatgcaaaactaagcccatgggtcatgatggttccctcaggccagaggcttgctggagagactaatggatcccctggctaaaatctgtgcttgggctgcacattggttaatttcttctgaaggaacagcctgagcctgacattctccatcttttccctggcaggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttgtgagtatcacccagccccacccctgccaactccctgatccctccctcacaccctttttccacttctctttctctggtagtatgtgtatcttctttggtcctcattgaatctgccctttcctttagccatttctataactgtcactggggccaatgttactgttgctatgacaatggaacccatctcccttagacctgagagctggaagctggaattcagaccaacaaatgctcctgtgattcctttctaagagagagggacagaggggtgctggtgaaggggatgttggaagagagacagagaaagacggagctcataagatagacagatagaaacagaaacatacatgtattaataatttttatgtacatctctggaaatgttcataacttatggttaagagaggatgccttagaaataaggagtggcttatatgttgccctcattttctctactta

SEQ ID NO: 90994 - DNA, 1053 bp, Homo sapiens
aggcaggagaatcccttgaacctgggagtcggagattgtagtgaggtgagatcatgccattgcactccagcctgggtgacagaatgagactccgtctcaaaaaaaaaaaaaaaaaaaaattctagtggcaaggcaaagtgtttggaggggatacagaggaatagatgaaacaaaatttgccagaagtaaataggtaagtgtctaaattggtgataggtacatggtgaatcattatattgttttatacttctctctcgctctctctctccccccgttctctccctgtcttcctctcccctctgtcttcatatatatatatatatatatacacacacacacacacagacacctaataagtttttttaaaaaacaaatacatctaaattacccataggtcaaagaagaaataataatggaaattagaaaatattttacttgaacaataatgataatgcatgacaaaatgttgagatgcaggtaaagccacacttaaaggcaatttatagccttaaaggcagttaatccatccatctcaaaagtttaggaaaagaatagaaaaaaaaaaaaaactcatggaaaacataaagagaaaagtagtaaagctcagagaagaaattaatcaatagaaaaccaataatagacccccaaagccaaacattgatctctttgaagactgatcacgtttgtcccaaaagttattcgttccaacagcattatagagtcactggtccctatttctcagagctggttttccctgctccttcccctgacttttctccccttcccttttgtagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatgtaagtgatgctgggacagtgtgtgtggacaatcagagtctcagggaggtggcctcctgggacca

SEQ ID NO: 90995 - DNA, 1083 bp, Homo sapiens
ccccaagtggatccgcagaggcagcccctgagccctccctccccactcctccccacggggagggaaaacccactggggaaggtttatttgcaatggttggaggtttgggtttttttgtgggttttggtttgttggttttttttttcctctttttctcttgctcctcctgtctctttctctcctgggcttgtgaagtttgctcaatatggaatgtcctaattatttctttccccgatgaagaaggtgttaattgaggcagagctatttctgctcctggcctcgtcacccaggcggaaatgcgagagagagagagagagagagagagaatgaatatggggcagggcctcttggaaaaatcagccgtgagcagagaaaccaggactcctggatcctaggtttctgtgaagttttattttatgtttttctaccctagactagctaaaggagaagaggccatggggttggcttgggtccgagtggggttttgaggggacagatgtgggtggtgccaccagaggggaggaagcctcgatttaggagaaagactgaaaagctagctcacgattaaaaatataagacgtgtgagtaagagacagatatatacagacacccaggcagtgggttaattttaaaatgtatttataaccgaattcctcagacactctggacgcttgtttttctagaagcaacgctcagagtgtttcgtgtcggtggttggggggttgagggggattgcaaagctgctaaagatagacccgttttcagtagcattcctcagtgtcgggagcccagttcctgtgtgcccagcaccgtgccaatcgcttagaaggaagcaaagataaagtggaaggcttcctgctttctaagagcttccaaaatagttagaggaaacaagacccctcatttgcagccatttttaacagtgaaggctaatgtgtgattatacccacgcccccctaaatatgaaaattcagtagctattgtatgcctgaaaggggccaggtgcagtggctcacacctgtaatcccagcactttgagaggctgaggtgggagtatcccttgaggccgttagtttgagacca

SEQ ID NO: 90996 - DNA, 1068 bp, Homo sapiens
cggatccacttgggggtcactgggtggagagggtgggtggaaatccactcccagacagaatcttcttctgtggctgcctttcccaaataaggggcctgaaacctctttctctgcccacctgggttcccctttgggcttcttgattccttctatccactccttcaattcacagctcccttgacccaaatcatcagaaccagaactgctattcagtctgtctgcacccagatggccagtggtccaaatactgaaatactgaaggcatcccttcctacttgattccatttcattctggagctttagagagcaagcagctagagtttggatggcaaagatttaactgaaaacgtatccaagggctatttggttcctgagtgtggatcgtggtggacacactgcttccacactgctggttcagagctgagccctgggagagtgtctctgcgctgcctggcttttccggggctcaccctacccccagacccagccactgaagggttaatgtgggcatagtcagggaggggcagaatgctgctgagtgctaggttctgattggttggtgccaggactcccaattggggtatctctggtacatcctgggggttgggggagaccaggaggactcatccagtactctcacccagcactcagggcagagaacaaaataaatccatgggttcctataataaatgagaactatcgtttagcatggcacctgtgcctggaatcttctctgtctctcaccttccacaaggtaccactcacaatgcattgaggcaataacccttttctggcccaactctccccacttcttgcttgctttagaagtcaggactggtcgaggtctgaaagcacccagaatacctgttccactcagccagatgtgccaggcattaattcccactctaggagcagtcctcaccaatgtcaaaaagaagccagtgtataaataccccagctcccttgccccttggctgggacggctctgaggtgtgtgttctttttttatttatatttttatttatttatttatttgagatggagtctcactctttcgccaggctggag

SEQ ID NO: 90997 - DNA, 1104 bp, Homo sapiens
gctggaatgtcatggactttgtggtggtgctaacggggtaagtggcgcgtgctatacgctttggatttaactagctgaaggattacgaggcttttggttggtgtggtccgggccaggctcaggaaggctgagcccttgtgttctccctccccttgttatgcgcctgcctcctttctgccaacaccccacctccatgtctcagctgtatattacagcagatgctttctgttacaattaaaataatagctcattattgttggctgcttccagagtgctttatgcccattctctaatttaatccttgcaacaacccactgaattaggaaatattaatattcccatctgaccactgaggaatcagaaactcagagtgtaacttgcttaaggccacccagcaagtaagtgatggaactgggagatgaacagaagattatgcattccagaactcaaggttttaagtgttgtacgtgcatgggtctcttgatttgcttgaggatatcttgcttttatttcaacttggtgaatgttttttgagaatgtctgggtgcaagggattgtgattatgacaaaggagaaaagcaagctaaataaggtacagttactgtcttcaaggagttttcagatccatatatgatgaactgtggttgaaatgtgtatatgctttcctctaagcaccctgtatgaggtagcacttgctggtataacaaaagatccaaagctaggaaatgacttaaacacggcagaagtttatttgtcactcatagaaaattcaaaattgagctgggtgtggtggtgcatgcctgtaatctcagcactttgggaggctgaggtgggaggatcacttgagctcaggagttcaagaccagcttgggcaacacagtgagaccacccccccatctgtaaaacataaaataaaataaaaattaaccaggcatggtggtacatgcctgggagaattgcttgagctcaggagttggagggcacagtgagctatgatcatccaaccgtgctccagcctgggcaacagagcaagaccccatctcgaaaaaaaaaagtccaaaataattgttcctagttgacaggctcatctcctccaatgactga

SEQ ID NO: 90998 - DNA, 1025 bp, Homo sapiens
gtagctgagattacaggcgtctgccactatgcccagctaatttttgtatttttagtagagacggggtttcaccatgttggccaggctggtctcgaactcctgacctctggtgatccacccgcctcggcctcccaaagtgctgggattacaggtgtgagccaccgcaccaggcccttccactggtgttttttgagcatctactatatagagaatgctctcctgggcacagaggatgaagcagtgaacaaagtagacaaaaaatccccacgtgcatagagtgtgcagtctcgtgggagagacagggaacaagataaagaaggaaaaaaatagcagatgcttgactggggacggggactaaagaaagaaaaaaataagcaggctaagggggttgatggatgtgacctttgagtaaaggcctaaaggaagtgagggagggagtcatgtggatgtctggggaaagactattccaggagaatgaacagcaggtacaaaggcccctgggtacaaatgtgcctggggagtttggggaataaaagggaggccggcgttgctgtagctgagtgactaagggagagaatagaggagatgaggggagggaggtaatgggagcaggtcatgcaccttgctggtgctggaaggactttgtttttgcttttgagtgagatgggatccatgggaaggctttgaatacttccacatgcattaggctgaaattttcttttctgcttttgtcgcattccaacattgcttttatttcatcaaaatcttcggtttcttctcaggctctttacccaagtgggagcagaaggctggtacccagggctgttcagttctccccctggggtcagaacgtggaggagaaagcttggaggagaaacaggaacccccacctctttctggatgactcaaaaccgcaattacctgagctcctcctcctatccctgaaatagaggcacttagcacttcctaaacttcccggtgcacacaaatcccctggcgatctttttaaatgcaggttctgactc

SEQ ID NO: 90999 - DNA, 1062 bp, Homo sapiens
ggtccctgttttgtctttgatctcatctctttcattgtctaccttcctttcattgtctattctgtctcagccctgctgaccattttactcacacccatgtcatttgcattacatgacattccttctgttcagcataagctatttcctctgcctgcatcactgtttctccaggtctccccatggctaactccttctcttcatttaggtctcagcccaaaagttacctcctccaagaggcctatccttttcatttactgaacatctcatgtacaaaaaagaatataaaatatatgtatactctctcatccacaaaaaaatctctgaagacattttaatgtatttcatcccatacctttttatgcatgtaaacttttaggaacacatttccatgccactaggtatccttgaaaaaataagggccaccatgtatagttgcacaggttgtgcactgcacaaagatagcatgtcacatatcttaagtatcatggagcttgtatgtctactatttcagtaccccagctgataaaagcttaagtatcttgttctagcaagatgaagctattatgacaatttttgacagagaaaggggtgttttgtttaagttcacaatcagagaaatgggtgtcttgtttaatttcacaaccagagaaaggggtgtcttgtttaaattcatacagtggtgctgtatgggttggtggcaaccccagaaaagactgttgttaatatctgataatgttccactttatacgtgtattatattcatgtaacaatctctggctgtttgttttgccattataaataacagtgcagtaaacatctttgtgtgtgaatctctgtccaaggttctgatagttttctgaatgaaattcctgtctatatatggcactccaagcccataattgaaactctgctgttaccactttctttgaatctgtagaaggaattttgagaacaggtgactggtatattcaggatgttgatgacaaggaacagagaaagaacagttaaatggtttggaatttttcctgggctgcatgtaaagcagtgcttttgaactgggag

SEQ ID NO: 91000 - DNA, 1102 bp, Homo sapiens
gatataagggtgtatggtagggtagctgtctatgtgtgggtctccctgatatttggtgttctgtttgacttgggaatgaccaagtctctccgcttaccaccttatttgtaccttttccagtatcaagtgaattttgcacacttttgtaaaaatcaataagattgtatgtttaggactttgggaggccgaggcaggcagatcacaaggtcaggagatagagaccatcctggctaacagggtgaagccccatctctactaaaaatacaaaaaattagccaggcgtggtggcgggcacctgtagtcccagctacctgggaggctgaggcaggagaatggcatgaacccgggaggtggagcttgcagtgagccaagatcatgccactgcactccagcttgggcgacagaacgagactccatctcaaaataaataaataaataaatattatatgcttaggttttacctatgtaattagaaagctccttgagggtaggggacagtgatttgccttcctcacatccccccaaagttcctgcactatatcatgcataagtatttaattgagtaatggtgaggaaagtaaacagtgttattgaacaaagattattaaaattctggaaacacctggttttgtttcagcactgggactgaaagtggaattccttggattttgctccattggtggataggatagcatgtggtggtggactggtagactctttctcttccaagcagattgggtaaatgccccagattcttacccactagtcagagattacagattactgattgatatggtttttctctgtgtccccacccaaatctcatctcaaattgtaatacccacatgtcatgggagggacctggtgaaggtgactggatcatgggggtgatttcccccatgctgttcttgtgatagtgagttctcatgagatctgatggttttaaacttgtgtgggcctctttcctctctctcctctcctgctgccatgtaagacgtgccttgctttccctttgccttctgccatgatttgtaagtttcctgaggcgtccccagccatgcagaactgtgagtcaattgaacctcttttctttataaattac

SEQ ID NO: 91001 - DNA, 1033 bp, Homo sapiens
tggacttatgtgggtggccatatttgggcttctctgatccactgctgagaatagtgtgtggcacacagtaggtgctgcataagtgttaatattctgctctttcttgccaagtctctcaactcccttgatctctgttatttttggcgtctgtgttgttaacccattcttctgaatgatcagctgaatcactgttgctccaatatataagccaaggagaacacaatcacaaggtctcattgattgtccatactagaattccatgattcctaggcccaagtaggattttccccacgtctcagcaatccttcttccatgtttctaatctttttctctcatttgttatgccccattgccagactctccaatctccccacagcttccccttcctctaactatactgtctctagtcttaccttctccctaagggcaccgtctttgaagacatcaaatacttcagagcaccaaatataggttagcttctctgagggccttacaaggacatggagtgtttgggtcttacacaaattggaatggtcagaaatgtttagagacttgagttgtctttgaaagagttgtcagaatgcaaatttttgacttgtggcctgtttctgatcacaacgcagtcttttaagttatggatcatagctggatgtttgtggtttagaggggatggaggcatcctctgcagttagtgttggatgtctgggtggatggatggatggatggatggatggatggatggatggatggatggttgaacagatgcatggatgagtggatggatggatggatgggatgaaggaaggaaggaaggatgggtgattggagggtaggtgggtggataagtagattggtagatgactcgatgggtgggtggacaaatggatgggtgaatggatgactggatggatgactggatggattggtgtatgagtgaatatatggctggatgaataaataggcagatgactagactggattgaggggtaaaaatatggatgactggatgggtggatgagtggatgatagatgg

SEQ ID NO: 91002 - DNA, 2006 bp, Homo sapiens
ggagaatcagcacccatgtggacatcttaggtaggtaaatgccttttaaatttttttttttttaatcaaagatccagaggaaaaaggtgaagcccacattttcttctgtggagatgctatcaaaatgcagatcttctgtgtttctttaaatccctgcctgcttgaaataaaccttgaggagggcttaacatctatcgagatgtaggcaggcaagggtgggtaattagtcgggctttctagcagttatctaagcatgacccagattccaggaggggggacacaccctgctgcccaggctggctggccactgtgccatgcccagatgtgccgcttctccgcacagttccaaccagctgccctctgtgtaaaaatgaacgggctggatgggtccctggggctcagcgatgagtcccctatcccttttgtatgtggttttgcagttatagactaaacggggctgggccctgtgtggtctccgggggttgctgtttgaggagcatggcgggtggtagagggactcacttcaggggggttcaaaatcgagcctggcgcttggatcctgggtgctgggattgcaacagagggcactgaggttttggagtgtgtgagtggtctactttgagggtggggaaaattaagaagttcagcagaggtgcttttgaggggagcatacctctaactacgatgccatctccgttggtgcccaaagcaggtgccaggtctttgcttcctaagtttcagactcttaaagaggctggttcttaaggttagcaattcctcaccatcccaggcccattgaagtgctcaggggtggcttgattactctgcctatcaacagagtgaggagtgggagtgccttgcaggaggacagggtattcatgggtgcacacccagttagctccaggagtgagagggctttgctcggctgacaggtttcctcattgaaaatggctttagatcgccttctggagcctggatttggagacttctaagaggaaaggaaggaggtggggagcccttctgctgtgtccttagcttacctctgtccagcctgaatcctgcagattggagggctgttgggggagagggggattgcagtggcccctcggaagggggaatcgtgggagagggaggcaggtgaattgcgagtgttgcttgccacttcatctattctctggccagctcgcccggggctttcttgctcttatgatgagtttgtgcattatgctctctgcagactgtttttgttctctttgacccgaggtaacaaacacattatacagccctactctggaagggaaaactccccacctcacaatctgtcatcgagctgggtcatccaggactgagctttctctgtcctggatggagcggagggcggtggcggggtgggtgggagggttggagatgagaggggatggacagagacctggggagggaggtagtgaataaaagaattcaggccagtgtaaagagaaagacacgtggaatgtcagagtcacgataccagggcagaacattctactttttaatctaaatatttctgccattaaaaaaaaatgtttcagcatatcctgagagtgaaaaaaaaagtgtgtaggtacttaaataaagtctaatatatgtacaggcaagtacatatattcagatgcatagatttttacaaaatgaacacacccacgtatccagcacccaggtcccgatcagtgccctggaagtccccctccccataccgcctcctagttgctcccccaacaagggtaccgctcacctgacttctaaggttcattttgcctcttttaaacatgtaaatggagtcacacagtacgttcttttgccactggcttcttttgctcacatctgtgtatgtgactctactacaatctatccattctactgttgatgggcatttgtgtcatttctgtttgtgccactgggaacattcttgtgtcttctattatttttttcccacagttctcttagataggagtggaatcgcccctgct

SEQ ID NO: 91003 - DNA, 1049 bp, Homo sapiens
ctacccgcaaccctccacaccagtcttattttagcaaaacctagagaaggaggaggtggagggatttggagggtggagaggcattgccgcatccaggggcagctattgagtggctaagcggagggcgcatacctctctctctctctcttttccccctgttgggaattttcaggatttcactgctgcaatttaaccccaagatgaggcaccattgagcgaaacgctgtgcgcacatacacactcacacttcctccgggagcagaagaggcagccgttggtgattcaggaagaaaaaaaatttttttttttttttttaaacctggaccctgcggtgtgaagactccttaggaaccctctggagcgtcttactccccttccctcctctttcccttccctttcatcttctttgtttttattttattttatttttggagctacagatctttcagcatttttaaggtctaggaactccagcaaaacagaagggcacttaattttttttttttttttttttgccctccccacccagacctgggtttcgtctttctttatttttaaatatatatatatttttttattttttattttttatttttttttaatgggccgagcgcactccttttgcaagatgccagcctgacccggacctcggaggaatttgaagcttccactgcgtcccggggggggcgtcctttgcaaaccgttcgcgtcttaaagggggtgtgcgttgggtggattttttttttttaactgtctctttttttttttttccggagtgggtggactggggattgcctggattccttcctcggttattttttgcctcgcttctctctcccctcccccctcctccccgggcccccgcgccccgcccccgcaccctcctcccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccg

SEQ ID NO: 91004 - DNA, 1048 bp, Homo sapiens
ctcaccctcagtgtttgcatctgttccacggggctgctgtgaagactcagtgggagatttaccctggcaggagctccatcagtgagatgtcactctttcctgaaaaactctggggtcttcacagatctatgcaggtaatgctcctgctctaaaactgaataatcttctcagagaggtccatcagaacaaatgataagttcaactcagctcctctcatatgactggttcttcccatctgaacacatgggctcgcttcttgtttcatattagttgctgttcaccttttatatctgaaacaatgtcaagtacaaaaatcactgatatttggtgagcgccttaaaagcccctccttctccctgaatcccacacaattctatctccttgcaattccaatcactcttggtttaatcatttcatccatatcgtgacaagttagaaaatcttgaaagtgctatggggcaatgtataatagttggtgcattggcacagaacggggactttatataaagacatatcatctttccagagtgttccaaaagaactcgaatattgatatgtgtgtgtggggtggcgaggggggaagggaattaactaggatttaactagctaaggcttgaaagaatatttgcctttttcatccttttcccattcctctccatttggcctttctgcgtatacaagctccatgaaaattcaatggtttcttggtacattgaatttgcaagacagtttgatgacatcttataagcttgaagatatgaataccttgtggacccagacattccacacctaaggctattcctagagacatgcattcttatctgcaccaaaggtacctgaggcagtaatgtttaatagccccaactggaaaaaaaacagatacccatcaacaagatgatggataaacaaattgtggcatattctcttgatgaaatactatacagcagtgaaagtgaatgaatcacagccatgtgtgacaacaaacaggtgaatttttctaaaattcgaaacagattaggatgtatgaatcttgttttttttgtttgtt

SEQ ID NO: 91005 - DNA, 1022 bp, Homo sapiens
gcctgggtgacagagtgagaccctgtcttggaaaaaaaaaaaaaaaaagaaagaaaagcaggttgttttgtttagacatcacaattaaactgcaacctaacctttaaaaaagaacctacttagaaatcagagctctctttctcttcttcttctttttatttacttatttttttgagcaggagtcttgctctgttgtccaggctggagtgcagtggcatgatctcagctcactgcaacctccgcctcccaggttcaagtgattctcacctcagcctcccaagtagctaggattacagggacccactgtgattagctgccatgcctggctaatttttgtatttttagtagagatgaggctttagcatgttggccaggcttgtctcaaactcatgacctcaaatcatccacctgcctcggcctcccgaagtgctgggattataggcgtgagccactgcgcccggcctctttctttcttttcttaagggaggcaggctggccaattctagcctagttgatatttaaaaaaaataggtctggtcccagggagcttctttttcagtgcagctggctgacttttggtgcagagagacccttcttttgttctttgaattagcagctttggcagccatggaaggtctgggtagggccccccagagatggggctcccctatctcttttggtctatcagattctccatgctggtccttgaaacccaagcagcttatgaacaaatatcccccaccacccccactgccaaattatcctctctgttcaatgtgacttttccatctagaatttatctgtaccttgggtttccaatcctgggaacaactatgccttatttatttatttatttatttatttatttatttatttatttttgatacagagtctcactctgtcacccaggctggagtacggtggcgcgatctcagctcactgcaacctccgcttcccaggttcaagcgattctcctgcctcagcctcccgagtagctgggattacaggtgcacaccaccacg

SEQ ID NO: 91006 - DNA, 1058 bp, Homo sapiens
gcccgacccgttcattaatttttgttgtcgtataataaaaagaaggataattcttgataggtgaaagttgtatgccgttcaaaatttggtgtccataaagttttattggaacacagccttttctatttgtgctgatgttgtctgtggctccttttgtgttacaacggcagagctgtctctgggacagagactgtctagccctcagagccggaagcatttcatctgaggtcctttatcgaagaggtttttggacccctgagctggaacagcgcctgacacacactgtgctcaaaaagcagcctgcgcgggtctcccctgcgttcacccactgtcgcccgccgctgctaagactggccaccaggtggcgccatggctccccagcctggcaggcgccgggcagcagagcgctcagctcgctctccggagtacccacctccctgccgcttcctttctgcctgttccgagaaatggaagtcagccccaaatcaataattgaattcccatcatgtgataactaatcattacatatatggctattgctttttcatgcacaaagggcttggtaaagaccaactggggcggcaggggcggactcggggctttgcagggctccctgaggtctgatgggttacaagcaggtcctgaggtcaagtgtggggcttacctggcttcaatctggggtgtggttgagtgccccggccagggttcaaatcccaactctgccacttgctgactgattctggggaggagggttcctttccctttcggtgcctcagtttccctctctgtcaaatggggaaaacaatagcacccatctctggggctcttacaaagattaagttcactgcattattacatagaaagcatttagaacagtgcagccacatagtaagtacttggtaatagttttctgtttctgtagcgggtatgccattaagcattttgaggcctcagtttacacagttaaaaaaaaaaaaaagaggctgggcacggtggctcacgcctgtaatcccagcactttgggaggctgaggtgggaggatcgattgagccccggaa

SEQ ID NO: 91007 - DNA, 1067 bp, Homo sapiens
gagccaccagtttggggttcacactgctggttttgccccacgcttgtgccttacttgccagctcccttgcccactcttcagatcctcagcttgccgtctgcaaagcagagatgacctggggcagaggaggctgcccttctagaggctgggaccagaggctgtgggcacgccggatcccatgcagtttagggacctgggcaaccagtgcctcctggctgcagcagactgtttccccatccataaaatgggcatgagcagaggtttagaagccaaggtgcagaagtgaggatttttgtgtgtgtggaggccccggagagtgcaggacttaaaccccagccaccagacccacagtcaggtgcggttcgaggggatagttgctgatctagccccctgcgagctctagccaggaagagggtgactggtcaggccctctctcagccccaggtcacaatctgactgccccgtgcttctccctcagaacctagaagtcggaatccggaagaagatcgaacatgacgtggtgatgaaagccagcagcagcctgcccaagaagctggcactgctgaaggccccagccaagaagaaaggggcagctgccgccacctcctccaagacaccttcctgaggacgctggccccagtgcaggccaacatcccaccccctacctccatatgggaccttgcaagtcatcccacaggctgcactgtcaggaagaggaccctgtcccccagcactgggcttcacctagaacttcagtgggggccaagggtgctgagaacccagcaatgaccaggaagatacagtcactaacttcatctgtccccgtgccccttcccaggtcctgcctccacaggtttaacccagaacaataaacctggctttgtcatccctcttgcagtcctgtgttcgggtgagcaggccaggtgagcccacaagtctccatgagtgacgtggcctggcgtgctccaccccaccccaccgcctttagcaaccatgtgcccaggggacagctgggcttctacacctctggccctgagcctgagagccgggaaagagtcttttctcca

SEQ ID NO: 91008 - DNA, 2001 bp, Homo sapiens
gctgagtcacgctccagcgacgccttgccccagggtgctggagctggcgccaccctgggtgtggtcactgagctgtggccctgggcagagcagggctgggtggtctaggatgtggggcctcggtgcctggggaactgacttcgaagatgccaagccccctggcctcccgcctggcctaggttctggggtcaccctccaggactgtggtggcccacaccctgagaatgccttggagagcctagaggccctgagccttgggcctgggaatcggtgcgttgagggaggtggatagggcgcagacaccagtgactgcattcaaggccaggggacccccacagccaggccctcactgcaaaatgtacctatgtggggagaaggcaggggtggacctgatgacggggtgtaccactctactaagggttcccaacatgaaggtgagggggcccctgggaattctgtgattggtctgggaaagattaaagtctaagtgggggttagagtgtggactggcgggacgcaatgggggctgggatgtcactttcatggttcccctatttataacaagtgattcagccctcacttactcaccccttcctgagcctccccccaccccagccctgggtgggcagcggggcccacccacttgtcagtgccctgactttccctacccagtgccaccctctgagggctgcccatcggggcggttgttattgtcgctgcactgggattggggcagaggggcggggggctcctggtcaggcggcgcttggccgggcagcccaggttggcggctggctcgaggcccagcccacggagcttctgctgagagtctgggcccattaggcaaagcgttagtgacaggctgggagggcgggtggcgcggcgggcagggcggggcctgcagcccttggtattttccgatcccagctgctctgtgagggtggaaagtatttggggaccaggcttgggggcggaggtggtggtggcgcccccggcggaagctgcccctgattcattcttggagcatggggttgggggggtagcggtacacatacatacccttgtgtgtctggtccacgcacacgctgtctggagggggtattcaggcatacccacatgcattggctggccggggtgtcctgatgcagcctggggcctgctttgctccccagcccaggggcccgccctctccctcatgcctccagctgctaggagcttggtttccccctggacaccatctcccaagagcctgagaagtgcaccatgattggtaaaggggaccctgtctcctgggcacctgcatggcagcaccccttccactcaagacccagaccttttgtgcctgcggggatggggagtggccttggccccggccctgggctctgtgcaggggaaaccccacaggaaacgagcctggccaaatggccgcccttcccgttctcgtccctgggacacgaatgtgctgtctcacttccggaggcggcccagggaggctggccgccctgcggggcctcgcctgctcccagttggcgcctccagaccctaaggggacagggctgggctggggcctgatgggaaagagtggctggtatgtgtgtatgtgtgtatagggaggggacaaaacaggacatcactcgccgcctgtctcgaagtggtgagcgccaccacatcgggcggacactggggtcctggtgtgagacacccacgtttccgttatcctttgccttggcaaagacagcagcagctctgtcgtgatcatgtttatcactcatggggtcctcaccatgacttatgaagtccatacttattatccctgttttgcagatggggaagctgaggcccagagaggttgagtgacttgcccagagtcacccagctcagaagctgcagagctggggctttcaaatctgggcagacttgggctccaaaactggagtctgctagccaggtgttgggctcttatcaaaagaagctccactcactaaagacttagggctggct

SEQ ID NO: 91009 - DNA, 1031 bp, Homo sapiens
cttcactgccacacccagtgtgtggacagagaactgcctacctccctgggcgtgactgtgatgccctcagcccaggctcaggtgtgccaacggctagggaggtcgctctttccctggggggcagggctgaagcaaggctgccatctgcccagacaggagaatgaacgccaacggctggcaccggctctggagccagaggaggccacatccgggcagccggtggggcgggcagatccctgaaggaggcaaagcccttacacgttctggcagaaaaacaaaatgacttatgtatgtttggaaaagaatcatatcaggacccccagaggaccctaaggagatgggcaaaggctcttttgcagcttgggagtgaagccccctccccaggcccaggtataaagccatccccaggcccagcttctctccatctgtgtctacccgcctcaatacatcccctgggaccccacggccagggtcaggcactgaagcagaagctgccaggggctggcactcctggggactccagttcaatgtggggggcccggctgagaaagcagctgtgtgtcaccatccctagatatgtcgacaaccaccaaaaggcaggtctacactttctggaaaaccaccgactccacacccagtagagctgcaactcggactcctatagtcgttggctgtgtaaatggtaagccctgagccccagctccccctctgccactgcaccgagtgaggagggggcttgtggaggttgggtgcctgccctgggcaggtatgtctgtcactcagggcagctctcacctgctcaggtggggcttcgaagtcagaggcgtccagggcatcctgtatctggctgtccagcaggaagtcgagttccacagctaaagagtctgcccaggtgccctggtctgcagaatgaggcaggtggtctcgctgccctgccagctctgaggtggtgtctggaatgccctgctgagccccgggctcctggagagggtcgtctgctatttctctgtgttccagcacaacagaggctt

SEQ ID NO: 91010 - DNA, 1050 bp, Homo sapiens
ggagccccccaggagggaggggcccaaaggacagcaggggctggcctgcctggagggccccaggaggagggagacggtgtcccctgtaccccagcatcagctcctacctcaggccctgctccaggactgggccctgcctcttggtgcctggaacccgggtctgtggcccagggctcccctgacccccagcagacccccagcaggatgggtagggaaggggaagggactcatagcagcctgggatgctcctccctcgggatggttgtcatcgcagacctgagcacagaccccactgagctggaagagagggctctggaggtggctgggcccgatgggcaggccagtgccatatcacctgcctctcccaggaggaaggccgctgatggaggccacaggagggccttgccaggctgcacctcgctcactggggaaaccacaggagaaagtggggaggcagggcaggatggcaagccccccggcgatgtcctagtgggccctacagcctccctggctctggcacctgggagcggagagtccatgatgggtgctggagattccggtcatgcatccccggacacaggtccatgtgtcaatcagaagcaggagccaggtcctgctcaagaggaagccgagttaggtggccagaacctcgaacgagacctcgaggggttccgtgtgtccccgcaagcctctgttgtgctggaacacagagaaatagcagacgaccctctccaggagcccggggctcagcagggcattccagacaccacctcagagctggcagggcagcgagaccacctgcctcattctgcagaccagggcacctgggcagactctttagctgtggaactcgacttcctgctggacagccagatacaggatgccctggacgcctctgacttcgaagccccacctgagcaggtgagagctgccctgagtgacagacatacctgcccagggcaggcacccaacctccacaagccccctcctcactcggtgcagtggcagagggggagctggggctcagggcttaccatttacacagccaac

SEQ ID NO: 91011 - DNA, 1095 bp, Homo sapiens
ttcttaccagcatgaattaaatcctttttgtctttttcttttttttgagacagagtcttgctctgttgcccaggctagagtgcagtggcaccatcttggctcactgcaacatcggactcccaggttcaaacgattctcctgcctcagtctcccgagtaggtgggactacaggcatgtgccacaacacctggctaatttttgtatttttagtagagacggggtttcaccatgttggtcaggctggtcttgaactcctgaccttgtgatctgcccgcctcggcctcccaaagtgctgagattacaggtgtgagccaccgcacccggccaatccttgcttccttttaaggaggttaaggcagtcgtgttagccagatctgcaataaacaagcccacattcttcccacaagcagaagcagaaatcaacaagtgtccatttgaatgaacgtacctgaggtccgcagcttcttcctcttagtcattttatcttccccttgagaaatctgaaaacaagcaaaatctctcatcattataagcagtctctgtctctgtttatatccagtggctttggctgagagcagaggttacccctacctccacctcagcccatttggctgccccaggggtcagatggctcccactgggacacaggatgggacacagagtcacagccactttgggccatggccaggtaggaattcaaacctcctccaaactgaagatcttatgcccaggacctgaaagacaaatgggccctggggggtccttatagatagccccggggacccagactctggtccctaggatgaaacagcctgtgtgaagcccctccctccagactggggtatctgggggcccttccaaggacacttgaggactctccaggggcctctggagaccagcctggccaatatggtgaaaccccctctctattaaaaacacaaaaattagcctgggcatcgtgacgcacacctgtaatcccagctacttgggaggctgagacagtagaattccttgaacccatgaggcagaggttgcagtgagccgagatcgctctactgcactccagcctgggcgacagagcgagactccgtctca

SEQ ID NO: 91012 - DNA, 1050 bp, Homo sapiens
gacagggtttcaccatgttggccaggctggtcttgaacgcctgacttcaagtgatccttctgcctcggcctcccaaagtgctgggattataggcgtgagtcactgtgcccggtctgcagagctgggttttgaattcaggtagccaggccccagacctgaggctgaataaggaagagatgaaatggggaagtcagcgagaagtgggatcacctagcgtgtccaggatgggaaatgggggctcttggtgtacgaccctggtccacctggggcatccccctaccgccaggtcccttgccgatggaggccattgagaagatggccagcctgtgcatgagagacccggatgaggatgaggaggaggggacggatgaggacgacttggaggctgatgatgacctgctggtgagcactgagggcggggtgggggctctgatccggttgcccccatccagcaggcccttatatcctgccctggctgtgtgtccctgcaggcggagctaaatgaggtccttggagaggagcagaaggcttcagagaccccacctcctgtggcccaggtacagtttggatgactccactcccttgaaccacaacccaacggacagcccggggttcaagacctagccttttttatgagatggagtcttgctgtgtcacccaggctggagtgcagtggtgccatctcagctcactacaacctctgcctcccaggttcaagggatcctcccacctcagcctccccagtagctgggattacaggtgtgtgccaccacgcctggctaatttttgtattttttggtagagatggtgtttctctgtgttggccaggctggtcctgacctcaagtgatccacctgccttggcctcccaaagtgttgggattacaggcgtgagccaccgcgcctggcccacccttatccttcacagccatgtgacccatatcaggtgggtgacatgatgcttctgaaaccccattccctccactgggaaatggggaccatgatttctgcctcactggggcaggggaggctggtccagggatgacatggg

SEQ ID NO: 91013 - DNA, 1089 bp, Homo sapiens
ttttgttttgttttgttttgagacggagtctcgccctgtcatccaggctggaatgcagtggcacgacctcagctcactgcaacctctacctcccaggctcaagcgattctcctgccttagcctcccgagtagctggaactacaggcacacgccaccatgcccggctaatttttatatttttagtagagatggggtttcactatgttggccaggctgggcttgaactcctgacctcaggcaatccacctgcctcgacctcccaaagtgctgggattacaggcatgagccactgtgcccggcctgccccttctctttcacccaccccctcgctcactcttccccttgctgtctggtagcctcaaacaccaggcactctgcaacctcagggcctttgcacatgcagttcccactgcctgaatgcttttcccacagacacctgtgtggttcactttctcccatcattaggtctctgctcagacatcacatctccaggaggcctaccctgagctgtctaaaatccctccctgtcacccagatccctctgctcctcctcccagctctgcctctccctgtggcatgtatcaccttctactctctcatatgatttacttatttcttctgattattgcccatctcccccaagagaatgtcagccccacgagggcagggattttgttctctcttcttcatccttgtgtccccagccccaaagcagagcctagcgcacagtaggggctccatacatgatttctcaaactcttgagctcaagcaatccacccgccttagcctcccaaagttctgggattatagacatgagccactgcacccggcaccatacatgatttctggggtgactgaaggatgcccttgttaaatgggacaatggaaggatcaagaagaaagaacagaggccgggcatggtctttcatgcctgtaatcctagcaattaaggaggccaaggccagcggatcacttgaggtcaggagttcgagaccagtctggccaacatggtgaaaccctgtctctactaaaaatacaaaaattagccaggtgtggtggcaggcgcctgtaattccagctactcagga

SEQ ID NO: 91014 - DNA, 1050 bp, Homo sapiens
atatgtatatatacacacacacacacacacacacatatatattaagtgaaaagaaggtcccccagcagctggggtactggctggcacatagtaggtgctcaagaaacattgggaaatgaaggaaagatctcccagcagctagggcactggctgatgcttagtaggactcaacaactgttaagtgaagggaatatcacccagcagctagggtacctagcacacagtagataccaaataaatatacacagactgaagaaaagactcgaaagtgatccattgccaacctgaacagagaactctagtctgtctgattctaaaatgagcccaggagctgagacacccccgaaggccagggtggggtttgttccctgcccccactgggggaagagaaggcaggcgggcagtgggactgaggtgcctctgtttccctgcccacctgcctgcccacctgcccacccggaaggatcttccctgacctcagcagcaacgacatgctcctcttcatcgtgaagggcatcaacttgcccacacccccaggtgagggggctgtaggcaagggtcagggtcatggggaccccctctctgcccagctctgaccgttgtttgcccacaggactgtcccctggcgatctggatgtctttgttcggtttgacttcccctatcccaacgtggtacgtggggagctgaggaggggagggctgcagcctcagtgggccaaagccaggtcccaggccccctagatttcctgcctcctctctggtcataggaagaagctcagaaagacaagaccagtgtgatcaagaacacagactcccctggtgagcctcggctggaagcaccctacccctactcccttgcagcagaagggacataagacaatggcctgaccccacccaacttcctctccctccttcctcctgcagagttcaaggagcagttcaaactctgcatcaaccgcagccaccgtggcttccgaagggccatccagaccaagggcatcaagttcgaagtggttcacaaggggtgagctagagagagccatggccgct

SEQ ID NO: 91015 - DNA, 1096 bp, Homo sapiens
gcagggattacaggcgtgagccactgtgcccagcccagtgtgtcttttgaattaacagggttgggctgggggaatctctgcagtcccttatccttcctccaccccttagatcagcccggcccctgcatagcctcagtgtgctggcgtttgaccaagagcgtctggagcggaaggtgggtatccatcctgccgggctacatggggcaggactggggagtctgcaggcccaggcaggatcctcacaggaccctctgtatcctctagatcctggccctcaggcaggcgcggcggccggtgcccccagaagtggcccagcagtaccaggacatcatgcaacgcagccagtggcagagggcacagctggagcaggggggtgtgggcatccgacggggtaggggtttggagatgggcatctggtgggggaggagctccaggataggcatggggggggaggtgctcagggatgcatatctggtgggggaggggctcggggatgggcatctggagagggaggggctcggggatgggcacctggagggggaggggctcggggatgggcacctggagggggaggggctcggggatgggcatctggagagggaggggctcggggatgggcacctggagggggaggggctcggggatgggcacctggagggggaggggctcggggatgggcacctggagggggaggggctcggggatgggcacctggcgggggacgggcttggggatgggcacagtccaggagggttgtgggcagtgaggccccaccctaagcctccattcccccgccatccattctcagaatacgcagcccagctggagcggcagctgcagttctacacggaggctgcccggcgcctgggcaacgatggcagcagggtgagctggtcgcgggccgggtgggcactgggcagcgggcagggtggggcctgcagggactacctgctgaatgcccatcccccacaggatgctgcaaaggaggcgctctataggcggaatctggtagagagtgaggtaagcagcttaggagatggggtggttgggggatcactgtggtcgtagcccacctccatgaccccagtggcctcct

SEQ ID NO: 91016 - DNA, 1003 bp, Homo sapiens
agtgggtcaggactgaattttgaggtcttgaggcacacactggggtcaccaaacagcaccctgtgcgacctagccacgtgtgattgcagggacgcccaaggccacccactgaaaaaacactgggtgacagatatagggaccctcacatgtatccccccccacagcaagcatgggaatgaaatgcatccttcaagctgggtgtgtggtggtgcccttctgtaatccgttaggaggctgaggcaggaggatcatgtgagcccaggagtcggaggctgcaatgagctgattgtgccactgcgctgcagcctgggtgacagagggaaacccggtctctaaaaaaaaaaaaaaaaagcacctttcacaagcacactgtccctccccaaaactgcttccctaacaggcgcctccccatccacttccaggggaaccggggggtgggtgggaagacctagcctggccaccgagggtctgagcaagaaacagacaggacagagctgggctgagtgtggccctggctattttattccatgtgctggccctggggacccagctgggccaggtcgacgcccctggggagacagtgtggctcggccagcctcagtggcttctttggggtgcaggagggctttggggttaaggctggggaggaacaggaagtaaagtgcttgcaggggccctcggggcttggccccagccaccctccctgctccggggcgggccagaggccggacacccctgggctgtgcaaacaggactctccagggcccagccaggcctgggtgaggggcacatactggctggcaggcatggttcccaacacccgcagccacggaggctctggcggggctgggggcccggatgaggggtgagtccagaaccgattgtccgctgattgtctgcttgtctggttcgtggctgtgtcggctcttcccggtatcggggcctgctgcccgctttctgggggctgcccgccccatgggctcctcacctgcggagccgctgc

SEQ ID NO: 91017 - DNA, 1022 bp, Homo sapiens
cggcccaggtgcaggatagccagggtccggggcaggccggcgggcactgtggtcagctggttgtgggagagatccaggtattcaaggctatgcagcttgctggaaggagagagggtcggtgttaggtggggcacttggagtggggtgcctgacagattttggcggggaggctggggagtggtcctgagacagatttaagctggagattttgacttgggagtgatgcgtggagagagctgggtgggaggtaaacttggggtgcccagggcagattccagcctgagagttagctatgggggtgaccagggtagagccgagatggaaaggcatgtgagacttacgatgtcagtgcagggctgtggggaacagggacacctacccagtgctctgccgagcccagtgagcagcaggcactcagtaaatgaggccgtggcttaggagccagtcagggaagggggactgaaggttgggacccccgactgtaaattctcagcccctgctgccccccaaccagcctgtacctgaaggtggtggcatccaggccactgtctgtcagctggttgtgctggaggtagagctcacggagttgagtctggcggctcagggctcctcggggcaccttggagatgagattgttctggagaaggaagaagagaatgagacttgagtctgggatgagggcagcgggaagccacagacggctcttgagtaagggagtgacgaggagcttgccttgagctcaaagcgatttccaataaagtgattcaaagaaggataactctgaccactggcattctgaggggcaattgagaagaatggaaagctaggaactggaggggtccccctggaaagaggtgaagagagtctggcccggggtgggacctacagcagggctacctgcaggtggagccgctcgagtgagggcggcaggctgggcggcaggtagctgagctggttgttggagaggctgagggtggcgatggcctcggagccgcggaaggcgtcggggggcaggccagcgt

SEQ ID NO: 91018 - DNA, 1071 bp, Homo sapiens
aggcggctgtggccatttgcggggggaggagggggcgggtgtctggagcaagaccagccagcagaggggaggtgggtgccgggcagcagacctggtcaggagctcccaggctggcatctgggctgccaggctaagctcaggcctccctaatccctcgctgctgcccgcccctgcttctcggaactctcctgtgccccgaagctccccccatccctccatccccacccctactcctgcggtcgtcccaaataccagacaggacgaatctcagcttttccccaaacattccttgttcttgtggcccggcccaggctggctgaggttacgaaagcagagatggggtggttgttgggggggaccaaggggacgggctggcctgtcctcaccaccccatccggccgcctgcccgtcctccccagggcggggaagggggtgggccagctcccccaaagccccgggagaacaggctgttgtggggggtggcatgggtctggagatggggggcggtggtggccacagcagaggctccaggaggtgaccgcctggtttccattaggaagtcctggtcagcagcttgggcgagatggcagagtcagggctggccatggtaaggtggggcacgggagggtctgagggtggggcctgcctgcccccccacccctgctctgccaactggccactgcctccccaccaagaccctccccgaggaggggatgctccagtcaccatggcgaccctgcgcccagcctggagacacgctgaccctccctcccccgcagtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcaggtggggcccacggaggggagtgggggcatgcagggctgagacccagtggtgaggggagctggaggggtgc

SEQ ID NO: 91019 - DNA, 1035 bp, Homo sapiens
ttttccttttttgtaaatctctttcctcggcctggctctgccgcccaagtatgctcgtcaggcctttgcccacctggaccgggcgcgggcagcccggggctgaggattctcgagccttggtggaccacaggctcccgtcgccccgcccaagggcctggaccgcctgtggtctccatggaaacccgccagccacagggggcgtgacgccgttgagacagacagagatattcacctatcagatcaaagttatctgggcagggcgaacaaacgggacctccgagtggtacgtccttaaggcggggcgggaatacggcaacgggccgcgggggctgttactgtcgctaccaatcaagagtcgagatggctttgatggacaggcatagcgcgagtgcgggctttcgcccaaccggcgggccgctgtcccgaaaaaggaccaatgaggaggcggcaggggtggggcgaaggggccggttgctccggaagtggagggagggggtgaaaatggcgcccagctcgaaatcggagcggaacagcggggctgggagcggcggcggcggccccgggggagccggagggaagcgggcagcagggcggcggcgggagcacgtcctcaagcagctggagcgggtcaaggtgaggcctggagccggagtggggagcgcgccggagggtggggagtagggacgagggaggcggagggaggagggcgttcgcggggtgaggggttgggggcggggccccaggggagggggctcggatgcagggcctgggcggggcccgggggagatggcttggatggagggggctcagttgggggcctggatgcaggtggttgtgtcgggtgaccggcaaaggggctgggatggagggggttgggggcggggccccagggagggggctcggagggaggcgaccccagaggccgcagggagaatcaggaggaagggggcgatccaggcttttcaaagctctgctcccatggttgctccataatggaaccttcccgccccctttgcagagcccctgccgctggct

SEQ ID NO: 91020 - DNA, 1400 bp, Homo sapiens
tgtctcctccatcagactggaaactcccagagctgggggatgatgtctctctcccccatcagtttgggagctctggagggcagaaatgtggatctcttgcaggtgggcagtaactggggcaaggctgtgtctctgtggacagggactgcgccttctccgtgaggctggtagctttgtaagggcagtgctgtgtctcccccttttgactgggagctccctgggctgggacagtctccgcccttagcctgggagctccctgggcttggctgtggttccgcccttagcttggaagctccttgggcagggactgtgtctcccctgtcggcctgggcctggctggccaggctgtttcctccgtcagactgagacctccatgtggacagggctgtctcccatcagacagggagcttcccagacaggactcttcccatcagattggaatgtcttgaaggcagagttgggtagcaagactgaggctgttcggatatccctgtgcctggcttctgcctgtcagtccccgcagatccttccgcggtgaagttttggggatgagggattcccttggattccgttggaaggcggtagttaattgggaagggggcgttgggtcattggttaggctcacccttctatctgcctcgactggcccccagcagaggccagagctgccccggggaggaggagcccccttgtttgaaggctggtgggttgggaacagatgggtgcaggtcaggactctgtcccagcctccttagtaggataaatacccacagcttagggacagccttcagggagggaagcaggtggcccagcgtgggacagggtgattggggaactttcttgggggcggtgacgctgggctcagtcaagagggacctgaggctgaagaggtatggaactgggaaggtggcctgggtccctggtggagatgaaggctcaagcgcggtccatctggctttactgtccccatctgcctcagttgttcccaccttccagagcttggccttcttttgaccattatggtgggctgggccggtctggacccggtgagagccgctctgcctctctgccgtgggtgagggggctgggggctgcagatggtgcctgaagtgccctggccaccccttccccagatcagcggacagctctcccctcgcctcttccggaagctgcctccccgggtgtgcgtgtccctcaagaacattgtggatgaggacttcctctatgcagggtgaggctgggcccaggcaaagggggcaggtgggcgggagtggtgggctcgccctgacctggccgctgtgccccctccacccccacagacatatcttcctgggcttttccaaatgcggccgctacgtcctctcctacaccagcagcagtggggatgacgacttctcctt

SEQ ID NO: 91021 - DNA, 1002 bp, Homo sapiens
aggctggactgagacagaggcttgattttagctggtcaggggacaatggccacagtttggactgggaagggggcaggggtctctgtgtggccagcctaggtagagtagggacccagttgtggcagtggagtgtgtaggccaggcaaacgcatggttagggctggggagaggtcaggggtcaggatgggggggtccccacttgaccaggcaggggcacagcttccttaggggccagggtcatgataggctggtcaaagggcagggttggataggtggtgtcgggagactgtgcctgagcccacagtgcctctgtgacttgtagatgaatgaatgaatgtgtgaggctcgaaagacaggtgcccagccagacactagttgagtggatggcaggactggggcattggtcctggtgcccacggctgcccagccctcaaactagcaaaggctactgatttcacttttgctacacccccacttgcagcagctgctggaaaggccagccaggacatctcggctgccccgaagaaccccaggggttccttgccagctgggtcgccccctgtaaaaggcctggggtgacttggtcagggccagccactcgctggaccccatggcctcatccagctcgcctgccagactgtcttcatcagcatctgcatccgggaaggtatctcctgcaaaagatgaacagagttagtgatcagggctcagctgctgctgcacccacagtcatggctcctggccagtctagctctgatcttgtgacaacagtcatagacatagttcagagtttttattccacccagtcctgggttcaaattctggctctgccagagtaggtgggattacaggtgtctgccagcaggcctggctgatttttgtattgttatagagatggggttcaccatgttgttcaggctggtcgcaaactcctgacctcaagtgatgtgcccacctcagccacccaaagtgctgggattacaggcgtgagccaccgcaccc

SEQ ID NO: 91022 - DNA, 1055 bp, Homo sapiens
tgaaaccccgtctctactaaaaatacaaaaattagccgggcgtgatggcaggcgcctgtaatcccagctactcaggaggctgaggcaggaacatcgcttgaacccgggaggtgaaggttgcagtgagccgagatcacgccacttcactccagtctgggtaacagaatgaagactccgtctcaaaaaacaaacaaacaaacaaacaaaaaatgcttcactgaccggtggtttatcaggtgacctcagggagacacatatatgtgcgtgattaatgggagacattaacccctttttcccttcatctctcaggccccagggccctgtgtgcaggtgagctacaaagtctggttctgggttggaggtcgtgagctgagtccagaaggaattacctgctgctgctccctaattcccagtggggcggagtgggccagggtgtccgctgtcaacgccacaagctgggagcctctcaccaacctctctttggtctgcttgggtaagagactgtgaccttcctcagctcggtgccctggaggggtgggaagtgacttcctgagtgggcagctgagacttctctccaccctccagattcagcctctgccccccgtagcgtggcagtcagcagcatcgctgggagcacggagctactggtgacctggcaaccggggcctggggaaccactggagcatgtagtggactgggctcgagatggggaccccctggagaaactcaactgggtccggcttccccctgggaacctcagtgctctgttaccaggtgaggccctgggacacctgggtctccatccccgctgttagagcagacggatgggtggacttgtaagagggagtgctatgattaaagtagcgtgatggccgggcttggtggctcatgcctgtaatctcagcactttgggaggccgaaaggggcggatcacctgaggtcaggagttggacaccagcctggccaacatagtgaaaccccgtctctactaaaaatacaaaaattagtggggcgtggtggcacatgcctgtagtcccagctactcgggaggctga

SEQ ID NO: 91023 - DNA, 1047 bp, Homo sapiens
aggtgctcttgtcagaaaaagctcccagaagccgggcgcggtggctcatacctgtaatcctggcactttgggaggctgaggcgggcagatcatgaggtcaggagttcgagaccagcctggccaacatggtgaaaccccgtctctactaaaactacaaaaaaattagctgggcgtggtggcacacgcctataatcccagctactccagaggctgaagcaggagaatcgcttgaactcaggaggcggaggttgcagtgagccaagatcacaccactgcactccagcctgggcaacagagtgagacttcgtctcaaaaaagaaaaagagccctttcatcaatcttcccgcgtccgccgattcctcctccttggtcgccgcgtccttggctggcgtcagaaaaatggctacaaacttcctagcacatgagaagatctggtttgacaagttcaaatatgacgacgcagaaaggagattctatcagcagatgaacaggcctgtggcaggtgcctcccgccaggagaacggcgccagcgtgatcctccatgacattgtgagagccagagagaacatccagaaatccctggctggaagctcaggccccggggcctccagtggccccagcggagaccacagcgagctcgttgtccggatcgccagtctggaagtggagaaccagagcctgcgtggcgtggtacaggagctgcagcaggccatctccaagctggaggcccagctgaacgtgctggagaagagctcgcctggccaccgggccacggccccgcagacccagcacgtgtctcctatgcgccaagtggagtccccggccaagaagccagcctcaccagcagaggatgacgaggatgatgacatcgacctgtttggcagcgacaatgaggaggaggacaaggaggcggcacagctgcgggaggagcggctacggcagtacgcggagaaggccaagaagcctgcattagtggccaagtcctccatcctgctggatgtcaagccttgggacgatgagacggacatggcccagctggaggcctgt

SEQ ID NO: 91024 - DNA, 1001 bp, Homo sapiens
tatacctgtgccgggttgaggggttggagacacgtttagagacccctccactctaggaatccacctcgagagataaaggtcccggccctagccacacccccaggacacggccagaggccacctccctaggcgggtccctccccaccgccaggttcctggagcgcgtgcggcgcgtgtgcaggggtagggggccgcaggcgcgcggactggagaggcgcgcccctcccgcgtgttgaaattcaaaagaggcgaacggcccccggcgcggcggcgcggctccggtggagaggtcaaggcaggggccagtcggaggctcccggggcggggtcgaacccgcggccaacctgagcagcagcggaagcttaaagagctcaggttcccgccccccggccctaccatggctacagagcagtggttcgaggggtcgctccccctggaccctggagaaacaccgcctccagacgccttggaacctgggacgccgccctgcggagacccctccaggtcgacgccccctggcaggcctgggaacccatctgagccggatcctgaagatgccgaggggcggctggctgaggcccgggcctccacgtcttcccccaaacctctggtcccccggcctgggccagcacctccccgcctatccctggacactttgttcagccccatcacccaacagctgcgctacctactgaagaaggcagatgatttccagagctacttgctctacaggtgatgctggacagggtcccaggtccccatgggtaaggagacttggaggggaggcgacaggatgggtgacacacaccagggtcgcaaaattacaagcgctaggagccagagggagacagtggaagaagctagcatattagaatccagtttaagagaatgaggaagactgtagaattgcgggtaggggatggctgctattactgtcgtggcagtgtgggcctggggttgtcaagtctctaggactttttctcccagtttttaagtgctgt

SEQ ID NO: 91025 - DNA, 1032 bp, Homo sapiens
ggctgagcgcccagcctcacccctgccccagcccattccggcccccatctcacccaagatcccccagagtccaggagctggacggggacaccctcagccctcataacagattccaaggagagggcaccctcttgtccttatctttgccccttgtgtctgtctcacacacatctgctcctcagcacgtcggtgtggggaggggattgctccttaaaccccaggtggctgaccctccccacccagtccaggacattttaggaaaaaaaaaatgaaatgtggggggcttctcatctccccaagatcctcttccgttcagccagatgtttcctgtataaatgtttggatctgcctgtttattttggtgggtggtctttcctccctcccctaccacccatgccccccttctcagtctgcccctggcctccagcccctaggggactagctgggttggggttcctcgggccttttctctcctccctcttttctttctgttgattgtcgctccagctggctgtattgctttttaatattgcaccgaaggttttttaaataaaattttaaaaaaagaaaaagggaaaaaaaagccacggagtccattttatgaatggggtggggagagggcactaaagagcctcctaagagagcctcaggttaggacagaattgtttggggagggagaaaaacagaaacaatgaattatagctgcctcacagccatgtataacaataattgctccaggaaggtgggaatatttgcttttttttcttctgtaatctcaccgtgtccgtgtccagaacagagctaggcacacagcaggtgctcaatttttgtttttcgtttagacaggtttcattctttcacccaggctggagtgcagtggtgctatcatagctcattgtagcctcaaactcctgggctgaagtgatcctcccacctcagcctcctgagtagctgggactacaggtgcactctgccatgccgggctaacttttaaaaatttttgtccgggcacagtggctcatgcctgtaatc

SEQ ID NO: 91026 - DNA, 1241 bp, Homo sapiens
gggacaggcccggacgggcgccgccggccgccagcgcccgcccgtctcgcagcaaggtgagcgcgccggggagcgggggcgccgcgcggtgggcaggtgcgggcgaagttggtggcgggggcgcgagtcccgggaggaactgggtggcgggtggctggggctttgcgcgcgtttcctgcgggctcggtgcgtggtgaccttggcaagtgattgaatctcccggagcctcagtttcctccgctgtaaacgcggtttaataacagtagcgaccccttggggttgttgagcgagtttagtaagatttggttgtcgagggctttagttaacacagagcctggcacggagtgaatgcgtaaaagttagtccgtattgttcttaaaggtggaatcggttcctcctccccaccgcccggacgccacagtcagggtctgggattagaacagctactaattttgcatgcttctctcctcggctccagagaggtggagaagagcgagtacttgagaaagaagaggaagaagatgatgatgaagatgaagatgaagaagatgatgtgtcagagggctctgaagtgcccgagagtgaccgtcctgcaggtgcccagcaccaccagcttaacggcgagcggggacctcagagtgccaaggagagggtcaaggagtggaccccctgcggaccgcaccagggccaggatgaagggcgggggccagccccgggcagcggcacccgccaggtgttctccatggcagccatgaacaaggaagggggaacaggtaaggatccctctgggtggggaagagtgctaggtggagaggaactcagcccgaagacaaagccaaagacaggtgtttttttccttcccagcttctgttgccaccgggccagactccccgtcccccgtgcctttgcccccaggcaaaccagccctacctggggccgacgggaccccctttggctgtccgtaagttggggtattggagacatgggggtgctgctcaggtgtgtggtacagccagagagacatccgtgttcactggtgtctgtttgttttgatgcagtcccgggcgcaaagagaagccatctgatcccgtcgagtggaccgtgatggatgtcgtcgaatattttactgaggctggattcccggagcaggcgacagctttccaagagcaggtgagtttccagcccaggactacacactgacagacacagagggcctccctgggatgtgccctgatcccggc

SEQ ID NO: 91027 - DNA, 1006 bp, Homo sapiens
gtcagtgcctgtcaaggctccagtcctgctgagccaaaggctttgtcattcctttctcttcctgtacatctgagcagacccactccagctttctggtgtcacaggcgggaatgttagttagtaggtagacttagatcccatttctgtcctgctcccaggaagattcttaggtcctcttcaatccagcagcccctcccagaggtgtgatcagcaggatgctgaggaaccatgttgcctttcctgtcaatcacagccaccttcctgttatctcctaaatggatctggcttttcctggaggctgccatggttggaagatggtatcagagggcctgcctgggcagtctgtctccgggccagggtcagggaccctctgcctctggcagccttaacctgtcctctgctaggaccagggtgatttcaagccagggaagcaactgggaccctgaaaactgtccctccccagcccgctccccctctctgtgccctggtccccttgctgccatgtggatgctgttgtgattgctgtttgtatattatcaaaatgtttttatattaaaaatgtttggtctgaaaattaaaagcacttcatttagaatgattgtttgtgcttttgtctctggtggactgaagcaactttgtccactctcccccagaagtggcctcttgccctgtccagtgggttggctgtcccacgtcttctttccagcttcctactccagtcttaattggttctacagttgtattccagactgaggttccaggaggggtttttctttgtcaaaacttaaaccagctgtcctgcagatagattataatgagtgatttttcagactttgcccttgacccacaggaaattaacatcgtgatcccaacacacaaacagcaatgcttttattaaattttactaaaccttaccatgtatctatccatccagaggcggagtggtcagccatttccccatagttcacagaaaggctctgactctccctccctggaactgtggttg

SEQ ID NO: 91028 - DNA, 1763 bp, Homo sapiens
cattgccgtttccccagaggtggcccctccacctctgctctgacctctccccatctctctgcccctccttttctcacaagtgccatgagttttcaaacatcttcgggtctcagcctgctgctgccatgaactttgttgggttaagggggaggggctctaggaaggaactggggggaaggggacaggtaggtggctggagggaccctttttgctgctagaaagcccctcccttctcccggggagctggggctggcttgtccccatcaattaggggagaaggggtcagaccaaagatggtggtttgtcccgtgtaagggaacaggtgtggggaagaggtggggttgggttccaactctggctttttctggtagaaaggcctaacccattacaccagaagaccatgggtgaagtctagatggggaggagaagtgaggccagggacagtcttgccagacgactctgaggagggcaagggacagttccatggcccttcccggactgcactaggctgggagctctgttgtgtggaggggtggtcagaggtctgtgaagagcgggcaggaggcatgagcaggcgaggagctggcctgtcccgggaagcagcccagcctgtggctgcccccgacaccaggaggagggccaggagagttccagggggctgaggcacacagagaggccaacttcctccctgcccagccttccttgtatctctccagactcggacaatcaaagggagagagggtgtatcgggtcctgttccagccggcatcgccgggtggcttccaggcctcagagctgtgtggcagggccccctgctggggctggacatcactgcagtccagtgcaaagccgcccccagagcccaggtgtccccccaacctaaccagacctggtgccttgacgcccccaccccagctgggacggtacagagaagggtcttggtttcctctcctactcccttccttaggctcctgaactcgtttgctcctaaatcttgttaattctttttctctggattttggtttcttttggctttcccttgccttcccctttctctgtctccaacactctttccccatgtctttctggctgtctctatgttcctcttctcttatcctcaactttctgtccattcgggcctcctccccacctcccacgccccagcccctccctccttggtctccttttcgatatgccaaaccaattttgggtcgagtgcatttaacgagaacaaaacaaaaggctcataacaacaagaacgtttcagaaaaaaacaaaaagttttaaaaaaattgttgagtcaaaaagtcaaacaataaagaaattaagatttcttggaatgacaagagtggtgtgacttcttgagtgggggagtaagaaatgggtgaatagctgggcgcggtggctcaggcctgtaatcccagcattttgggaggccgaggtgggtggatcacttgaggccaggagtttgagactagcctagtcaacatggtgaaaccccatctctactaaaaagacaaaattagctgggcgtggtggcaagcacctgtggtcccagctacttgggaggctaaggcaggagaattgcttgaacccggctgggaggcagaggttgcagtaagccaagatcgtaccactgcactccagcctgggctatagagtgaaattctgtctcaaaaaagaaagaaagaaatggttgagcagatctgcacaggggcgtccccatgggctctggtctgcactcgagcattcagaacccctgg

SEQ ID NO: 91029 - DNA, 2665 bp, Homo sapiens
ctaacagcatccaacagcttgcatatttatattttcatctatgttctgtctctgtctactgaaatataagctctcagaggtagggatttgtgtctgttgtgttccataccttccctgaggcctaaattgtgcctggcacatagcggatgctcaataatgctctgttgattttatgaatgaatgaaaaactgtcagaggaggtggagaagaggatgggcctgagtaagaagagagtgaaacctgatcggctggctgttgggggacaggggacatcaaggcttccgtggcctgcaagtcgctgaacaggggaacacagtcattggaagctcggtctccggcctcccaaggctgcctgtcttgtgaccagccctgtgggagactggatcacagaggaggccagtgtcccagccagctgactgtcctccacctcccaggtgcacaaggagtacagcaagtgcctgcgtcactcctactgctgcatccgctccccacccgggggcactcacggatccctcaagacctcagccatgcgaagcaacacccgctactacacagggacccaggtatcgggccagacaggactccctggggctgagtgttggaacctggagcctgagaggtggggagtggcttggcctaggtttctgatcgtgatgatcaggtgagcagtctcagaaagacgccagagggtgggtggcccaaggatcccctcacatttgggttgtgttcccagagccgaattcggaggatgtggaatgacactgtgaggaaacagacggagtcctccttcatggcgggtgacatcaacagcacccccaccctgaaccgaggtgagaaggcatccttctgcctctggcttcagtctctggaggctcccggctgccttgtgacctctgatcctttggccaggtaccatggggaaccacctgctgaccaaccccgtgctgcagccccgtgggggcaccagtccctacaacaccctcatcgccgagtcagtgggcttcaatccctcctcgccccctgtcttcaactccccaggtgagagcacgggggaaacatcccaggttgggaaatggagggtttgtgtcccaagggacctctgcatgggatgttctgtgccccagaactggagcctggacttgcatttcgagctcatccttgccttttctcttctctcttctggctgccacctgcagggagctaccgggaacccagtaagtgtgactcttccctggggatgtttctgaggctgggagagggacagacagtggccttctcagacggcctcacttaaggaggagaactcgggatgcctccccatgcccacatttccccaccccccgacacacagcctctggcagccgaatggaggataatggatggtgttcattgagtttgggctgttaagtgctgagggtctgagcacaggaaagcgatcctgttgcccaggcctcctcacactgctgagattctgaacctccagctggggatgagatcctgggggaactggtccttgtcccccacctttcatcaatacgctgctgggctggtgtgtctagtgccagtgagggagaaagggaatgtgagatcagagatccagggggcagggggaagcctacggaaaaccagcaggaatcaagcccacttctccacatggaccgcaccccctcactgtcccctagtgcatccagggcccctcttcaacctgaccagcccctttctgccctgcagagcaccccttgggaggccgggaagcctgtggcatggacaccctgcccctgaacggcaacttcaataacagttactccttgcgaagtggggatttccctcccggggatgggggccctgagccgccccgaggccggaacctagccgatgcggcggcctttgagaagatgatcatctcagagctggtgcacaacaacctgcgggggagcagcagcgcggccaagggccctccaccgcctgagccccctgtgccacctgtgccagggggcgggggcgaggaagaggcgggcgggcccgggggtgctgaccgggccgagattgaacttctctataaggccctggaggagcctctgctgctgccccgggcccagtcggtgctgtaccagagcgatctggacgagtcggagagctgcacggccgaggacggcgccaccagccggcccctctcctcccctcctggccgggactccctctatgccagcggggccaacctgcgggactcaccctcctacccggacagcagccctgaggggcccagtgaggccctgcccccaccccctcccgcaccccccggcccccccgaaatctactacacctcgcgcccgccagccctggtggcccggaatcccctgcagggctactaccaggtgcggcgtcctagccacgagggctacctggcagccccaggccttgaggggccagggcccgatggggacgggcagatgcagctggtcaccagtctctgagggcacctcatggaccaggggctggtggcccaggccagggagggaaccctgggcagggctctggtgggagagggagacagatggaggcagtggctggtgggccactctctccaggtgcccctcagccatgggccctacagtcccctcaggggactctaacctgggggcctgaggtgccagggttcacagac

SEQ ID NO: 91030 - DNA, 4183 bp, Homo sapiens
gcaggaattgcctccttccagtgtctaccagccttggggctctggaacccccggggccctgacctcagcaactgcacctccccctgggtcaaccaggtggcccagaaggtaccagccaccacccctcgcaggcaggcacatgtgctcgggcccagggcccagggcccagcgggggtcgtggagcagctggggagacatgggctggcaggtctggaaggcaggactgtggggtcacctccctggcctacaaagggagcagggacagatggggtgggaaggggcagatggcgatggggaagtggagagagagataggagaggctgcacaggccagggaagccggggagggcaggatggtccctgacagtcctgggattcccccttcccgcccccacctcatgcagatcaagagtggggagaacgcggccaacatcgccagcgagctggcccgacacacccggggctccatctacgcgggggacgtctcctcctctgtgaagctgatggagcagctgctggacatcctggatgcccagctgcaggccctgcggcccatcgagcgcgagtcagccggcaagaactacaacaaggtggggcctggcggtggcgctgacctggtatggggagggcgcctgcccccaggggcttgggaagtacctgacctggtacctcccagccaggctgccacctccactcctttcctcagagaggaaggacccccccctctccgccaaggactgccgggtctcactcctgtgctgccccggatggtcctgggggttggggatccctgaggaatgtcttgctgatagcccagccctgggtcagtggtaaccgcagacgagagagctatccagatgtgacagtattagggtgagggaaccggcacccagaggcctggcctgacatcacctccatctctttctagatgcacaagcgagagagaacttgtaaggattatatcaaggtgagacccagggggtcccagtgtaaggaccgtgggctccagctgatggggggattaggggtggaggttgagaagagggcatgcagagcccacccccaggaattagagggtgttggggggctcacagcaccatgccctctgcctgtgcaggccgtggtggagacagtggacaatctgctccggccagaagctctggagtcctggaaggacatgaatgccacggagcaggtgcacacggccaccatgctcctcgacgtcctggaggagggcgccttcctgctggccgacaatgtcagggagcctgcccgcttcctggctgccaaggagaacgtgggtgagtgccacagtcacccagggcaaactcagatacgaaccttaaaccacggggttctggcctggaggccacaggggggctatccgacccttgggcatcttgccagagtctcgttctgcagcctgagcccctggactgggaacagaccccaactgtgtatgccttgccttcccctgtccccacagtcctggaggtcacagtcctgaacacagagggccaggtgcaggagctggtgttcccccaggaggagtacccgagaaagaactccatccagctgtctgccaaaaccatcaagcagaacagccgcaatggtcagtgtccccggcggggcctcgggtggggaagcagccccacccccaccccccagctctgtgccagcgtctctgtgccatttgtagagggcagcggtgctgaccttttctcatgctagtgtaaaatttgaggggattcatgggccctgaagtgctgcagagccctaagggtgagccttacagttgcaaagctggctcctgggcctcacagctcagagaggatggggccattgagatgaaggctcagagaggtcaggggcttgcccaaggtcacacagtgagaatgggtgggtcggaggcccagcttgtgtgtcctggcacactgccctgctgtttagaactgccttcagctgagcagtggtcttgtggacagggctccctgacccccacctgcctgggctatggactggcttcagaggtcccagtggccagcgtggccaagggctgaggagctggctgagctgggaagccaggggcctggatggaggtgcgccagctgaggatgctgacacatccaaacgtgcctgttctcaccaggggtggtcaaagttgtcttcatcctctacaacaacctgggcctcttcctgtccacggagaatgccacagtgaagctggccggcgaagcaggcccgggtggccctgggggcgcctctctagtggtgaactcacaggtcatcgcagcatccatcaacaaggagtccagccgcgtcttcctcatggaccctgtcatcttcaccgtggcccacctggaggtgagctgagccgtccccctccctccatgggggtccctgtaccctctgtgttcccaggctgtgtacctgcccctccatgtgctcacctccagaacaagttatgggttcttccactttagagcttgggccatttgtccccagagctctcagaatgtcaactggagccccagaccccaggcacttctttgatacttggtaccatccctgttgccaggtgtggggggtcggaatgggactccccggttctgactctagttatgacaccctggtgccaccacacaacaggacaagaaccacttcaatgctaactgctccttctggaactactcggagcgttccatgctgggctactggtcgacccaaggctgccgcctggtggagtccaacaagacccataccacgtgtgcctgcagccacctcaccaacttcgctgtgctcatggctcaccgtgagatcgtaagctggctggtgctctgctcctccaggcaggcccgattgctggcctggctttgcatggcatcctagagagatcacgggcagtaccaggggaggctagccccatgggtgtggggggcccctggtcttgcctggggcatgaggccatgcgtctggtcctctatggccatgatcccaccgtctcccaaggcactctggagaagcaagttggtgttacgttggtcatctctccacaagccttccagagcatgaggaagtgagcgcattgctgcgtgcagaggggtgagggctgccaggttggcggcaccagaggtcctcacggcccatggccttgcccagggccctgtctgtggctggcacctggctgagcccagcgtgcaaaaccaaaggccctgagcgtgccccctgttcctgtccccagtaccagggccgcatcaacgagctgctgctgtcggtcatcacctgggtgggcattgtgatctccctggtctgcttggccatctgcatctccaccttctgcttcctgcgggggctgcagaccgaccgcaacaccatccacaagaacctgtgcatcaacctcttcctggctgagctgctcttcctggtcgggatcgacaagactcagtatgaggtgggctgggactctagggcaggtgacggccagcgcctgggggccgggagaagaagggggacacctgtccaggcagcagcccctcaccctcagtgctccccgcagattgcctgccccatcttcgccggcctgctgcactatttcttcctggctgccttctcctggctgtgcctggagggcgtgcacctctacctgctactagtggaggtgtttgagagcgagtattcccgcaccaagtactactacctgggtggctactgcttcccggccctggtggtgggcatcgcggctgccattgactaccgcagctacggcaccgagaaggcgtgagtttccacctcccagccctgcaccctcccacctggttccctgctgggcggcaccccttggaccaggaccctcagggcggtagtcccttcctcctcctgatcccagaggctgcagcctgcagagtcctaggccttcatgagtcgctgggaatggctcctcggcttctctctataccccggccctgtttcctttacagctgctggctccgagtggacaattacttcatctggagtttcatcgggccagtctccttcgttatcgtggtgagttgggaggtgacacccctagcaccacatcttccttcatccaggctggccttgaccccagcccctgcccccgccccccaccccccccacacacacacacactctctctctctccacacatcggaactgagccaccg

SEQ ID NO: 91031 - DNA, 8804 bp, Homo sapiens
cacttttaaacaaccagatctcaacagcacggaggggatggtgataaaccattcattagaaactgcccccatgatccaatcacctcccaccaggccccacctccaacactggagatcacaattcaacatgagatttgggtatggacacagatccaaactatatcacttggtttccagctccactgccccttcccaatttgggggtgtctatgacaccatgaccctggagcatgcacccccacccccgccaccccgtctatgtgtttctttcccaatgccctgtttctcctctgaaggtgtaacaaccgcacccagtgcgtggtggtcgccggctcggatgcctttcctgacccctgtcctgggacctacaagtacctggaggtgcagtacgactgtgtcccctacagtgagtcatcttgttccttgtgcggatgcgggcccttctcgcatgagtgagtgaggaggagacaccttgacccatcacacatgtgcacacatgcatggggcctgggcacagtggggacagccgggcctgctctctccaacacacattctctaatcccagacaccagtgtccacactcagtgcctgctcccccgcctcacagactctgtcccctcctgtggggacaccttctccagctctccttaccccagcccactcaccctgcttcttcatgcaccctatactcatttccacactgccaggccatggtcccgtgctctgcctggcacacttacgtctctctcttctcccttggcctctatgcttttctcccccatctgcctccctcgccttctcacatcccttccttttctgactcttctgaccttttctgacccttctcatctaccttctcttccctctcacttaccccactgcccctctcaacaccgttctctcagcaccctcactccccacacacttcttcccaatcatggaagctggactctacacccatagagtgggataccatcctctgaggcctggtggcagattcagggtgaagggctggggggcattttcaacagattcatagctcctcactggtctccccattaccatgtggcacttcctgtctgcaaaggaaatgccgccatgttggactgagggtggcctccaggcagcctgaagaaagtgatttggggagccaggagcctggccatcttgcacctggccaaagggatcagacaaagacaaggtctctcctcctcagcaccccacccttgacatcacctttttcctgccctctctcctccctccctccttcccattatcccttcccttctcctcccacaatgggttccatgtagtcaacctggtggtagggcctccgggaagagtggggagaaggcagggccatcagggtgtctgagtgtggcgggccgggtttggggactaagaggccctgtaactctccctcctctcccctcccaccccaaccttccctgccagcctttgatttctcctcacaggtgactcgatgctggggaaacaggatcccttctgtgcttccgtaattttcttcttttactcttcgtcctttcctttcagcgcttgaggccttcagccaccaccgagggggatgcccatctgctccttgaagcctccccacagcactggggacacggctgactcccgcggctgggacagcggggaaggggggtgggaggcagcgagctcagcacaggggggcagtcagatgggtgtaggttcaaggctcgactgggctcttgagttttctggctctgaaaccttgagcaaatgatttaatttctctgggccactacggaaggaggtgtgagtccatgagatgacatgtgagaagcgcttggcccagggccggccacaaagtcgctcctggtggcagggttttgagtgccgagtgtaaacttcccaagggcagaggcttcgtcttcacccgccgccccagcgcccagacccatgcctggttcaggatgtgctcagtaatattaccaatgccctttaagccagctgagcctgtttattcatctgtgatggggtggagaggggtcaaaagccttccctgggaagccacaaggagtagcgacaacgcatgtcaagcttgtgtgcacccgagctgtagatgcaaaggaaatggtgcctgctttcgccagccatgtggcctcacttcagtgtgcctcagttttcccatctgtagacagggttctcaaaagacggccagtgaggtgcgtagcatagttgctggcccctcgtgagtgctggacacttggtagtcgttgcttttgttgcagctccttgtaatgcctcttgtcaattacgattattgctgtggtaatcaaaattaaaataacaacggataatgacccaacttctcccgaggcaggtgagataaagggcaggaaaaattcctcggtccaggtggaagccaaagcaagtagacgagaggctcaggtcaagccgcaggaaagaagctaggggaggagaggagctgagaaacctcctggagccgaggccctgagcgtggtccaggggctacaaccgacagagaccaggcaggctccagggacagagggcaggacagttcagaggatgagtggctgcctgtctgatggaagagagatagcctgagcccttggggagacaggagacacacgcacacacacacacgcgcagacatgtgtgcacacatacggggtggatgttgggggcagagctaactcctgatgctccagaggaaggaggctggagttaaagcggggacaggaggtagctagaggacagggaggccaggcactcacttgtccccaaaatgttcactgagcatctcctgagtgccaggccctgggtgaggcgctgggaagggaggcagaggctgcccctgcggagctccctgctggaaccttcagagaggggccaggagagccagtccctccagtcagaagttcctgaggggccagggatgcagagggggagcggcctgggcagccacctggcccagggcttcagaggctgggggtgaccccagtgctggtgagggtgggtcaggggtgggtggcagggggcacgtgatgtgtgggaaccctcccacacagtggacaagcccgactaatgctggatttgctttgcagctgagcacagtctaaccgcgccccttcctcccctaggtgccgcccgtccgcagggcagcgggcagggcggagctcccagctcctgggcccccgggccctgggtgggttgagcagagaagccgagcctcagacttgcccctggggagcctgggagcgtgtctgtgcccccacttgctgtcccacccagtctgtgtcccccacccccgccacctctctgcctccgtctccccaaccctggctctctctggggcccgggtgcaactgcccgtctgcctgtcgttctgtgtctggctctgccaccttctctctgtgtttgcttcttctgggttgtgagggcttgggggaagtcagctggacctgggtgaggccagcataaaggggaaggagttcagcctgtttcttggctgagggtgggcccaggccctgggagacactgaaatccttcccctggggcccctggttctagcaggagggcagcaggcagggtgggaagggagccgagtggcttatccaccccaccactccctggtgccccctctgaccggagcccacctcccagctggggctccctactccctgcccccgccttgcaccaagggtgccccctcccacctgagggctctgtctgcctgcctgtacccccctaccacccctgtgtctttctgtgtcttctccctcctgtgtgtgtccccctcgtccctctgactgtctccccagcaccctctcaccccacctgaccacccccagaggaagggacctgggggcgggggcccgagctgatgctacggaaggggttggggaagcaggagcgaggaaggaaaggaaaagggggcgtgttgccagaaaagaaacgaaagcaatttaatctctttttttttctctttttttcttgcacattttttttttcaatttgttttctctctctcttccgatgcttaaagtagaagtggagcagaaaggtaaacgcactgttaccaatgctaacccctaactcacactttgttctacctgtaccatacttatgtgacctgccctcccccggccccttcttctctccccaacccacacttggtccggtcggtatcccccaccctgggttgtcctcccagtgggaccagccctggtgcggccacgggcatctccaccctccagatacccacggaagctcctctctgagcttgggcaggattttctctctctcgctgtttctgtctctctctgtccctccttcctggtccctggccctttcgggggacctggccttttctcatacttcttttgcctccttcaggagaagtgtataagcatccagggcgggtggggagggagggactcccttccccggctcccccactggggcaccgggtgagctgtctctctctctctctctctttctctctctctctctctctgtctctcccctctctcttcctccttcccctgtaccttttataacatgtttctggttcatgggaggcgggctggaggggacaccattgttttccttttggggagcagattctcctatgtctcgggctcctggtggcttaagttccttctggtttgatgtttccaaggcccagagctgttttggagcatggagcaccagtcctccccacccccaacctgatccccatctctgaccagctgggggcccagccctggggaggggtgtcagctgtccccagccctgggagggggcagcctgccaaaaaatgaaaaaatgagggcgagggggcgggggcgggcctcgtggttgggggagcgaagggtgggggagcgtgttctctgtttctttcacacttgcaaagctgcagtcagggtttcttctgggctgttgtggttagaggaccagggagatgggcggcgggcggcgggggcacagtctggggacttccacagactccgtaatttctagcagagaactccctagtggatggggctggccattactggctgttattggggggagcggaggtgctgctgctgaggggcttctagggtgagatgttagggatgaccatttcctctccagaaagttttgggaaatttacccatctgaggccggcagcagcaggcagggctggaggacatggcctttagggatcccttttgccttgaaattacagtggtctgtggagcatcccttccgaaggaggtggggcagggtccctctgagctgctcccctccccgtcttcccctctcccccatctcagagaggcctgggctgctggccccaggtccgccccctcaccacacccctccagtctcctctctttctcctggagtctctctccctcccagcaccagccactcttcttgcaggcccactggtttggatgcggcaccactggagattttctcttcgagggccagggcagggcgggtggggtgacggggcaagggagggaagaggagggattgggagtttggtgctggtgaagggtccttgctgtccaaggccccagacagacccttcctcatcttctcccccttcccctgggttgacctctaaccacatttttcccccctgacaccctctgagcaggttaggctctgaggcctcccaccgtccccttcacacaaacacgtcccctcagatgccacacacctggtgggggtggggaccggcttgggcagaggccagtgtgctggacagagtgggcaggccgacccctcagggcatcagggacagggggatggccagtccccagggcccaagccagggtcgttttggctcctgcccagctctatgtcccaggctcctctccctctacaaaaactacatcctggctgctttgtgccagggggcccctgagccacattgttcccatgctgtgaagggagtgctgcctgtccccctccctcccaagcctgctggaggtggggaatgaggactagcccaagcccctcttgccactggggctgccccccaagccggtgccaggtcccagccccccgatcccctcggggccagctgctttggtgacatgccaagcaagagcagagaattcactgcaaaccctccaccctcgccctgtgccctcgccctggcctatgtgtgggttctgccagccaggaggtgagggaggcccggccatcctggatggaggggcgcactctgggaggaggtggggtgtctggccacactgacccccggatcagtcaaggggaggttaggagtaggtggtgctgggacgtgactgggcaagggtgggccggccagcagtggccaacgagatgcagttgaggttttcctccttttcagggattgggggggtggggcggggccccccacctttctgacatcagcgctgccttggtccctcttcccgagccggggatggtcgcaggtaaatcggggtccgggccaggggaggtggggggcctggctggggcgggctgggtctttatcctagcgcctggttccctcccctgccccctccgagctggacctgggactgcccccctgagggaccctcagtcgggcctgggccttggagtgaattctctgctcacccctctctcctccgccagcactaaccctttcttcccaggtggtttgcagcgcagcctcccacggagccaggacctcgccaagccccatacgcccttgtctctcttccctctgcacagctctcctctccctccccaactctcccgggagccctgtccctctccatgtccccacccccacccctgtgcacagtgccactgtctgctgctgagccagaccccatgagagaccctgccggctgggggcagggctgggcgccctccaggaggggccagactctttcattccccgtcctagcctgggagctgcctctgggaatcccttcctcggctactgacttcgtgggtactgggtggggggtggggagcaggctgcatcaggaacctggggagagagttgaaacccctatcctggaatagggagacactcctgacacccacagtgggtatggaaacaccactctaccttgcaatttttgcaggaggaagaaagaggagttaaaaaaaaaaacactgtccgggtgtggttggtgaaggatgggatcctggaccctagctcttccctaagtggcagagaagagggagaaggggccgggtgctgagtccctggaccgtcaaagtcaggagtgactgtagcggggagattctgcccccacttaaatcacacaggaccacctctgggagggctcttgccaaactcctccccagcctgtggggtctctagcagccagggaagggaagaggggcaccacttcccctcactaaccccgctcttaatggccttcagggttcacatttccagggagaggggcagctgggcagggcgtggggagggggtcgggtcccagcccggaaacccccttcccatcaccagccataccaagcaaccgtgactgcagcagcaggaggggacaacctggctccccaccagcagcgtgaccaacttgcctctctcccccctctctctctctctctctctctctctctctctcctccctctcgcctctgccccttctctcctacctcctcccctcccgcccactctgcccagtcttcgtgtgcccagggaccctgcagaaggtgctggagcccacctcgacacacgagtcagagcaccagtctggcgcatggtgcaaggacccgctgcaggcgggtgaccgcatctacgtgatgccctggatcccctaccgcacggacacactgactgagtatgcctcgtgggaggactacgtggccgcccgccacaccaccacctaccgcctgcccaaccgcgtggatggcacaggctttgtggtctacgatggtgccgtcttctacaacaaggagcgcacgcgcaacatcgtcaagtatgacctacggacgcgcatcaagagcggggagacggtcatcaataccgccaactaccatgacacctcgccctaccgctggggcggaaagaccgacattgacctggcggtggacgagaacgggctgtgggtcatctacgccactgagggcaacaacgggcggctggtggtgagccagctgaacccctacacactgcgctttgagggcacgtgggagacgggttacgacaagcgctcggcatccaacgccttcatggtgtgtggggtcctgtacgtcctgcgttccgtgtacgtggatgatgacagcgaggcggctggcaaccgcgtggactatgccttcaacaccaatgccaaccgcgaggagcctgtcagcctcaccttccccaacccctaccagttcatctcctccgttgactacaaccctcgcgacaaccagctgtacgtctggaacaactatttcgtggtgcgctacagcctggagttcgggccgcccgaccccagtgctggtgaggacgactcacttccaggcatggagcctgcttgcctttgtcccctccacccccacccacccctgggtcccagagtggggagccccatcctgtgagctcttggggatcgggaggtaaaggaaattcacagcatgtgacagacgctgttctaagcacttcacagtcattaactcgtctcctcacggtctatgacacagggatccttactgccctgttttacagatgacactgaggctctgtgtgggtaggggattaagttatttgaggatttgaacccagcctcccaaccactgaactgcagtgcctctcccaggggcct

SEQ ID NO: 91032 - DNA, 1077 bp, Homo sapiens
acaagtgtgtgcctctgtgcctggccaaaattgcccgtttttataaggaccacagtcatattggattggggcctaccctaatagcctcatttgaatttatctctataaagaccttatctccaaataatgtcacattttcaggtcctgggggttaggacttcagcatatgaattttcaggggaacacagttcaatccataacagcatatctggtgtagcccgaggaccccaggaaaacagtcactcttatcaagcagagcattccaaaggctcagacgtcacttcctaggagctgagagtccaggcactctctgggccaggttaatgtcctcactacacaagtgggcacactgagaggcccattctacagctgaatcaactgaggctgcctcagctggcttccaggacacagccgagccagaggtggtgttttcttggcagtgggtagggtcttcccttcctggcccaggcccaggagtgacaccatccccaaccctccctgcaggcctgagccgggccgggctcccgttcgggctgatgcgccgggagctggcgtgtgaaggctaccccatcgagctgcggtgccccggcagcgacgtcatcatggtggagaatgccaactacgggcgcacggacgacaagatttgcgatgctgaccctttccagatggagaatgtgcagtgctacctgccggacgccttcaagatcatgtcacagaggtgagtgggctctcgtggcagttcctggatgaagtgcccgcctaaaagcactgcacacctgccagcacacccgttcaccttacatcttttttttatgcattcaacacatgtttactgagcacttaataggtgctgggccccatgcagacgagaataagacccagtacatctccccacagccagcctgtgcccccgacagaggcctatacccatacatacactgggaagtccctccccccaccagcctcttgcttccataacttccatcccaagattagccagggcagtttgtttgtttgtttttgagatggagtcttactctgttaccaggctggagcgtggtggcatctcagctcact

SEQ ID NO: 91033 - DNA, 1789 bp, Homo sapiens
ttgggaggacactcattacctccttgctcatggtgaggatgcgagtaggggagatgagtgggcagggtcaggacaggggcatggggaagaggcttccagagggtccaaggcctgcctgggatctccccgtgagctgtcccaggaggttccagtggggaagagttggcagtctctttgcccagaggtgcccagatagctgggtctggctgctgggtgtaagggtggggggtgtggtgtgagctgcagaccccggagggggccctacagatagggctggctcgagggacgtgctggacctcagcctctcagagctactcagccaccagcaggaggagaggggagcggcctggaggccctatccccacctcagtctccctgtcctcccccaggctggtggtccaggccgtggtgcctgccaggtgatgtggggcaaagccccccgcacaggccactgagagctccggacacgcacccggctgccaccatggcccgcctagccgcagtgctctggaatctgtgtgtcaccgccgtcctggtcacctcggccacccaaggtaggtgctgctggggccggggaggggccgcggctcccaaacccttctggggggggcagataaaatgttgaaaaccctcctgatcactcagtaaagaattacagccccctgccccgccccagacctcagctggagcaggccagtggaagactcaggggtaacacacaccccagtgccaccaagaggcccctggaccatcctcttacctccaacaagtcggctgggccaggttggtaggggccatcccgctgtggcccctgggaccaggacaggccttcttggtgagccgatgctcctctctctgtctctctctcgctctctctctctctctctctctctgtgattacatcttcgaggctctcactgggaagaaggcttaattaaagcatgcccgctgacgtttatttaaaaacaactaattacccggctcggccctatgccggccctaggatcctgcacacgccactattagtgccccaagcctgcccgcccaccctcaccgattactcgattactggccccgtgaccagcccaggccgggggcaagggcgggataaggtgagaggccaagagaagaggccagtaggcccggcccctcactctgggatgtgccccctgcccaccccgacatccctgtatgaagggcattggcgggtgactctgctccctctggccctgccctctggaaagctccaaaggttgaagggacacggttcagctgggccccagggccttggcactgccccgctggccagcaacctcactcctctgctgctacgttctctgcccatccaggtcctgccccatagccccagctgggccgggagggctgcctccacccccagacccatctgagccagccttccacccccggccctccctcccaagcccgggaaggctaaaattagatgaggaggcagatggtgctggaggaacacatgtgaaatgttccccccgctgggactcaactcaccccaaaaaaccccaagggcctccctgccatacccctggggtacccacccagatctctggaaaggctcagctctgtcaccgtcccgcacgagtgccctcccgaaacctcgtacagcaggtggtcacttccttcacctacaagcgacggtccccacattggggcatctgggtccctggctgaatccctgctgccctccagcaccccgcagggcctggctggaaccagcgtcacagaaggtgctgccccggccagcatggaccct

SEQ ID NO: 91034 - DNA, 1706 bp, Homo sapiens
tttgcagggggtcagggtaggtcactctgctggggtgaccttgcggctgagccctgaacaatgagcagccgcagccgacatgcagggatcctgcttggggactggaactggaatgttgaatgtttcaggaacaggagggaggacagaatggggcttggagagcttggtggcaccagttcacccacagcctctgggctctagtgaggaactgagaccccagcagagaccagggggtcagttaatgttcggatcaacatcatcatgtggtcccttagctctgagtgaagggcggattgggaggcgggcaaggaggccaggacaacatacaggtgacataggatggtgcatgggcctgggtgctgtgcttagagccagaagtgggcaggtcgcgaggtacttcagaggcagagcccacaggagttgctgatggcttccgtgagggggatgacagggaaggtgaggaatcaaggcagagtctcagctttgggatctgagattcattcaacaaataattaattcattgccacgtgccaggcctattctaaaagttgaggatatgaagacaacagtggtgatggcctcacgcagtaatcccagcactttgggatgttgaggcaggaggatctcttgaggccagaagttcatgttcagcctgggcaacatagcaagacctcatctttgcaaaataaaataaattagctggatgtgatggtgcatacctgtggtctcagctactagggaggccgaggcgggaggatcacttgagcctgggaggtggaggctgcagtgagccatgatttcaccactgcactccagcctgagtgacagagcaagaccctatctctaaaaaaataaaagtaaataaaagttggggatacggccaccatgagcaaaacagttcaatgatccctgccccatgaagaggacattctatacaccaggtgaatagttctatctgagcagaggcctgaaggagccagccatgtggacagtgggttggcagaagctacaggtggaggaagcaacaggtgcaaaggccctggggcaaggcctgctgtggtccaggaatagcaggagtggctggagcagaaatggggtcagggagctaactgggccaattacaagggttttggttttcagcagggaaatggtagtgggggctctgatgagagattccaggctggacataagagatttgaaagtgctggctcaatgatggtactgagagcccaggacagcctgagatgggacaggctgggatgacagctggatatgacagagcaggggttcccacgcttcagggcctgcctcagagaatgtgtgtttctggccagcacagtggctcacgcctgtaatcccagcactttgggagactgaggtgggaggatcatttgaggccaggagttcaagaccagcttgggcaacatagcaagatcctgtctctataagacattttaaaattagctgggcgtggtggcgagagcctgtggtcccagctactcgaaaggctgaagtaggagcatcacttgaacccaggatctggaggttgcagtgagccgtcattgtgccactgtactccagcctgggcaacagagcaagaccctgtctcttaaaaaaagaaagagagagagagaatgtgtgtttctaccaagttcctggcaaggctgatgccagtgtgctgggaccacacctggagaaccagggtg

SEQ ID NO: 91035 - DNA, 2803 bp, Homo sapiens
ctgtcaggaggagggggtgcagccgggcagcaccttctctccgtggtgccgggttaaagcacgggaggccggcaggtttgatccactcggattattcgtgctttgaggacagctccccacccccaccccaggtgcgcattggattgagctgcgagggtttggttgtcatcctcccatctgacggtcctgggacccgagtccaggcctgaagtggtggggtggggggatgctgtgtttgctccagccgtgtccagaaaatgccctcccaggtatctctccagtgcacccctggcccccatctgaagacagccgctggctacacacacccctgtctctacacttccagtccgggtcctcacactgccccatccctggccaacacctcactgtacctgcctggaccctttcttcctgttccaacccccatccacccccagccatgccagctgcgtgggtgtttctgtatcccagttccaggcagggcccccccttccgcctggcttccaccggactcagagctggggtctgtcttcccacatcccacttcccaacatgtgtgcctgggggcaggagggggaggggttcaaaatggctgccaagatggctggctcgcgcgctctctctctctctgtctgtctctctctctctctctctctctctctcactctctctgtctttctctatctctctctgtctttctctcttcccctctctgcttgcccggctcccttatcctggtagggagtcactgcttagaggaggtcggatccagtggggcacacctgagggtgaatgtctattccgggccgttgacctccatgctgtttggggacagaccattggtttctgcttctctctccaacaccccaagggctggcatgagtctaacctgaccccagaccccactccttcaccctggctcacagcctgaaagctccgtgccctccacctgctctccagggcctggccccctgaattgatcaaccccacggagggtccacacccctcattctcttctcctgtctgcccccggcaggggactctgcgtgggtccctgtcaggccccagctttggggggcaggtgacttctccttcctccctgctcccctcccactaatgccaaatttattacttaaaagtaggatgaaaacagggagaataagagaaggattacaaccttcattatcatatcgagaaaattatccgtgattttcctaactagcaatttgtctgccatgccgttcagaactgacttgcccattaattacagagatgaaaaatcatctggaattcggaaaagggaactaattccatggctggcagcgatcgcacccgtgcacggagccacatacgtgtgcgacatacgtgtgcgctcacatgtgggtcccggccctcctgctggtcttgccaccatcttcctacccagcttggtgacctccctcatggccccgctcggtccaccccatgtgtgtgtggcatctgctctgggacacccctgcaggccctctttctctccaaggggcgcccatctcaatccccacttctgggcgcttgcgtaccccgtgatcacccacgctgattcctgctcttgggggtgtagctggcgcccaggcttggggaggatggggagctggggaccagcacacctgggctgtggagcctgcagggagggggtggaagggggggactcgaagcccagcttctattcccagcctgcccaggggagccctttctcctggggggccttggaggaccctgtgggcacgttggggaggagcctacaggcgcctcagctgcacgggagtgtgtttgcatccagcagtttgggctcctggcgggtggcctctccacctgcatgtgaggctgtgtgacgcttgcatctcggggcgtctgcgtcctccctaccctgccaggctggtggcagagcatgtgttgcttcagccccagcgcaggcatctcggtggggagggtggcagtgggtgcccctcaagaggaacgggaggagtgggagcactgccatccccgccagagcatcgtctttgccctccaccccctcctttctccctggcgagacatgtggccaaggacacacaaggctctcgtttctgtgtgggttcctctcacggatctgatttccagatgccagacacttcccctcctccagcccctctgtggggaggcagggggaggggctcctgaggcgggggttccctgggtctgaaaccctgaccccagtgaccctgaaggtgccgtggcaagacagacagctcctcccaggctgggtttggggcaaagtggttgctattgggcaccctgatggaaggggagagacgggtcctggagtgaggtgggaggccaagtagaaacatggagggggtcccggtgtccccagaatccagatgtctgtctgtctgtctgcacctgtgcataggtgtcctctgcctgtgtggcctggatggtgatctagccaagggtgcatgtggccacgtgaccatcagactcatccggtgttcataaaggtccctcctgtgctggtgtttgtgttttgcagagggggtggtcatgctgggggaggcagggctgcaagaaggagtagctgtctgtgtgcacacatggggctgtctgcatcttttgtgcacctgcagttgtgtgctcaggacttcttggagcaaggctgggtgcaccttgtcatgcaatctgcacacacttgcctccccacccagcaccatgcagggggcgccatggggggtggtggccatgtcctgtcctcatggagctcacactctagcaacacatatggggt

SEQ ID NO: 91036 - DNA, 1005 bp, Homo sapiens
aacagcagcttctctcccggcttctgtttgggcaacttccaaggccccagatggaggcagctgggccctgtagcctcacggtgggagtagagaacccagctcagcccatgcagaggggatggggcacaaaggaaccctgcccagggccctgaggacctcaatccctcaattcctccttccccaacctcttctgtttattggattcctcctgatccttttctgggctccaagcctcagtttctctatctgtagaatgggcatcaacacagcccctgcctcctagagtggttctgagctttaaaggagttacctggggctttgggagttagagatgaatctgcctagatcctgtcctgccaggggaggtcattttgtggtctgttctgcaaagaggaactgggttctggccgagggaggaactagccaagccttgtggccagagaggaggaagaggggaatcctgacagaagtggggagtacgggcttgggctggggggtttcggccttggtttaacccagctggaaggagtgtggaggtgggagtggggatctctgccttccacccacctaaggggtactaaatttgaacacagtggctgagtggtccggggacctccaatctgcaccccaaacacccgccctctgaagctgtgctcataacagaccccaaaattcccctggaagcccctccagggttgaattggggcaaatgagtggtgagtcattccttcccttaggcccaggaagtgactcatgcccagccgttgtcctggtccccatccctctgcccgacaccccccttcaggtctccctggattattggggtccccagtattcccagatcggcagggactggacgtcccctcccagcccgccccaggccccacctgccgctcatatcccaacgccctccgttcccctgcccttcccctctgtttccatccaccctcctttctcatggttttctttcttcctcactgtttatctctctgtctctctgttctc

SEQ ID NO: 91037 - DNA, 1030 bp, Homo sapiens
acagggtgacagactctttggctttgagcatctgagtgggacatgacatctgctcactctgaacgaccgtcaggatctgagcctgagaggggtcagcatcctcctcccacaaagtgcatcacccttacgcctcctttcccaccctgggatcccctctgaccccctttcctttctctgttgcagcattctgtgtctggctgactctgccgggagctgaaacccaggactccaggggtgagtctgctgggaagcagaaagcacagtccacagccagagcctggggagggtcctggacccccgcccagcccccttcagcccagggaaagagagggctcgcgcacgagaaactcagcgccctgccccatctcccccagtgccccctttttgtgtattcccttacccctcaccttctgaccgtgctccctgctcttgcaggctgtgcccggtggtgccctcagaactcctcgtgtgtcaatgccaccgcctgtcgctgcaatccagggttcagctctttttctgagatcatcaccaccccgacggagacttgtgacggtacagaggcttgagggcagcgcaggggacatccgcgattatgaggcattgcccagccagtgggggacagaggttgttgtgaggggccacagccttaccttccagactatcatcatggccagagaaaagaaaaagagggcaggcgtggtggctcacgcctgtaatcccagcactttgggaggctgaggcgggcagatcgtttgaggccaggagtactcagaagactgaggggagaggattatttgagcccaagagtttgaggctgcagtgagctatgattgcaccactgcactctagcctgggcaacagaatgagatcgtgtctcagggagagggagaggaaggggaagagggagagggggagaggaaggggaagagggagaggggtagggggagggagaaggggaggggaagggggaaagggagggggatggggagggagagggggaggggaagggggaaggggaggggaaggggag

SEQ ID NO: 91038 - DNA, 1037 bp, Homo sapiens
tacaggcatgcaccaccatgcccagataatttttgtatttttagtagagacggggttttgccatcttggccaggctggtctcgaactcctgacctcaggggatccacctgcctcagcctcccaaaatgctgggattacaggcgtgagccactgcacccggccgccatggggtttaaatttctacaaagagactggggatggggatgtggagcttcctgtccatccctcacctcagcactgttcactgtgtccaaatctaagatgccagccagagaactaagatcaagtgtggtcttcaggaatggcttgctccagctgcagcatagcctgtgcagtgcaacttaagattttttccaaaagatactaagcagcaggccccatgttggggagtcaggatgggggtctctgccctgacagaactcacatctttgggaggtgactccctgtcctgttgtgttccagacatcaacgagtgtgcaacaccgtcgaaagtgtcatgcggaaaattctcggactgctggaacacagaggggagctacgactgcgtgtgcagcccgggatatgagcctgtttctggggcaaaaacattcaagaatgagagcgagaacacctgtcaaggtaagaaccaccccacgtcctctgactttccatccatgaggtttggggtcaccagagccattctggcagcatccagagagcagggccttggttgtagggtcagtgcctggcgtctgagatgggacaggtgcacatgtacctaccccaccaccccagagaggcagagtgatgtgaggattaagggctgactctgggaccagctgcctgggccaaatcctgataaccaagtgtatgacgttggccaggatacttattcagaaaccgctgtccacatgtgagatgtgataacgttatcatgcttgtaattccagtgctttgggaggctgaggcgggaggatctcttgaggccaggagttcaagaccagcccatagcaacatagcaagaccccacccctataaaaggggaggcgaaggcaggt

SEQ ID NO: 91039 - DNA, 1027 bp, Homo sapiens
ggaggcggctccagcctggactagccggcaagagacagcatcactggggaccatcgtcccaggcccgatcctctcctgtagtcagtcctggtctggaccactcaaggacagagatggaagcttgaaccccattcagcagggcccacaggtctctgtccctggtggaatgacaagggatgagaggacagatacatctgccacccctcacccatcggcacctgtgccctctctagccacaggcccccgctcacggccagttctgcttagatatggattctcaccaaatcctgctatttccatatccatagatcctttcctggggatcagaaaaaagcatctttgtagactcggggctgcctggctggacatcagcccccactgttcaccccagcctggtgcccactgtccgggcagccctagcctgtcccacatcatcccgcactctccccacccctgctattgccctgcatcgcgggggcactggcttagggaggggtcttggtccatgcccatgaagctgggctctcagagctagtgtggatgggagagcagcatcctgctagggccaccaggatgctgagaatttggccagcgagcggccgttctgtgggagtcaggccgagggccaccgttgggaaccaagacgtgtcctgcccaggcgcacggcatgtcccctgcatttggttctcaggaaggccccaccctggcctttgcccggaatccttaggctgggacacagatggctgggacaccccagcttggagctgcccaggaaggcagaggagaaggggaggacttggctgcttccagccacatctggacaacagaaggactgagccaccaccctcaccataggatgcctctgtgtggattggaaaagggaggagacagtggtgccttccagatgcttccgtgccaggaaacatggcggaccctcagccctgaaagctgctcacagctacgggcatccttcaccctctccttcctcttgcagatgtggacgaatgtcagcagaacccaaggctct

SEQ ID NO: 91040 - DNA, 1023 bp, Homo sapiens
cttctgtagtcccagctactcagaaagctgaggtgggaggatcgcttgagtctgggaggtggaggttgcagtgagctgattatgccactgcactcaagcctgggcaacagactgagaccctgtctcaaaaaaagaaagaaaaaagaacaggaaatcaaaacagagcctggcaggcagcccgtgcccaaccagtgttaagcgctgtgattcatacgtgcatgcaggcaaatactcaatccgtcgcttgttttctggttactgcatcatctcagtgattcccttgtgcctgtgggtctccagtgtgtcccctggtagggggtgacatccaggtccttcaggcaacccctgtggtctgatgctccagcgattctgtcacccgccaccccctagaatgtcatcaaattggtggatgaactgatggaagctcctggagacgtagaggccctggcgccacctgtccggcacctcatagccacccagctgctctcaaaccttgaagatatcatgaggatcctggccaagagcctgcctaaaggccccttcacctacatttccccttcgaacacaggtgaggccttggcctggcctgccctgccccaaccctgggccccacctggtacctggggtccctaatcacaactgcccctctcccctcagagctgaccctgatgatccaggagcggggggacaagaacgtcactatgggtcagagcagcgcacgcatgaagctgaattgggctgtggcagctggagccgaggatccaggtagcagcggtggtctggagggggagcccgtgggagagagatggaggtgctgggatggggccagggtgaggttcagaatagaacaactgactgggcgcggtggctcacgcctgcaatcccagcattttgggaggcccaggtgggtagatcgcttgagctcagaagttcaagaccagcctgggcaacatggtgaaacccggtctctacaaaaaatacaaaaattagccaggtgtggtggcacgtgcctgtagtcccagt

SEQ ID NO: 91041 - DNA, 1035 bp, Homo sapiens
aaccccatctctactaaaaatacaaaaattagctgggagtggtggcaggtgcctataatcccagctacttgggaggctgagacagaagaattgcttgaacctggggagtggaggttgcagtgagctgagatcacgccactgcactccagcctgggcgaaagagcgaaactccgtctcaaaaaaaaaaaaacaaggaacaactagaaactgactcatcgggaggggctcctggcgtcatcgtggtggactggctgagcctgagctgggtcatcttgggagggaggatagagcatgggaggaggacaacgggagtaggcagcgagtgtgtctgttccccaggccccgccgtggcgggcatcctctccatccagaacatgacgacattgctggccaatgcctccttgaacctgcattccaagaagcaagccgaactggaggagatatatgaaagcagcatccgtggtgtccaactcagacgcctctctgccgtcaactccatctttctgagccacaacaacaccaaggaactcaactcccccatccttttcgccttctcccaccttgagtcctccgatggggaggcgggaagagaccctcctgccaaggtctctgctcactctgctcacttcctcaaagataacccagggccttcgcacatgctgggcctctctctgggatgctctttcccgacgtgactcagtcttttatgtttctggccttctgatttgggccttccccaacctcattacttatttatttccttactttatttatttaatttaattaattaatttatttattttaagacagagtctcactctgtcgtccaggctggagtgcagtggcacgttctcggctcactgcaatctctgcctcccaggttcaagtgattctcctgcctcagcctcccaagtagatgggattacaggcatgcgccaccacacctcgctgattttgtatttttagtagagacggggtttctccatgttggtcaggttggtctcaaactcccgacctcaggtgatctgcccgcct

SEQ ID NO: 91042 - DNA, 1106 bp, Homo sapiens
aacctgggcgacagagactccgtctcaaaaaaaaaaaaaaacgggcaagtggtgcccccttggaatgctctccatggggagcttttagttgacatctcacaactggtacgggatggacaggcagaggagcggagctagtggctgcacccagtgtatagttgctgggttgtagagaagaggccaaaggaagaggctgcgaagggtgtgacgtggggacacctgggctgtgcaaccatgcagatatatctgagcaaccagtagggctccatggagaactagctgcctgtctggttgcagctggacctcattacctgtgggcacttgaggatgcctccagctacttacctccacgtcataatgagccataaggatcgcaaagctgctcaggtggctgcattggcaggtggtgctgccgttcttgctgcccagcacctggcagccctcggtggcccagtgccctcccctgtcgctgtcactcttccagaaggcacagagcagctcctgccgtggcccaggcatcacgtcctgtgggcagatgggggtggtcagaaaggttggcctggagctcactcttaggtcctgggcttgggctgagtctaagagggctgctttttactagatgagtattgaccgagcgcctactgaatgtaacaggtttggagacacagcagtgaacagggcacacacaagtacctacccttgtgaggttgacataagagtgggagaggtggccaggcatagtggctcatgcctgtaatcccagcactttgggaggctgaggcaggcggatcacctgaggtcaggagtttgagaccagcctggccaacatggcgaaaccccgtctccactaaaaaatacaaaaattagctgggcctggtggcaagcacctgtaaatcccagctacttgggagtcctgggcaggagaatcgcttgaacctgggaggtggaggttgcactgagccgagaatgagccactgcactccagcctggatgacaagagtgaaactccatctcaaaaaaaaaaaaaaaaaaaaaaaaaaaaagtgggagaggcagattatgacataaacctaacgaataagtaatgtagatagtgcattagaagg

SEQ ID NO: 91043 - DNA, 1017 bp, Homo sapiens
ctccacctcccaggttcaagcgattctcctgcccaggactcccaagtagctgggatttacaggtgcttgccaccaggcccagctaatttttgtattttttagtggagacggggtttcgccatgttggccaggctggtctcaaactcctgacctcaggtgatccgcctgcctcagcctcccaaagtgctgggattacaggcatgagccactatgcctggccacctctcccactcttatgtcaacctcacaagggtaggtacttgtgtgtgccctgttcactgctgtgtctccaaacctgttacattcagtaggcgctcggtcaatactcatctagtaaaaagcagccctcttagactcagcccaagcccaggacctaagagtgagctccaggccaacctttctgaccacccccatctgcccacaggacgtgatgcctgggccacggcaggagctgctctgtgccttctggaagagtgacagcgacaggggagggcactgggccaccgagggctgccaggtgctgggcagcaagaacggcagcaccacctgccaatgcagccacctgagcagctttgcgatccttatggctcattatgacgtggaggtaagtagctggaggcatcctcaagtgcccacaggtaatgaggtccagctgcaaccagacaggcagctagttctccatggagccctactggttgctcagatatatctgcatggttgcacagcccaggtgtccccacgtcacacccttcgcagcctcttcctttggcctcttctctacaacccagcaactatacactgggtgcagccactagctccgctcctctgcctgtccatcccgtaccagttgtgagatgtcaactaaaagctccccatggagagcattccaagggggcaccacttgcccgtttttttttttttttgagacggagtctctgtcgcccaggttggagtatggtggcacaatctcagctagtgaggttcaagggattctcctgccttagcctcccgagtagc

SEQ ID NO: 91044 - DNA, 1048 bp, Homo sapiens
cttcgtgggctccaccatcttcctggccggcatcgagaacgaaggcggccaggtgaggtcccgccccgctccctcctgagctctggggtcagggaggcctgggaggggttagccccgcccactcccggggctcagtcgggtaggcgggccctggaggcatgaggccccgcccctgtccgggatctggccccgcccaccggggggtcgggttgtctctttaaagggcgctggctttggagctgcctggccacaccccgagtgcccgctcgcttctgagcgttgttgggggtgggccctggggggaaacctggcccccgctccagacccgcccaccctccggctgtggtcccgcccactctcgggacctggcaggcgactggctctggcgccgcatgcccctccccgcgctgacgtcgctccgcccctccgtccccgccccgcaggtggggctgcgctgccgcctggtggccgggctgctgcactactgtttcctggccgccttctgctggatgagcctcgaaggcctggagctctactttcttgtggtgcgcgtgttccaaggccagggcctgagtacgcgctggctctgcctgatcggctatggcgtgcccctgctcatcgtgggcgtctcggctgccatctacagcaagggctacggccgccccagatagtgagtgcagcgagatggggcaggaggaaggcggggtgctgggcctggggctcacaggcagtgccacacacaatgtccggccgccctccgttccgctcctggcttcctggggcactgatgggacccctcccttccctcctagctgctggttggactttgagcagggcttcctctggagcttcttgggacctgtgaccttcatcattttggtaagtacccactctccctccaccgaagcccgagcgccacaggcccaggcccggctggaccatcgctctcgccctctaacccacaatctgctccctgcccagtgcaatgctgtcattttcgtgactaccgtctggaagctcactcagaagttttctgaaatcaatccag

SEQ ID NO: 91045 - DNA, 1045 bp, Homo sapiens
ttcccggccatcgccatccaccggggcatggcccaggaggagcggtgagtgcgagccgcccgccaaggctgcagggagcaccaccaggagcccagtgtctgacggcctccacttgtttctcctgcaccccagcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtgagcagcctcacgggcatgttgctttcccctggcggtggggtggggccccagccctgcttttcctcaagtcctgaggtagtatctgtggcctgaccctgatcctgtctgcctgcaggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacagtaagtgccttgggcagggccaggggtctggggcagagggttcctcccccggcccttcagttcactgcatctcatgtcttacagtcgagcagagccggtaaccaccacgtgccagagccgcccacccggagccgcccgcatgcagcttcacctcccctttccaggcgccactgttgagaagctagagattgtatgagaataaacttgttattatggaagcctggctcccaccccatctatttcttggtcatcttggcctttcacggacaccctgggcccggcctctgaatcaccaccagcaggcaaggccatcttctgtatgcatgtgtttaattttaagtgtcaacactgaaaaattttaacagataaaaacacattacacaacgtctacaaccttcacaacagtgagaacctcctgcccggccaggcagggcaggcctctgtaccgtgagcctcaggcagtggccccaaggggcctcgccatggggcctctgacatcagt

SEQ ID NO: 91046 - DNA, 1825 bp, Homo sapiens
cactgtccttgctgttaggccctggctgtcttctcccattgtcttgtgtgccactgtcctggggagacacttcagtgaattctggtgtcttgctcccgagtcaggccaggtgcacatctttgggcttcatattggcgcccgtgccctcgttatctcagagcacatcctgaaggatgaaggtgctgtggagggctgtggtgtggtccagtgtctgatggcacgggtgggaagaccggggccgcccgagtgccgagattcaggaaatccttagagagccaggtcccatgtcacccaggcaggccaggtctaaccattacattatgcgggccattttctgttccattttctgtttcttattgtgggtcctggtgttgggagacaggtttcaatagctgtgggagggtatagggagtgaggggtggggaagggccgtgagaagtgggaggcatttggaccgggccttcaaatggcctgtgatgttgggtgcagtgtcagggggactgggttgggtggactctggtggggaaggggtttaggacactgcctaaggtaaggccctcttcttatgccacttcccaggtgacggtcctggtcatgtgccacacgagggagctggccttccagatcagcaaggaatatgagcgcttttccaagtacatgcccagcgtcaaggtgagtccctcgggccagactggaccaggcgccacttggtttctgcagctttgttagcctcggctctggcccagccagcatttaccaagcttggcaggggcagctgcctttgaggtttgcggtggtttttgctccttaaaagcctgatgaattatgcatggctcccaggggcctgcgcaggtcccagcctggggctgcctttgagtggagccccgggaggctctcaggcctgccttggtcccctgaggcctcctgttcgcaggtgctgggccgtgcaggttggggccttgggccgtgtatcagcatggagcggtttcctcctcatccccataggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctgggtgagtcctctgcccttgcagccccagctgagagtcagtgactaggcgggccccatagcaggcggaaggctcttgagtgggttacatgggcggccggcaggcggggctcctgtggtgatcttggggaaagctctgctgctggcagagggatgtgctgtttctgagcccgagccgaatgggaccacggggcccaagcaagcccccgtccctcctggacgtaaaggcatgcacacatacctctgggagtatgaggcttctgccacctgttgggttggttccaggccccgcctgccctcagtgagccccgacagggccggtgggagatgggcttgtgtcctgggaggcagctgcagctctcaccccagcggctgtctctgcctcaggctcccctccctgaagcgtggctcgaggcgcacgggcacggctgctccgcgccagcgtgtaagtggattgcagctcctcccgcgcctgcgctcgctggccaccccccagcccctcaggcaccaggactggccactcccgcggctcactctgccctcgtcacggtgccactggctccctggcacaggttgggaggggtctgggtctggtctggggtgggggtcctgcatggcagacgctcatgcccacccatgt

SEQ ID NO: 91047 - DNA, 1631 bp, Homo sapiens
ttgaaccctggaggtggaggttgcagtgagccgaggttgcgccactgcactgcagcctgggtgacagcaagacttcatctcaataataataataataataataataataataataataataataataaaacaggtgatagcagcttggggccagcatggtagcataggtgagaactggccagagggccttggtgggattcactgcctcatggacagggaggttgagagagagaaaacagccattgagacaatggaattgctgtttctgagccgggaatgagtgacagcgaggccaaaagtggcctaggatcctcagcatccagcctcaggaagaattgtagcagctgtcaccctctgctccaccccccactggagtctggggtaggggaggaggacgaaagacaattgtcctcatgtttgggtcccttgcacccagcaggcacttggtatgcattagattaataaagcaaagaggtaggcagactttgtattaattccattttccatcttctcagctttatttttattggcccaggcccaataggaggcctttcatgagagcacttaattattcccctgtgcagaccacagagagtgggagaagctggggctggacagatactgcttgctctctcgcaaactcagttcccaccagcatcctggcagccccacccctgggatctttgggctcctgccccatgaaagcccagtgggttccttggggagtgatagggagggggcttctctgggctgagtagtctgaggaggttcactggagctgaggcttgcgtgtggagaaggaggcatttgtgcagagacctgggggcagagcattcctggcggtgacagccaggttcaaaggcttggggcaggggctccaggggtctgagcagctgaacaaggctgggggtggtgtgggatgaggtgagcaggggtcaaaccaaggggattgcctggcctgtggtgagagttgggattttaactctgtgagccatgggaagcccttggaggtggagggtgttctgtctgtgggtgtggccagaggggcatgggggagagatggggtagcttgggggtggggaggtggagacagggcgaagctgcgaggtgcagcccaggtagagctgatgggctcactcatggaaggaggcggcagagaatgccatttgaatgaagcttcatcatccttctgtgcccactcgcgggaccctgcctctctctcttctcagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgagggtacgccttctgggtgttatcctcttgcccaggtcctcaccaagacaagaccagccctgcccgcccagagcggtgccgcctccagtttgccgtgggtgagggaggggcccgtctgtcccgcggatcagttgtgcccagcggggcctgtggctgccctcggcagtggggcgttctgctttgaccaggcgga

SEQ ID NO: 91048 - DNA, 1048 bp, Homo sapiens
agaaatccaaatactgcaaaatgttctgtccatttgagtcattccaagctccctattcttttcagagcctacactgtggaggacccccaggccgcagattgatagcaactgggacagttctggtttcagcgcccagcgcagacgccactcttcgaaaaggtggggcacacgccaaaacgcaatcatccggtcttcagttatcagtactaaacatggcggctcccaccgagcaccacacccagatcacgagaccgcgcgctgtcggagccagtctgtcggctcactggggcgcgcctacttttagattgaccaataaacgcgaggcgtaaggcacgccctctttcttcccgtctccgccaataatctcccggtcccttccacaggacccaatcaccgcttcggcctctcttgaatgaaaaggcagcggcccagtcagcagagcagcagcccgacgcaagaggcaggaagcgcagcaactcgtgtctgagcgcccggcggaaaaccgaagttggaagtgtctcttagcagcgcgcggagaagaacggggagccaggtgagcagcggatcccgggcgcggggccgcggtgtggggacgtctgaactgagagcgagaggacgaggggagacgttgggatctaaggggagggggagaaagggtcgcgagacggtgggggcggggcggttggtgtgtcagagcgctgtgtgttggccgttgggcaccggggcgcatgcgctaggggtgggccagccgttggcgcgcggtgctcggggctcggggcccgcttctcggaggggctgtcatggcctacggcgctccgagccccacttggagtctgtcagttcgtccgaatagaccccgcggcggcctggggccatttggagagggacgagggggtgacgccggggtctggggcctgggtgggagaagttggagctttcagttgtcaggggtttctttgggtccgagggacttgatccctttcccagtctaccttcttcttggtctactttttacgggattcgggattctgagatttagagcaaataa

SEQ ID NO: 91049 - DNA, 1741 bp, Homo sapiens
gcaccttggacattctctagggacagggagcaaggactgtccctgggtttcatctagaggaacaggaggtcccttagatgccctggagttggccccgcgcgaggggtgctgggagttgacaggaaagaggaagtggcagccgagaggccctggtggggctgaggttcaggaagagggcggggccctcagcccggacccaggatggcggaggccaataacccctcggagcaggagctggaggtggggtccagggtccctgtgggggcaggcagaagggggccccaagtggcacaggccagtagtccttccccgggtacttctcagtttgggaacaaggagaggagatggggcactggcctcagagttctctctctggaggatgagagtatccagtgcccttcggggctcccagattggggagagacagaaggaaggagaccgggctctgttctttagggtcccagttgttgaacataggagaagagcagatgagggtcttcaagaccccatagtttgggggtacagcagagagaagacttggcctgcccttgggataccctagttttgggggtgtagccaaggaaagatgaggcctgccctcgggatgccatagtttcagggtacaagtgagggaagatggggcctgtcctcaggaccctgtagttttaggggtacagcagagagaagacagggcctgcccttgggccctcttagtttcggggagcagcagagaaaagaaggaatcttcccttgggaccctctagtttgggggaggcagcagaagggagacagatcttattcttgagacccccttaatgtgggggacgctgtggtggtgggggtgacaaggccctgctcttgagacctcccagtttggggaggtcaggaagcagtggcaaggcctcgtcaccttccagttttgggagtcagaggaggtagagcaggccctgtcttgggagccccagtccagggcagaggctgggccaggctggctgcatgtggtctgcacctggagttctcctagctccactgaccctgttctgtcctccgcagagtgagcctcgcagctggtccctgctagagcagctgggcctggccggggcagacctggcggcccccggggtacagcagcagctggagctggagcgggagcggctgcggcgggaaatccgcaaggagctgaagctgaaggagggtgctgagaacctgcggcgggccaccactgacctgggccgcagcctgggccccgtagagctgctgctgcggggctcctcgcgccgcctcgacctgctgcaccagcagctgcaggagctgcacgcccacgtggtgcttcccgacccggcggccacccacggtgagctgggatgcctctggggatgcgggactccagggattccactgctcactggctcacccatggtctccagagccaggttaacccatctccacggacccccagggagatgcatgccatgacccccgtagccaccaacacccagagaggtgcatacagccacaccagcacccggtaacactcaagaccgtgcatgctgtcacatgaatacctctagacacagccacgccaacacccaggcaacattcaaggatgtgcatgcagtcacacaaacacctaaaaaaacagccacaccaacacccaggcaacacccaagggtgcacatactgtcacacgaatacctccagacacagccacgccaacaccccaggcaacactcaaggatgt

SEQ ID NO: 91050 - DNA, 1070 bp, Homo sapiens
cagtagcacgatcttggctcactacaacctctgcctcctgggttcaagtgattctccttcctcagcctcccgagtagctggcattacaggcgcgtgccaccacgcccagctaattttttgtatttttagtagagacggggtttcgctatgatggccaggctggtcttgaactcctggcctcaagtgatcgcctgcctcaacctcctaaagtgccgggattacaggcatgagcaaccttgtctggctactgccagcattttctgactgggccctctctcccatttcaggtgaagtcagcactgtgcttaagctggataacacagtggtggggcagacgtcttggaagccatgtggccccaatgcctgggaccagagcttcactctggagctggaaagggtgagctgcgttggaggacagcagggcctagaggaggaggggttccatgcctctggcaccctgagtgatggccctcttcctctccctccaggcacgggaactggagttggctgtgttctggcgggaccagcggggcctgtgtgccctcaaattcctgaagttggaggatttcttggacaatgagaggcatgaggtgcagctggacatggaaccccagggctgcctggtggctgaggtatagcccacacctgaccctgagaaaatgcttcttctccctcactgccccattcccagtttcctagaaggggaaaatatgttttaggtctggctcttccagaaggggaagataagttttaagtcaggcttttctagaagaggaaaatagattttagatccagctcttctagaaacggaagatatgttttaactctgccttttctagaaggagaagatacgttttaggtcaggctcttccagaaggggaagagacgttttaggtctgcttttttctagaagggaaagatatgttttagatcaggctcttctagaaagggaagataggcttttgatctgcctgttctaggctgggcgtggtggctcatgcctgtaatcccagcacttcggaaggctgaggcaggaggatcacctgaggtcagggagaccagcctgggca

SEQ ID NO: 91051 - DNA, 1040 bp, Homo sapiens
tgaatccgggaggcggaggttgcagtgagcgaagatcacaccattgtactccagcctgggcaacaagagtgaaactccatctcaaaaaaaaaaaaaatgagctggacgtggtggtgcatgcctttagtcccagctactcaggaggcggaggtagagttggaggctgcactgagctatgactgcgcccctgcactccatcctggaagacagagcaagaccctgtctctaaaaaaaaaaattcaggttgggcatggtggctcacgcctgtaatcctggcactttgggaggccgaggcgggtggatcacctgagatcaggagttccagaccagcctggccaacatggtgaaaccccgtctctactaaaaatacaaaaattagccagccatggtggtgcaggcgtgtggctggaggagagtgagtgaggggctgcgtgggaggagaggtgaggacagagaggtcgggggcagatcttgcagggcctcggaggctgctgtggttatgagggcatctctgactccccttactctggcctcctctctccgccacagagctcccccatccaggaatccactgctcccgagctgccttcggagacccaggagaccccaggccccgccctgtgcaggtgacaccactccctggccccctgtccaccacccctgcccgctgtccttgttctcaccagtggcctctctccacagccctctgaggaagtcacctctgaccctcgaagatttcaagttcctggcggtgctgggccggggtcattttgggaaggtgaggtggagggcagggaattgggagaccccccaggtccctggctggccgctaaaaccacccctgcccactgtggttccaggtgctcctctccgaattccggcccagtggggagctgttcgccatcaaggctctgaagaaaggggacattgtggcccgagacgaggtggagaggtggggacctgccgtggtcctctggggacctctttcttctcttttgggaaatgacagagcagttctctccttggagctacagggagag

SEQ ID NO: 91052 - DNA, 1057 bp, Homo sapiens
gccaagatcgcaccactgcactccagcctgactctgtctcaaaaaaaaaaaaaaaaaaaaaaaagaacccctcttgttgtggagaagcagaatgctattgccttccacacatggttgtcaggtgctctctacacagtgcctaacccctctaaacattcggtacaggcactgagattgtgcctggtcttcccagcatccttttgataatcaggaacccaactgagaaagactgaaacaagtaaagaaatttattggtctggatctgaaaagtccaggagtgtgctaccttcaggcatggctgtatccaggtgctgagatgacgtttctcagttctgcttccctctgtatgggctttggttgccatctgggagtctggagtaagtggcggccatggtctctgacttctatcccccacccctccccagcctgatgtgtgagaagcggatattggcggcagtgaccagtgcgggacaccccttcctggtgaacctcttcggctgtttccagacaccggagcacgtgtgcttcgtgatggagtactcggccggtggggacctgatgctgcacatccacagcgacgtgttctctgagccccgtgccatgtgagcctggaccccagcccgggcccctgcctcccctacagcatctgacacttagtccccccgagaggctggcagcctgcttctcacccctccaccctcaggccttgcttccctcagcctcccagagctttggggagactggggggcttttgaggatgtggaagccaggcttatgtgaccctccctccttgcagggtggccccacccctctcagcagcctctctctctctgcagcttttattccgcctgcgtggtgctgggcctacagtttcttcacgaacacaagatcgtctacaggtgtgtgcgtgtgtgcatgcatgtgcacactgcccgttgtggggacaggacccagacccccgctcatccctctttccacccctccaacccccaacagggacctgaagttggacaatttgctcctggacaccgagggctacgtcaagatcgcagacttt

SEQ ID NO: 91053 - DNA, 1008 bp, Homo sapiens
gaggttccatctttctatttccaagccaggtttcaatgccctggtgctccccacggtccgggggttgtcaccagctgcagacagcagccttgtgaagctccagggggtaggaggccttgtgggagagggggcaggatttgaaccctcagtagtccaggaagctctggccctgcctggaagcctggtggcctgcagccagaaggaacagtgggagggggcaggtggcttggtgccagctcctaattcaatttggagcctgcggaagatggatttcagctgctgaattctttctcagccccaatcttccccctctcccaccccgaagccacacaggtccaacagcagatagattctttatgttcaagacagcaaattcagatacaaaaacccaccgccatcgtccctccctccctcctgctctgggccagggatgggcctggaaggagagatgggaggtggggaggaggttgcggggttcacagcagactcgtgtcaaatgcggaggtaacaggctccacagggagggggctcctctcaggaggggtgagggcattattgcatttgctggggggaaggacaaccctctcccctgtattccctgcgtcaggaaactaggaaggtcatgacccccaaacagaacccaaggccccagggagacagagggaccagtttggcagctgatggtggaaagtggtggaggcgggggtggccgcccaatttggctgatccctcccctccctgtgcctgacccagctgaggtaggtggggaacagggcacaggggggccggggaccccggccagactgggaaccagggaggggatggtaccgattggagcggggcagggggcctggccccacctcccctcaccatcgtccttgggctgctgagctaggctcaggctggaggctcgggtcctgacgtcagtgtccctgctgggggcccccaccaggttgcgcccgggtcatcatcgcagggtccgggggcagtcctagtagcggccgacct

SEQ ID NO: 91054 - DNA, 1194 bp, Homo sapiens
gtgcacacctatagtcccagctacttgggaggttgagatggggggatcactggagctcaggagttccaggccagcctgggcaacataatgaggctcccatctctaaaaaaaattattttaactatgtgggtgtggtggcacgtgtctgtggtcccagctactcgggagactgagacaggaggatcacttgagcccaggagttggagaccagcctgtgcaacatagtgagaccccatatctccacaaaaaatacaaaaattagccaggcatggtggcgagcacctgtagttccagctacttgggaggctgaggtgggaggattgccggaatctgggaggttgtggctgcagtgactatgatggcaccactgcactccagcctgggtgacagagcaagaccctgtctcaaaaagagaaaggaaaactaaatcctagtcctagcagagctgacacgctaatgtgggccctgctgtggccctggctcaggctcagtgggtgatgagttactgggatggaatccccctagtcctctcccagctctctcccttcgccctccagtggtgattagaaaagggggagggagggggaagaggtttcagcgtctcccacccctgcaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaaggtgcctggggagacggggcaccccggaggcctgggagtgagggtgggccatgggaccccggaaaccagggcagagccccaagggctgatgactccccgcccccgcagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcggtgaggagccgccccctggacctccccagtggcgctgctcgcatgggcgcaggcggtggtgccgggagcggccagcaggtggcgcccaagcctggcctgccgaa

SEQ ID NO: 91055 - DNA, 1069 bp, Homo sapiens
cacccgaagcggaagacgcggattggctgcgagcaccgagaggcagccgctgattggccggccgcgggcgtcggccccgccccccaggcgccgctgcgggagaggcccggtctggagtttgcggagggccgagccgggtgcgcacggggaggcggaggcagcggcggcggcggcggcggcggcggcggcggcggagcaggtgagtggcctctgcgagaaggatgtgtctgctccgggggcctcgggggtcgcgggcctgcgaggatccggccgatcctgcagggtggggccggcgccgtggacgcgactggaggtctaggctgcgcgcggggatgccggaggccccttcccaggggaagcgggggtggggggtggtgggggcagctcccttcctgctggcgggcaggggacaaacgcctcccaacgctgggctggggtttctgggcttgcccctccccccgtcccccggctggactgtccccatcccagcgtggacaggcgcggggtcagtgtttctgaccctttcctgggcacttcccctgagctaaccgcgtctgaaccctccagggccttgggggggacgcagtgaggaccacggtctgaataataatcgtcatgaaaaactccacctcagctagcatttattggagagcttccgtgtcaggcatttaccatgaggataattgactctaaacacctcatgggaggtgctgtgccttcttgtaaaaaaggtgaggcagcctacccagagaggtggagtgacttgcccaaggtcacacagctagtaactggcacatctgggactggaactcatgccccagggtccagaactggagtcacacccactagactggataccaataactccacggctcagttgttgctgagtagctccggccccctacccctcccaccccctaccccgtactcatcatcagggccacacctgctggtcttttgctttaccagccactcaaacaggaagctgccctcctttcccttctccccagagctggagagggcaggtctaactacctgggtccagagaagagagtggcgtctgcagggg

SEQ ID NO: 91056 - DNA, 1627 bp, Homo sapiens
ttatctatggcagacggcctctgggcaagagctgagcctcttgagccagcttccatctaatgctgtccttttgcttttcaaggctctgtgtggctgcacagtgaacgtccccactctggacggcaggacgatacccgtcgtattcaaagatgttatcaggcctggcatgcggcgaaaagttcctggagaaggcctccccctccccaaaacacccgagaaacgtggggacctcattattgagtttgaagtgatcttccccgaaaggattccccagacatcaagaaccgtacttgagcaggttcttccaatatagctatctgagctccccaaggactgaccagggacctttccagagctcaaggatttctggacctttctaccagttgtggaccatgagagggtgggagggcccagggagggctttcgtactgctgaatgttttccagagcatatattacaatctttcaaagtcgcacactagacttcagtggtttttcgagctatagggcatcaggtggtgggaacagcaggaaaaggcattccagtctgccccactgggtctggcagccctcccgggatgggcccacatccacctccagtccctggccaggggtgagaggcagaccagcagatggacttgatccctctgtgtctttttgcttctggctggtagataatgtcaacctgcagtcttgattcccagaccctgtacactcctccttttctgttgtgtgatcagtttgtgctttattctgtatttgtctcccatgtcttgctcttctcctggagaattctgtcttctctttggccatctcaaattgagaacctaaactattcctgcagaactgcctggttggcgtccacaagcaatacctctcgttccagcaggaccaagggagccagcctccagtgagtgactccagcaagtgcagccacctctcccttgatggtctgggagcctggcctcagcaaggggccttcctgacctctggctccagtgaagctgaatgtcctcactttgtgggtcacactctttacatttctgtaaggcaatcttggcacacgtggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttataattccatgtatagttggtgtacactcaaaacctgtccccggcagccagtgctctctgtatagggccataatggaattctgaagaaatcttggggagggaaggggagttggaacaaatgtctgttccctggaggccagtccagtgctcagacctttagactcattgtaagttgccactgccaacatgagaccaaagtgtgtgactagtcaatgaagtgcgacagcattaaagactgatgctaaacctcaggggagcggtcctgtgactctgtttgagggttctgctggttttgggggtggagtggggagctgggcatccttccaaattcaatcaaggtgagagggtgggatgggcaggaggcaagtgccctgcaagggaaacgtaagtctcc

SEQ ID NO: 91057 - DNA, 1047 bp, Homo sapiens
gacgaagtctcgctcttgtcccctaggctggggtgcaatggcgtgatctcggctcgctgcacctccgcctcccgggttcaggcgattctcctgccttagtctcccgagtagctgggattacaggtgcccaccaccacacttggctagtttttgtatttttagtagagatggggtttcaccatgttggccaggctggtctgaaactcttgacctcaggtgatccgcccaacttggcctcccaaagtgttgggattacaggcgtgagccactgcgccggcagtgtgagtgcttcttatctagtaacatatctaaatcgtgtactaaacataagacgtagatgctgttcttatctctacttgactgatggagaaactgaggcacagaaagtgaagcgacttgtccacagctagtggctagcagagctgggattcttctagaaccagagtgggctttgctgtgggtcgtgcactggggaaagaatcaagtgtgtggtggtggtgaaggacttggaggccacccactctgtccttgggacagtgacttaacctaagcttcagttttgtcaccctgtgaggccaggataacgacacctgggggcctgtgggggagtgtgaagtgctcagcatgcttcgcggcccacaggcagggtaaaaatccttaagcggagagggacccacgttaggcaggtaaggacagatcagcatccccagggctgcctgagatgcttttggcacctgacctctttggaaggcctcaaaactcttttttttctttttttttttttttgagatagagtcttcctctgtcaccaggctggagtgcagtggcgtaatcttggctcactgcaacctctgcctcctgggttcaagtgattgtcctgcctcagcctcccgagtagctgggattacaggcacgtgccaccatgcctggctaatttttgtatttttagtagagacggggtttcagcatcttggccaggctggtcttgaactcctgacctcgtgatccacccgcctcagcctcccaaagtgctgggattataggcat

SEQ ID NO: 91058 - DNA, 1002 bp, Homo sapiens
tctggccgagcaggtgtggcctgtgcagggttcctggcagctgagccctaggtcttctcagccatcctggcattagcaggttgacttgatatttctggaagtgggaaggaaagggagccgagagggctgagccgctgagccggagtccagatgaatgtgccggagtctctgcatttgtgatgggggcgaggtgatgggggcgaggtggccggcgtggctctgggcatgatcgggccaggcctccgacctctatgctgggcattggctggacagggagctcaggcgatgagtgcagcagcgcttgtgcccggcgcggggatggtgagtgcctggctggccagctgcaggacctgtcaggccctttgtgtctttacctggggccctggttgcactgaccagggctcgcacccccagccaggcctcttgtgccccagactcgggagatgcttcctaccaggaagtgcagtcccctgcggggtccgagagagcctgccggagctttgagctcaacaggtgggctgtgcggcaccacatcagctctgcaagggggccctggaggcccatgtgtggtggggtatggcctggctttcaacatgcacgcgtggtcttctgggctctgggatttactgcttagatcttggcctcttcatctgtgaaacggagctaatggctcctgctccctccggctgctgcaggagagatgtctgggaagctgtggcagttccagccccgggcagggaacgtgaaataactgttggtcgctgttctcactcatcaccattaggcaggtcacgtcctaggacacacagaagtttcaggttcataagccatgggagatgaggccggcccagaatccaagcttcccgctctggcccgggtctgcccctcttctggggctgagagggcaggcaggtgccttgctgggtcctgtggtgtggactctgccgccagcaaggccattgaacctgcttgtttacagccgggagaggactgggaagcacc

SEQ ID NO: 91059 - DNA, 1377 bp, Homo sapiens
ggcttctggggcgtgactggggcaggcgcctccacgtggcactccgcaggaacgcccttgctaggctctgggaaggacaagatcctgcttctgcccgcgctcttctggcttgtgtcctgaaaccgcacaagcctgagggtttgcccccaggtgggaggagctgtggagtcctggggtccttgcaccctgggaaccctgagaagctggcacagtggctgggcagcggaccggctgagccctgccaggctgtgggctgtaactgccctgttctccccgcagatccgcagtggtaccccgcccgccagtccctccgcctggaccccagtgagtacagctgtccactcggcccgccccctgggctcctgggtggcagtgggagaaggcccgggtagcccctgagccctggcccgcctctctgcagagggcaagtccctgaaggatgaggatgttctgcagaagctgcccgtgggcaccacggccacactgtacttccgggacctgggggcccagatcagctgggtgacggtgagtcctgaccctacccacggcctcttttcccgtcagccacgttgggtgactcatcttgcccccctctactctcaggtcttcctaacagagtacgcggggccccttttcatctacctgctcttctacttccgagtgcccttcatctatggccacaaatatgactttacgtccagtcggcatacagtggtgcagtaagtggggcaggtgggaggagggtaggggaaggcagaagacctgccggaccagccccagctgagcctgctccccccgaccagcctcgcctgcatctgtcactcattccactacatcaagcgcctgctggagacgctcttcgtgcaccgcttctcccatggcactatgcctttgcgcaacatcttcaaggtgagagcccgtccccgcctcacccctaagccccgcctttctgccccaccccgccccgcccccaccgagccccaccccaaggcccttcctgtctgccactacgccccagcagagccctacccctaggccccgcctaacctccccagccccgccctcgcagagcctctagaccccgcccgtcctccccagccccgcccccgtcgggcccctaggcctgcctatccaccctagtcccacccctaggcaccgcctatccccccagccccgcccctgcagagccccgccccagtttcacccctaggcccctcctgtccaccacgccctcacagagccctgccctagcctcaccccttggccccgcctatcctccccagccccgccccaaggcccctcctgtcctttcccaccatgctcccaggcccctcgggatgagacatgggcagcatctgccttgtccggtgctggccc

SEQ ID NO: 91060 - DNA, 1025 bp, Homo sapiens
gcctctctgctgtggtggcggggaggcgtgtgccgctgggcttccgccgtatacagccccgcctccgctggaattgggttcccatccctgactcagaaagcaggggcggcgggaggtggctggctgagtccaggacagccacatacacgggttgcgaggctgcccacgctcactctccgcccctgcccacaggtggggtcctggatcggtttcgccatcatgacgcagtgtctcccaggtgagcctgccgccctccctcggcggggccctgcccctccgggccggcagcccctccctgacgcccgttctttcctgcagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcggactcgggctctgtgtgtttctttccggggttggggaccaccacactgcccttcactctctccccactctcgcgtcggagcagtaagaggggactctggttgaggggcctgaaggcttttatttgactggtccatagggtggggggtgcaccccctacagggccaccttggggtccacttccccgggtccctggcctttggccaactctgccgccttcttctcccgccgcttcttccgctggagcagcctccgctcccgctcaaactccttcatgcgcatcacatagctgggggaaaagcacgagaggggctgtcagggtccctggccaggacacgccccccaagccctgggaagcggaggggccgtcccagagcactgtgggggaggcctctgaagaagacatgtccgagtgcctgtggcttgggtctggggtctgcccacgcaggtggcagggcttcccactggaacctg

SEQ ID NO: 91061 - DNA, 1035 bp, Homo sapiens
tcccatgttcatgaattgggaggcttagtattcataagatagaagtactccccaacatgatgaatttaacatagtccctaccacaagcccagttaacttttttgcgtaaattgacaggatgaccctaaaatttatgtggaatggtagaggattcacaatagtcaaagaatcttggaaaagaagaaccaacttgaagactcacatttcctgattttaaaacttactacaaagctacagtaatcaagacagtgtggtatgggcataaggattagacatatagcccgatgaaatagaatcaagagtacagaaataaactcttacatttatggtctatagattttcaacaaggatgtgaagacaattcactggggagaaagaatggtctatttaagaaatgtttctgggacaactgtatttcagcatgcaaaagaatgaagttaagcttctgcttggggcctggaagggtgatgtggctgtggcatcgccggcctcgctatgtctgccattttcaatattcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgaagtatgctgtatagtaatggccttcagcatcctcttcatacagtagctggggaaaatgccagaatttaattgccatcagatttcattgtgaacaaggacttactgcagaaaataatggaaaggatgtttaactcttttatctccgaacattgaatgagataaatttccagatgctgttctctattttaatgttattggaccaatattctgtataaataattaagatgtaaccatttaatagtctgtaacaatgaacctcagtactgtcactacaatattacattctgcaaatgttattctgttgtatcagatacgaaattttagtgaggtatctctaaggcatatagtagaaaacaaaattggttaa

SEQ ID NO: 91062 - DNA, 1020 bp, Homo sapiens
ccaggttgtcaaggtagttccaacctcccagcccacaatgcccattgctgcctggcccagaattccagtgctcaccccactgggccctgattagtctgtggccccggcaagaagacattcactctctcttcccacccccaggtagtgggactgtaccgtctttgtggctcagcggcagtgaagaaagagcttcgggatgcctttgagcgggacagtgcagcggtctgcctatctgaggacctgtaccccgatatcaatgtcatcactggtcagcatggccccctctcccctgcctgctcacccccattcaatgcctcacttcaaggccttggggctcctctgggacctcagtcctcctatctgaccttgctttcacccacctcctcttcccccttagctgtgccctccttagccttagaagccagtggtgccctgaccagaggggaccctgtgttcacaggcatcctcaaggattatcttcgagagttgcccaccccactcatcacccagcccctgtataaggtggtactggaggccatggcccgggaccccccaaacagagttccccccaccactgagggcacccgagggctcctcagctgcctgccagatgtggaaagggtgagttgggcctggtgggagtgatgggacttgagagtgggctgataccaatagaatgtttcacccatgcctgggcctgagatgggcatgagctggcagcatcatcatatccccaagaaataggtgctattagcatcccacttcatagatttggaaactgaggcccaaagcaggtgacagttgcccaaggtcacacagccaggatgtgtcaaaaatgcaggctgaacgctgatctttcaacctacaagggaggttcctggctgagggaacctagacaagtcccatccctctctgtgcttcaatatcttcatctgtaaaatgagattcatggcagctctgcttttccaatgcttagttgcctttggcttcagtcttccctccaacaaaataggctcataa

SEQ ID NO: 91063 - DNA, 1079 bp, Homo sapiens
gtcacggagaggcatggcttcaccccgagcctaggcgcacaaagggcgtggtctggcagggttgggggcgtggccgcacagaaactggcggcaagggtcgtggccctggatcctgctgcgagaaggggcgcgatttcttccggagaggttccctgtcgcgcccaagtctgggaagtgccctttctctcttaggtaccacctcatggagacccccgcggccgccgcccccgctgggagcttattcccctccttcctgctcctggcctgcgggacgctggtggccgccttgctgggcgccgctcaccgcctggggctcttctatcagctgctgcacaaggtgcggggcacagaatgggaggtgggctgggggcagtcaaagagggaggggcctcgtggtgctgcttccagctcactcattgtgcagggtgggaaagcgagccccgactagtccagagggactggtaagaggttctgtccagggccctgtctccattgccacgctgtgtatggaggcctggactttgccactggtaagagagaacacggaagctgccgctgccggggcactcgcaccccacctacctccttccccagtgactcttttcacagaacagatggacagcactctgtgctccctaacctggatgggataaatggggcagagggcaggctccagcgagggggtggcagtgacagtttcataacagttgccctctgctgagctcagtactgtagactttcttacctaccccttaccttttccttgaaagtaggtgctgttctttctgtcttcattttctgcaagaggaagctgaggctcagagagattgtgtggtggtttgccctaggtgacatgtttggagagagctgaccccacaggtgtccccctaaactccttgcacctctgtttgaaatttaccccttctccagaccccttcctcaaccctttctctcctagcagggaccaagcttgacctctccctccccaaacccttctctactgcttcctctgctagccaggagtgatgccactgaccttcaggacttaggagatttaaagcaagccttggatgtgtagg

SEQ ID NO: 91064 - DNA, 2642 bp, Homo sapiens
ccaggtctgtcaagctccagtgtacaaactcatagctctcgggctcccccaagaggctggaagactttgctactgttagctggggtttcgctgacctctgtgggttctggccccccaggaggagacccccctattcctggccgcccgcgagggcagctatgaggctgccaagctgctgttggaccactttgccaaccgtgagatcaccgaccacctggacaggctgccgcgggacgtagcccaggagagactgcaccaggacatcgtgcgcttgctggatcaacccagtgggccccgcagcccccccggtccccacggcctggggcctctgctctgtcctccaggggccttcctccctggcctcaaagcggcacagtcggggtccaagaagagcaggaggccccccgggaaggcggggctggggccgcaggggccccgggggcggggcaagaagctgacgctggcctgcccgggccccctggctgacagctcggtcacgctgtcgcccgtggactcgctggactccccgcggcctttcggtgggccccctgcttcccctggtggcttcccccttgaggggccctatgcagctgccactgccactgcagtgtctctggcacagcttggtggcccaggccgggcgggtctagggcgccagccccctggaggatgtgtactcagcctgggcctgctgaaccctgtggctgtgcccctcgattgggcccggctgcccccacctgcccctccaggcccctcgttcctgctgccactggcgccgggaccccagctgctcaacccagggacccccgtctccccgcaggagcggcccccgccttacctggcagtcccaggacatggcgaggagtacccggcggctggggcacacagcagccccccaaaggcccgcttcctgcgggttcccagtgagcacccttacctgaccccatcccccgaatcccctgagcactgggccagcccctcacctccctccctctcagactggtccgaatccacgcctagcccagccactgccactggggccatggccaccaccactggggcactgcctgcccagccacttcccttgtctgttcccagctcccttgctcaggcccagacccagctggggccccagccggaagttacccccaagaggcaagtgttggcctgagacgctcgtcagttcttagatcttgggggcctaaagagacccccgtcctgcctcctttctttctctgtctcttccttccttttagtctttttcatcctcttctctttccaccaaccctcctgcatccttgccttgcagcgtgaccgagataggtcatcagcccagggcttcagtcttcctttatttataatgggtgggggctaccacccaccctctcagtcttgtgaagagtctgggacctccttcttccccacttctctcttccctcattcctttctctctccttctggcctctcatttccttacactctgacatgaatgaattattattatttttatttttctttttttttttacattttgtatagaaacaaattcatttaaacaaacttattattattattttttacaaaatatatatatggagatgctccctccccctgtgaaccccccagtgcccccgtggggctgagtctgtgggcccattcggccaagctggattctgtgtacctagtacacaggcatgactgggatcccgtgtaccgagtacacgacccaggtatgtaccaagtaggcacccttgggcgcacccactggggccaggggtcgggggagtgttgggagcctcctccccaccccacctccctcacttcactgcattccagatgggacatgttccatagccttgctggggaagggcccactgccaactccctctgccccagccccacccttggccatctccctttgggaactagggggctgctggtgggaaatgggagccagggcagatgtatgcattcctttgtgtccctgtaaatgtgggactacaagaagaggagctgcctgagtggtactttctcttcctggtaatcctctggcccagcctcatggcagaatagaggtatttttaggctatttttgtaatatggcttctggtcaaaatccctgtgtagctgaattcccaagccctgcattgtacagccccccactcccctcaccacctaataaaggaatagttaacactcagtgttgttggtctgtgtctaggtaaggtggggagtggtggcagtgggacttctatctcccccacccagggctaacttgagctcccatcttggggtaaatacatttgacttgccagtctacttatgcttcctcttttggcagatgactaccgattggattagtggttgtcacctgacttaagctgagccaatcagattcttttgctcgagaactttctttaatggagaggctaagaaagttgtcagttggtggagctcttaaggtcacaatcagatttagaaatatcagtggccaattcgaggtggtgggcaaagagacaagcaaacagggcagaagaatgaagctaatattcagggagaatcagaaatgagagctcaaatggctccttgagggctgggggggttatctcggctcccagtgcagttatcaattccagttaatt

SEQ ID NO: 91065 - DNA, 1021 bp, Homo sapiens
tagggaggctgaggcaggaaaatcgcctgagcccagcaggtagaggttgcagtgaactgagattgtgccaatggactccagcctgggtgacagaacaagacactacctcaaaaataaataaatggataaataaaaaccacatgtgactgactactgtattggatgtcacaaccctaggttcaactgaaggaggtccacacagcaccccctgtgtataaacagtcatgcacatgcacgcacacacacacacacacacaaacacacacacacagacacaaagtgcttccccattgcacagagtcattttgcagatttgcacacacatggatccagacacaagtacttggatattcacggcaggcctgcctcctctacccctaggccacattctagacaatttctgcctccctgacatgggggccccaggacaggtgcctggtcctgacctctctccccttcatcctccagggaaatcagccttacactgggctgcggctgtgaacaacgtggaagccactttggccctgctcaaaaatggagccaataaggacatgcaggatagcaaggtgagccccagcccttggtccactgggtgtcagcagtggcacagtgccattgcaatccagcctgggcaacagagtgagactctctcaaaaaacaaaacaaaataaaaccccaaacattggattaaaatataatttactttggtgactaaagtttttgggggccccttaaattttgtgcctaatggctgggtgtggtggttcatgcctataatcccagcactttgggaggtcgagatgggtggattacttgagttcaggagtttgagaccagcctggccaacgtagtaaaaccctgtctctattaaaaatacaaaaattagctgggcgtagtggtgcacacctgtagtcccagctgctcgggaggctgaggcaggagaatcgcttgaacccggaaggctgaggttgcagtgaactgaaatggcgccactgcactccagcctgggcgacacagtgag

SEQ ID NO: 91066 - DNA, 1012 bp, Homo sapiens
aagaccaaaaaaaaaaaaaaaaagaaaccttgtgtcttccttttattacctccttgggctatggcacacattgatttcctgttaatctcagcactttgggaggctgagaggggctgatcacctgaggtcaggagttcgagaccagcctggccaacatggtgaaaccccttctctactaaaaatacaaaaaattagctggacaccgtggcatgtgcctgtaatcccagctactccagaggctgaggcaggagaatcacttgaacccgggaggcgggggttgcagtgagctgagatcatgccactgcactccagcctgggggacagagcgagactctgtctcaaaaacaaataaaacaccaaacagatggtaaatgatttcccagggctctgtgtgtatctcctaaagagaaacctgtaggaatgcccagccccatccctggcagtggctctccccagcaccaaagggtgagatctgagatccagggtgcctgcccctccaggtagaggagccaggcatgggggctgaggaggctgtggattgccgtcagtggactcaacaccatctggttgctgctgacatccgcgtggcaccagccatggcactgacaccaccacagggcgacgcagatgctgatggcatggatgtcaatgtgcgtggcccaggttagtgacagtgcccctcccaaagggatgcccctcacccatcctacctgtgagaggttatttctgactctgtgttttggggagaactgggggagtctctaagcttctgtgaagggtgtgtgtattcagcaacactcttggttggaagtgacaaaggtccaactcagactagcttaagtaaaacaagggatttatcaactcatttaactaaaagtggcacatttggatccaggactcagttttcccctctctaccctttgactccaatcttacaaaaccttcttaatgctccagaaaagtctcaggatgcattctgattggacagactagggtcacgtgctcatccttg

SEQ ID NO: 91067 - DNA, 1031 bp, Homo sapiens
ccccgcctgaggccaaagccccgccctcggctgaagccccgccctctgcttcctgctcttaggggagccgctggagcctccagaacccagcgtcccgctgctgccactgctagtggcgggcgctgtcttgctgctggtcattctcgtcctgggtgtcatggtggcccggcgcaagcgcgagcacagcaccctctggttccctgagggcttctcactgcacaaggacgtggcctctggtcacaagggccggcgggaacccgtgggccaggacgcgctgggcatgaagtgagaaccctgctcgctccctgtccctgactacggggaccttgtgaaccctggaccccgccttgacctgactcagacctctgaccccaccccaaatcctccttcccagctggacacctctagtgtccccctcacatcccctcttcccattgtccgccaggaacatggccaagggtgagagcctgatgggggaggtggccacagactggatggacacagagtgcccagaggccaagcggctaaaggtactgccccccctctgacctttgccccctcctctgacccctcccctcagggtactgggtggggtccccagtggatgatgggcgtgatcaggggatggcaccgctgtccccacctccctagctccagagaatagtcccagctttgcaaccctttcttctcagtgtggttctgtgacctcagagggaggaagatttgccactggggccccaagggtccctccgggcaggtggaaaatcctcccctccatcctgcccctccccagccaggatcctgcttcctggccagcctgcactcttcctggaggtgtccccccagcccagagagcgagtctgccttatctctgtcagttcctattttgtccagcatggacttagcctgaaagtgctctgagccggttctgagctcatggagtcatgcccctgggttcagtatgagtcagctttggctgccattaaaaaatcccacagaggtggatcacctgaggtcaggagttcgagacc

SEQ ID NO: 91068 - DNA, 1012 bp, Homo sapiens
tttaaaaaaatattatcaagggctgcgtgcggtgacttatgcctgtgatcccagcactttgggaggccgaggcaggtggatcacctgaggtcaggagttcaacagcagcctggccaacatagtaaaaccccgtctctgctaaaaatacaaaaattagacgggcgtggtggtgcatgcctgtaatcccagctacttgggaggctgaggcgggagaatcgctggaaccggggaggtggaggctgcagtgagctgagagatcatgctactgcattccggcctgggcgacagagcaagactccgtctcaaaaaaaaaaaaaaaaaattatccagtgaatggcaagatttgcagaaagcctggcatgggtccgtatattccagtcccctgtgcaagccttgtctggagtctctgtactctacggtgtgaatgcatggaaggggattgtctcctctgacccctgactccgcccctctctgcctcacccttccccaccagcccggtgtacgagaagtactgcgccgaccactttgccgacggccgctgcgaccagggctgcaacacggaggagtgcggctgggatgggctggattgtgccagcgaggtgccggccctgctggcccgcggcgtgctggtgctcacagtgctgctgccgccagaggagctactgcgttccagcgccgactttctgcagcggctcagcgccatcctgcgcacctcgctgcgcttccgcctggacgcgcacggccaggccatggtcttcccttaccaccggcctagtcctggctccgaaccccgggcccgtcgggagctggcccccgaggtgatcgggtgagtgaccccacctggaaaagccgtggtggctggggagaggagagatgctgttgatccaggtcttgtgtgtttcatttcacttaatgcctttacccaccagatgtcaggagcaccgcctcctggctgtgacaagcaaaaaatgcctccagatggagctagtgcttctggggtagaattgcccag

SEQ ID NO: 91069 - DNA, 1005 bp, Homo sapiens
tggggtgtttttttatttgtttgtttttttgagacaggttctcactctgtcacccagacgagtgcagtggcgcgatctcagctcactgcaacctttgcctcctgggttcaggtgattcttctgcttcagcctctcattatagctgggagtacaggcacccaccaccacgcccagctaatttttgtatttttcatagtgacagggtttcaccatgttggccaggctggtctcgaactcctgatctcaggtgatctgcccacctcggcctcccaaagtgctgggattacctactggtagtgcgctgaacatctgtgtgtgtccttttgtgctggggttctttgcgtcttcatgggtatgtccaggtgggtctgtgtcccactaagctgagtgggtccctctcttaccccactgaagtgtcttcctggctacaatggtgataactgtgaggacgacgtggacgagtgtgcctcccagccctgccagcacgggggttcatgcattgacctcgtggcccgctatctctgctcctgtcccccaggaacgctgggtatgccagggccagggttggggggacaggatgagaggctgtcttcattccctcttgaccacccctcgtttcttcccccaggggtgctctgcgagattaatgaggatgactgcggcccaggcccaccgctggactcagggccccggtgcctacacaatggcacctgcgtggacctggtgggtggtttccgctgcacctgtcccccaggatacactggtttgcgctgcgaggcagacatcaatgagtgtcgctcaggtgcctgccacgcggcacacacccgggactgcctgcaggacccaggcggaggtttccgttgcctttgtcatgctggcttctcaggtaagcgttggcgaaggggctggcctgggaccccgcctgtcattcccccattgtggctgatctacatgctcccgctcgctcaggtcctcgctgtcagactgtcctgtctccctgcgagt

SEQ ID NO: 91070 - DNA, 1098 bp, Homo sapiens
ctgcctgtgccgtcccggctacacaggagcccactgccaacatgaggcagacccctgcctctcgcggccctgcctacacgggggcgtctgcagcgccgcccaccctggcttccgctgcacctgcctcgagagcttcacgggcccgcagtgccaggtgggtggagttactggggacctgggggaggagcctgcctgggatcctaggagggagaagccaagtcggggcacagtttctcccagactaccccccaccccacagtactgactctgagtgcttcccctccagacgctggtggattggtgcagccgccagccttgtcaaaacgggggtcgctgcgtccagactggggcctattgcctttgtccccctggatggagcggacgcctctgtgacatccgaagcttgccctgcagggaggccgcagcccagatcggtgagtgggagcatgtgggcgggcgtgtggggccttgggaaggggctcatgcacgtacctcctgctagtgtgagccgaatgggggtgccacagagcctatggggcatgatggggtgtgtggctgagtggtgtgggtgtgtgagcatgtgacaactggccgggatggtgtgtgtctgtcactgtgagacagcagggatggtgtgtgtgctacagggtgtgaccgagctgctgtgagcgttgaaggcatgtgtgtgtatgtcagtgatgagaccttgcctgctggggggatgtgtgacaacctgatggagtgtgggtgcgatcctggggactcattccaccaaggatgttgaatgatctgtgtgatggaggcagaagggggatgtatggggttacctctgttcctgtgccactctcctctttgcaggggtgcggctggagcagctgtgtcaggcgggtgggcagtgtgtggatgaagacagctcccactactgcgtgtgcccagagggccgtactggtagccactgtgagcaggaggtggacccctgcttggcccagccctgccagcatggggggacctgccgtggctatatggggggctacatgtgtgaggtaagggggcgctccccaggagagggaagaggaggtgggcatgcttgggtgcgtc

SEQ ID NO: 91071 - DNA, 1033 bp, Homo sapiens
cataccaagtcttcaaaatctgaaacccagtatgtattttacatttatagcacatctccatttagtcacaatttcaaggactcagtagccacatgtggctaatggccactgtccttgtcctgttccaagcacaggaattagatcaggcacaattagcagcgtttgcttggcagcttaaagggaccttttggttttcccaacatcctgcccttgccacataggtgaggtttccagataaaggaggggacgaggccacagaaggggatggatttagattcctctgaccaaatgcaccccatcccagttgaacctggtttcctcctgaattcttctcaatccaaggcatatcccagtcagactgggctaatgggggcaaggtaggtgaccagaccgccttcctcctgtccgcagacccatgcctgaacggtggctcgtgccaagacggcgtgggctccttttcctgctcctgcctccctggtttcgccggcccacgatgcgcccgcgatgtggatgagtgcctgagcaacccctgcggcccgggcacctgtaccgaccacgtggcctccttcacctgcacctgcccgccaggctacggaggcttccactgcgaacaggacctgcccgactgcagccccaggtgggcggggcctctgcttggagagcagggactctggcttgggatggggcctgggacctgggacgaagtggggacagcaacgacttgggggagtcctcagcttggtacccactgcggactctgatgactgatggggcagggccagggaaggagcagggcgtctgtttggagctcaccttggagtctctggtgcctgagagggcatggcttccaggtggctctcaccttagggctgaagtccctggtgaattggagctaagggacctgattggcttctgctggggctgcagcttcttgccgagataagggtcagggagtgggacgtccccagcgctaacagcgggactcaggaaggagggcagggcctgtgagggggcggagcctgatcctccctcc

SEQ ID NO: 91072 - DNA, 1068 bp, Homo sapiens
gaggctgagacatgaggatcacttgagcccaggagttcgagactagcctgggcaacataatgaaaccctgtctctacaaaaaataaacacactcccaaagccagattagtcaatacgtagataaacacgcacacacatgcacacacaattagccagacgtggtggtgcgcaactgtagtcccagccactcgggaggctgaggtgggagaatcgcttgagcccaggaagtggaggctgtggtgagctatgatcatgccactgcagtccagcccgggcgacagagtgagaccccatctcaaaaaataagaagaagaagaaaagaaaaagaaagggacttcatggaagtttggggaccagaatgatctggggcaagtcagctcttggttgaggaggcgggtgtcctaatctgcacaagagctgatgcgttatgaaaaagaggtcattgctcgggggtgtgggtgtgctaagtggggtcacgtcgtccctccctggttgtccctgctgactttgttctgagatgagattgcttgtgtactccccagggcccctttgtaacgtggagatcaatgagtgtgcttccagcccatgcggcgagggaggttcctgtgtggatggggaaaatggcttccgctgcctctgcccgcctggctccttgcccccactctgcctccccccgagccatccctgtgcccatgagccctgcagtcacggcatctgctatgatgcacctggcgggtgagggcccttctcagcctcagacactgccccctctccctggcccacctccctggcctgactaccttcccctgccaggttccgctgtgtgtgtgagcctggctggagtggcccccgctgcagccagagcctggcccgagacgcctgtgagtcccagccgtgcagggccggtgggacatgcagcagcgatggaatgggtttccactgcacctgcccgcctggtgtccagggtgtgtacctcaccttccctctgcagccccaccaacaccatgggccttctcatctctcttctcctctactctctcctcccgctatgttagcttcttttttgct

SEQ ID NO: 91073 - DNA, 1554 bp, Homo sapiens
tccccaccccaggcttcagcggctccacgtgtcagctggacgtggacgaatgcgccagcacgccctgcaggaatggcgccaaatgcgtggaccagcccgatggctacgagtgccgctgtgccgagggtgaggcgggccaatgacagtccgacaagaatcaggaggcggggcttgtgggcgacagggccaataacagacttggggagagcttgggggcggggttgtagcaaggcaggacccagtgacagagttggggggtggagccaataatgcatatagactgacataaggctacgtgtggagccaaagtgttgggctgggcacagggtgcctgtaactgaatggggagggcccaataccttcccctggcacctgccatgtgctcccatctccagtggagggtggggcagaaacagggctggaggtggggccacagctgggggcgggatttaactgtgggagagtcttggctagggacaaattctggagcttgtagtggggtggagtggaagtaagtggggggtggggggtggggcctgtattgagctcgcctcctgacagcttgatgggcagggcctcagatagagctgaaccaggattggtccgaggcctcacttgtgggcaggcccctggcaagtgggcggagcctgaccctcttggccccacaggctttgagggcacgctgtgtgatcgcaacgtggacgactgctcccctgacccatgccaccatggtcgctgcgtggatggcatcgccagcttctcatgtgcctgtgctcctggctacacgggcacacgctgcgagagccaggtggacgaatgccgcagccagccctgccgccatggcggcaaatgcctagacctggtggacaagtacctctgccgctgcccttctgggaccacaggtgggaccgggggctggggcagaaacagcacacctggaggggcacagagggtttgggaatggtgcatctagtggggcacagtggtggccactccatgccatgttcctggcccctaggtgtgaactgcgaagtgaacattgacgactgtgccagcaacccctgcacctttggagtctgccgtgatggcatcaaccgctacgactgtgtctgccaacctggcttcacaggtgggcaagtggctgccatgagagggggtccttagatcgagggtgaagtcactcgtctctgtgggcctgttttgcccgtatctttgcagactcttgtccaacgaggttgtccgtgctttgccctgagtctgtgctgtctcattggcataaggttgtttcgagattattctgcaggctgggcgcggtggctcacgcctgtaatcccagcgctctgggaggccaaggcaagtggatcacttgaggtcaggagttcgagaccagcgtggccaacgttgcgaagccccatctctactaaaaatacaaaaattagtcgggtgtggtggtgggcgcctgtagtcctagctactcgggaggctgaggcaggagaattgcttgacctcaggaggcggaggcggcagtgagccaagattgtgccactgtactcc

SEQ ID NO: 91074 - DNA, 1044 bp, Homo sapiens
acctgggaggtggaggttacagtgagccaagatcgcgctattgtactccagcttgggcaacaagagcgaaacttcgtctcaaaaaacaaaacaaaacaacaacaacgacaaaacaatactcaaggggtgtgggccttttgggcagagcaggaagatctgcctatgacttctgcttaccacttcccaggcctcctgtgtcacctggatgacgcctgtgtcagcaacccctgccacgaggatgctatctgtgacacaaatccggtgaacggccgggccatttgcacctgtcctcccggcttcacgggtggggcatgtgaccaggatgtggacgagtgctctatcggtgaggggagctccatcgtctgtgaatgggctgggaaagaggggagaggagggggtcccggccagccacgcccacaccgatcgcactccatccggcaggcgccaacccctgcgagcacttgggcaggtgcgtgaacacgcagggctccttcctgtgccagtgcggtcgtggctacactggacctcgctgtgagaccgatgtcaacgagtgtctgtcggggccctgccgaaaccaggccacgtgcctcgaccgcataggccagttcacctgtatctgtatggcaggtgggtggtgggcgtggcctgggcgggtcctgaggcagggggcggggacagagaagcccgcggatggggagctgagcagaatggggtgtaagtgggtttggagtgggacccttagagactgaagcctggaaggaggtggggtcaggaccagaagggaatactgtgtgattctgggggcttggtcaaatggagtcagtagaacctcaggtgggctgggagtattcttggccttaggacccactcgggaaggggttggggatagagaggcagagtcggggctgctgtgaggtcaaggtgaagcctgcagacaagcttgcagtaagcctgggcaaaggctatggggggccctggggctgggggctggggactggggaaagggcttagtctgaggactggggagaggaggaggggtttgaa

SEQ ID NO: 91075 - DNA, 1367 bp, Homo sapiens
tggccgtggtgtctgccagagttcagtggtggctggcaccgcccgattctcatgccggtgcccccgtggcttccgaggtgagaggggaagagtctggaggggaggtagtcgggggtgtggtcagtcctaaactcaccctgtcctggtccctccaggccctgactgctccctgccagatccctgcctcagcagcccttgtgcccacggtgcccgctgctcagtggggcccgatggacgcttcctctgctcctgcccacctggctaccagggccgcagctgccgaagcgacgtggatgagtgccgggtgggtgagccctgccgccatggtggcacctgcctcaacacacctggctccttccgctgccagtgtccagctggctacacagggccactatgtgagaaccccgcggtgccctgtgcaccctcaccatgccgtaacgggggcacctgcaggcagagtggcgacctcacttacgactgtgcctgtcttcctggtgagtgagccctactcaggagagtcagaggggtgggcgtggggacagcaggccagcccggcggtgaccatccttgcccccttccctgctagggtttgagggtcagaattgtgaagtgaacgtggacgactgtccaggacaccgatgtctcaatggggggacatgcgtggatggcgtcaacacctataactgccagtgccctcctgagtggacaggtgggcactgcggccagagggagcggggaggcaggcctcgggtggacatgcgccaggtggctggactgctgcatctgtgtgccacaggccagttctgcacggaggacgtggatgagtgtcagctgcagcccaacgcctgccacaatgggggtacctgcttcaacacgctgggtggccacagctgcgtgtgtgtcaatggctggacaggcgagagctgcagtcagaatatcgatgactgtgccacagccgtgtgcttccatggggccacctgccatgaccgcgtggcttctttctactgtgcctgccccatgggcaagactggtgagtggccgttttctctgcagggagccatggatggtttttagtgagggcaaataagaagtctgacttgagtgttagaaagattatgctaggctgggcacagtggctcatgcctgtaatcatagcactttgggaggcccaggcgggcggatcactggggtcaggagtttgagaccagcctggtcaatatggtgaaaccccatctctactaaaaacacaaaaattagctgcgcgtggtggtgcacacctgtaatccaagtctctcaggaggctaaggcacgagagtagcttgaacccaggaggtggagattgcagtgagccaagattgcaccactgc

SEQ ID NO: 91076 - DNA, 1444 bp, Homo sapiens
acactcagcacccttacttcctgtctcagcacaccccattctgcacatcttagctctggcagcttcccgagcccccacatctggcataagacagcccctcctcctgccttcccctgctttgtggttcccagggctcgagctggcagggacagctgcagcctcaacagctggggctggggcggggggggggggggcgtgggaactgtggatggggggactccctgcacccgcagagacgcccccatccccatgcagctgttgcctggtggagggagggagggggtttgtcacttgggcctggggttcctgggcacctggctgatcctccaccttccttcacccccacacagcccccccttgcctggacggaagcccgtgtgcaaatggaggtcgttgcacccagctgccctcccgggaggctgcctgcctgtgagtgcctggctcagagccaccagtgggccctgtgtgtgggggcgggggggaggggcgatttgtcttctccctctgcctctgtgttcaccatggatgtctctaccacttcctacatgtgtgtggcttgggcaacctctcgtgtttccccattggaaactgagcaggggctctgcactcttcttggcatgggttcaagtcccacatcatgttgctgaccggctaggaattaaactctttacatctcagtgtcatggtctgcaaaatgggcccagtaatcccagcttcacagttcttggccacctgaggtcacatgtaaagccccccatgaggtaggtattattcaatcaacaaactatcagggaccaatcgcagtggctcacaccctccacacccctcccatctctcaacatttagtggagggggacataggaggcctataatacagtcccacactgccacttacttgcagtgtgactttgggctagtcactttccctctctgatcatcattgcacctgtgaaatagggaatgcttcactggcgactgtgaagggacttaacaatttagttgttagatatcacaaggaaaggcaagaggttgcagggagcagagcagaggctgggaaggagctgagcagagacagaaagagctcagcttaaattctggggtctgggacaccttgagcattcaagctttttgagcctcagtttttgcatctggaaaatggggcaataataactcctgtatgcactcaacatacattaagtgctcagaatatagtatgtgctcaacataggcattattataaataataatggtagggaggcaggaaacaggtgctctaaggagaagtctctcaaggttatgaggaaatgcttggctcctttcatgctatcattaataacagcagttcacgcagtagccattgattgactcattaatgtattcatttattcagcatcatgtgtgccaagtactgggtcaggcccaagctgggtgggtctggggtgat

SEQ ID NO: 91077 - DNA, 1077 bp, Homo sapiens
gcaccctggcctgggcagaggaagcacacctttggatatgggggttcccaggagatgcccccatcctgtggatagtgaaacatggcaggagggaatgtagctggtgcccaggccaggaggggtatctagtaccttcacagacccaggcaggcagcagtggcattcctgaggcttgtgtccctgacctgggtatgtgtaggggtgcaggtgtatggggccaccccaggagcaggccttatatctctcccccaaccctcccaccccagactattccctgcaccacatcagccagttcttccgttcccactacatgttcctgttccagctgccctggctgcccgagaagctgctgtctatgtctgactttcaggtacagagggtgcaggttgaagggaggagggaagcaggtcggggctgggcaggctgggcactgaagccagagtcctgctgtgtacctagattctgaagaccaccctcacccaccgcaagacaggcatcccatgcttgacccccagcgagctcgaggccttcctttataacttctcacagcctggtggcctcactgggcccctcaactactaccgaaacctcttcaggtgagaccagttgccaagcataagctcaggagatttgcaggggcaggggggtgggaggcaaccatccttctgcctgtctgtctgcctgtctgtctgtcctggccacaggaacttccccctggaaccccaggagctgaccacacccacattgctgctgtggggggagaaggacacttacttggagctggggctggtggaagccatcggcagccgctttgtgccgggccgcttggaggcccacatcctgccaggcatagggcattggatcccacagagcaacccccaggagatgcaccagtacatgtgggccttcttgcaagacctgctggactagtggtccttgctggcctgcccaggaggcatggatactcaggaaggaacacacacccattatctgtgtgtgcctgggagtccatacaatgtccatacatgggtgaactcttgaatcgctcataggcatgggactcctggatcccacaca

SEQ ID NO: 91078 - DNA, 1007 bp, Homo sapiens
taagccccgcacaggacctgctaggccccgcccatttatttcccccctttccaacctcttcctccccagcctccgcaccctacccttgtttcctgtccctgtcgcgcccaggtgtttacctggcactcaggtgagtggtgcgctctggctgttttctgtcggagccgcccgcctcttccttcagcgcgtcccacaaatcccgacggcacggaggggccccaggccaagggcgatgggcccctgagccctgacaccgcttcgccgctgctgcaggtgcccctggccggcagcgccgccgtggtcccggagcgcggcgacatgccggagctggtggtgaccgcgctgctggcgccgtcgcgcctgtcgctgaagctgctgcgcgccttcatgtggagcctggtgttctcggtggcgctggtggccgcggcggtctacggctgcatagcgctcacgcacgtgctgtgccggccccggcgcggctgctgcgggcgccgtcggagcgcgtcccccgcctgcctgagcgacccctcgctgggtgagcacggtttcctgaacctcaaggtgatcgcacgggggcgctatcggggctgcggggtcgcgtggggtcgagacggttcaagcctcgggagagagggttccccaggcttcaggctgtgccctccccctagagctcgggcctgcgtctgcactatgtctcggctggacgaggtaacggacccctcatgctgtttctgcacggcttccctgagaactggtacgtctggggccaggggcctgaggcccacgggactcgggggcaggtggagcttgggctcccaagaggcagggaggagggctgtatagatcgggacaagctgaacatagatggggataggggtactgagccagcatacccaggatccctaggccctgaagggacaggacaaaggggtattgaggttgattgaagttccctggattcagggtgtagctggcttcagcctcagcctctgcctctgcctgggatt

SEQ ID NO: 91079 - DNA, 1119 bp, Homo sapiens
cccccaaaataggatcctcaccccccatgcacatacacacacattcctgtccaagaaagcccacaggtggctgctctgcctgtgtgtccacttgtgtatgtacatgccccagccacaaggcacgggtgacgcccaagaagagcccctaagatgtaagatacaagtatataatttatatgtatgcagagacaaactgattgaaacatttctagcactgtttattctcctacatcccctctttttgacctgaaaggtcctttattgtctttggatctgccaaacctccctgtgagggtgtggttcaggcatccagccagaggtccccccacttcttcgatgtccatgcccactcaggcactttctcatataccactgtgccacttcaagtgtgacgtatttaggttctttggggtttcttccatctcatcccacccactcatttttgttccttgttttgttcagacacttccccagcctgggtccaactgctgagctggatagttttctctgcagcttcctgctgaagatttaactcagccatggccttctccacacctccctgatgggtgtctctctacctgggttgtaattagaactgggatctatttaatttctccagccatttcccaacccttcccacagtactagaaatcttagtcctataccagagtaagaggtgtgtacaagcccccactgtactgtatgcacggatcgcttggccaataattatgtcagtgaatctgagacttgtattaaacactttagacatttgtagaagggaattcgtagacttttcacttacatacgaaaggtttttttttttttttgtgcagttctcattgcaaaaataaacatttgtactgagtataaagttactctcctgtgatggctgctttttgtttgagggtagacttgggagaagcggggagatgagggcggggggtcagtgatgtgtaggagaggaagaagggaggttccccagacacccaccacccatgcgtccagattagcggagtcggttgggagagatcctgggaacatcaaattgtgagataattgatttaatggaaggtgtaaaagaaaaagctgccaggcacggtggctcacatctgtaatccc

SEQ ID NO: 91080 - DNA, 1596 bp, Homo sapiens
gcttgtagctgcagggtggctaggtcatcctcctgactccctccttcctttctcctccagatggcagctaccattgacatgaatttccagagtgatctattgtcaatatttgaagaaaatcttttctgagcgcacctaggtggcttctgactttgattttctggcaaaacattgactttccatagtgttaggggcggtggtggaggtgggatcagcggccaggggatgcctcagggcctggccctcctgcatgctatgcccggggcaggcctgacgggcagctgaggattgcagagcctgtctgccttacggccagtcggacagacgtcccgccacccaccacccctcacaggacgtccgctcagcacacgccttgttacgagcaagtgccggctggacccaagccctgcatccccacatgcggggcagaggcccttctctccgccaaatgtctacacagtatacacaggacatcgttgctgccgccgtgactggttttctgtccccaagaacgtgacgttcgtgatgtcctgcccgccgggagtctttccccacaccccagccatcgccgcccgctcccaggaggccagggcaggcctgcgtgggctggaggcgggcgaggccggcccaccccctcgctggcactgactttgccttgaacagaccccccgaccctcccccacaagcctttaattgagagccgctctctgtaagtgtttgcttgtgcaaaagggaatagtgccgtggaggtgtgtgtgtccatggcatccggagcgaggcgactgtcctgcgtgggtagccctcggccggggagtgaggccaccaaccaaagtcagttccttcccacctgtgtttctgtttcgtttttttttttcttttttttctatatatattttttgttgaattctattttatttttaattctctcttctcctccagacacaatggcactgcttatctccgaaatggtgtgatcgtctcctcattgagcagcggctgccaccgcgctgtgggtagtgtgtgaccgtggctgtactgtatagtgaacatagttggcatatctttgtttgaagtttgttggtgactccaccaaactggtgtgaaaaaagaaaaaagctcaaaaaaatccacaaaaagacaaaacacacaaaaaaaatcctgcctatattttactcagtttcaaactttattagtctatttttaattataaaaccagaaagctacaatttcttttctttcccctccaccccccccccccccacccatttgttggcttttttgttttttaatgtcagatctgttgagttggtttttttggttttggtttttgtttttgtttttgttttttactgagaaaggaagggccaagggatgaggtgggaaccgggccctgggggcgccacagactaaggcagagactcccctacctggcgcccagccccaaccagctggccgctcctgcccatgcttttttttttttttttttttaatttttataattggagcccctggtgaggttacgcgtgccatgagaacccactctacaccacgacgctggtgcctcagtgttggccaaactctggagtcactgactgg

SEQ ID NO: 91081 - DNA, 1049 bp, Homo sapiens
cataagcttgctgtggggctggtggaccatgccccactggggtgaggtgggccagggcccaccggctgtttatgttccagggccggaaatgaagcctgtggatgtcgggaggcctgtgatccggcccccagagcagaacgcaccgccaccaggggcccctgacaaggacaaacagaaacaggagccgaagactccagttgcgcccaaaaaggttgggatggaggtccatgggtgtcgcttgccccttggccctggaaggtgccatgctgggcacacccccagctatgccctttaggcacagcagacccctcacccaccccaacctctctgttctgcaggacctgaaaatcaagaacatgggctcctgggccagcctagtgcagaagcatccgaccaccccctcctccacagccaagtcatccagcgacagcttcgagcagttccgccgcgccgctcgggagaaagaggagcgtgagaaggccctgaaggctcaggccgagcacgctgagaaggagaaggagcggctgcggcaggagcgcatgaggtgggcgggtgtctgggtggggcatggggactcttggggccacaccagtccccaggctgactgggaccctctgcccaggagccgagaggacgaggatgcgctggagcaggcccggcgggcccatgaggaggcacgtcggcgccaggagcagcagcagcagcagcgccaggagcaacagcagcagcagcaacagcaagcagctgcggtggctgccgccgccaccccacaggcccagagctcccagccccagtccatgctggaccagcagagggagttggcccggaagcgggagcaggagcgaagacgccgggaagccgtgagtctggaggcctggtggggaccctggtctaaggattagctcctgagggagctgggaaagggggactggagcctggacagggaggggcagcgggggagccccgtccctgctggtcggcatgtggtcctctggactcagctgtagggccctgagtgctgtgtggacggggtgagcgctatgaggggt

SEQ ID NO: 91082 - DNA, 1060 bp, Homo sapiens
ctgctggatccttcccagccttgggttggatgcaggtgtcaggctggcctgtttcctaagagacagctccaggcccttttccgcctgctccccactcggcgcaggtggaggccaattccaggcttctctcttccgtgggggcgtgcaggctgagtggggaataggactgtggggagggtcctgagcatccccacccccaggactgggtcttgcaccccctgcaatcatccaggtgggccaggctagttggcaggaacccaggctgagctttgtgggtttaaaaagtattagggcccaggccctgccaagcccacatgtgtcaggatctgtgttttccacagtatcccagatgattctgatgcacacaggagggtcaaacaccaggactggtgccacagggccctagaaagctctgctgcacactgagttatgccccacatgcagggggacacagggcactcagccctttcggggaggggtcatgtcctcaccaggcccagtcacttgtgtgggtcttcaccctttttgagctgggctaatggacccttgtcccagggcctgggcggcacatgcagtttctccatacagcccacgttttccttcccgacaattctctcagggccagcagttctaagccagccccttgacacattccttgtcccttctcctaggtcacctccgcgaagccccctccccgcttatgatacattccccccagatgtcacagttccagagcctgacccaccagtctccaccccagcaaaacgtccagcctaagaaacaggtaactggcagggctgggccatagtcctgtgggctagggccgggggtgcctgcccacctcaccggccgctgtgcctgtgccatcccaggagctgcgtgctgcctccgtggtccagccccagcccctcgtggtggtgaaggaggagaagatccactcacccatcatccgcagcgagcccttcagcccctcgctgcggccggagccccccaagcacccggagagcatcaaggcccccgtccacctgccccagcgtgagtgctctccctgcccacagcc

SEQ ID NO: 91083 - DNA, 1112 bp, Homo sapiens
tccccctaccttccgccttctgccccgggtcccctccaaggtgtgcccagcatgcccccagacagcgcggctccatcacctccttgtgccaggagagaagccctggccttttcttcccagttccctagtgtgcagggtccccctggtcctgtggctgccaacctctgcagccagcgctcctccccccaccaccacagcagtcagactccctgttgccctgacactgcaaatctactcaagctttcccttctggcatgtctcacccacaacagtatctctctcatcagatgtcatactctgacccagagcgtcctgagccctgtatgcaggttttaggcggggccccaggttcccccgtgtccccagttgcagcccctggtcatttgtacgaggacgtgtgtctgtagctgctgaggtctgtgtctgtgtcttgtctggcgtggagtggtgagctcttacagggcacaaggtccttccccatcccttttggtggcatgctgcactgagggccacgtgcctcacagaagcttagcgtggccctccacgaagcagatccaagtggaaggagcctggatttgggcaaagcatgtgtcctccaacaccagcagcaagaggcagcaccctgacaaggagctcaggcgaagccaggcagtgccatgaggtgcttctcagtgacaggaatccaaaaggcgccataccatgggcccggcctcccatctggtggcaggcgactgtgacctgccagcccatgagcactggccagggctcatgtccccctgtggggcttgtacaccatccatgtttggtgaggggacatccaactggcaaaagtcccttagtgtaaatctctggggtgaggacagaggtgggcacgctggctctcgagtacacctctcaggggcagacacaccctggacccatccaccctactgtggtgccaagccgtcggcccacacgagtgggggcgtatgctgccttctgtctgcagcatggtgactgtgtcccaaagcagggacttctgaggtccatctacctctttagtagctggtcattcccaggaggccagcctgctccttttttttctcccggagtgggctctctgtgttttccct

SEQ ID NO: 91084 - DNA, 1078 bp, Homo sapiens
ggacctgccaggcaggcactggtgaagggccttgggcctatcatccccccaaccccacctcaccccacccgcctcctctagtggggtgagtctgggctggtggaccagagagggtgtcacagaccctcagggactgccccatggacacctctgactggtgttaacagtgtgaacattttccccgtcttcagtcccttagaatgacgacagcccctggggttggggcaggcgagtgtggccacatcatccaagccctcccagagacacaaataggcttttttgctctaaaaataaataccagcccttttttggtcacaaatccagcatctcagcagaaaactgcctgacatgaaaagtcccctgaggaactgcatctgcgtttcaggggcttttcattttttctccttttttaaagtgtagattgtgggtgcttcctagaggcctgccttcttctggaactggaagtgggctatcaccatgggcaagcccttgggtgcaggctccccacctgcctgggaactctggcagctctcctcagctccttgggcttgagcagctgcaactgccccagatttgctgtggaagcaggggctagccctggcctcaccagggcctcccggggccctgcattgatgctcaggagttcctgggctgctcttgatcctttctgggcatccagcttccagttaagctctgtttgccaaacaaactattctcagctgccctttggcctgcgcctgatgtgttcctgttgcagtcccgcctgcctgagacaggagcaggcaggagagccttcatgcccagattcccacaggacaattggggagctgctggcattgtctttctgggaagattctgctttcttggaccaaatggcagcctgattaccagtgtcgggcctgcatgctgcccccgacacacgcacgcacgcgcacacacgtgtgcacatgggccatagccacaagccagctctcctccagggtcctttcaacctcgctgtccagggaccctgtccttcttgcccgtggggcttccatctggcagagaacgttcagggcttgttgaacttgaaagctca

SEQ ID NO: 91085 - DNA, 2104 bp, Homo sapiens
aaagattgtgcaacaagtaatctgagagtcctgggaacagctgtcctggcgggaaggagggcgagatttacagtctcagagccgctggctcccaggctcccaggctctggcggtccagccctggccgctcatgcagctatctgggctctggccttcccctcttcccaggcgccctccccaccttgggttttgcctggctcccttttgtcttcccaatcctggccagcaggggctttcctttgccttctgtgtgcactgagtgagctctgtcgtgggccggcagggtgcttctcctctcaggaggggccgctgcgagggtttcgtacggcagatcccgaaatgggaacccacaccctggcaccagtaaatacagccttctgctgccctgtcccgcacaggactctgcactctcagggcggggggcagagggggcgtagctccttcagcagctgctctcctgggtccaggaatcccggcagccctgatgtccatggcccgttacaggcagctctgccttaacgggagtgggtcagggtgggggaacattatttccctttggtcttttggtgcctagttgatttgcaggcccgcgcccccgcccccccccccccccccgttcttgtgtttccatttggattggagccgaaattcctgaaagggcctatttttgtcacttatactacggggttagttccgctgacaacggccctgagacatgaatcaccagaagaaaacgaatggagtcactagattgaggctggggggtgtgatacatgaacacccctcttggtagctatccatagaccgggatgctgtggactgatgcaggcgtggggtggtcctctggggccaggctctagttcagggagcaacggaacacaggcaggaggaggatggcgggggtgggtgctgctttcccagctgtgtcccaggccaccatgtattccccaccctctgccccagcagcatgcagtgcagtgggccagccctaccacttcctctgattccagctattgcttgggctgtggtcttccattgagctgtgattccagctaaagcctggagctgcttgaggattctgtattgagacaggcaggggtagggcacaaatgccactctcccaccacccctagggcatctgcagacctgggtggagcaggctggaggaagacactgtcccaggtgggctgtggacagtactgtggctttgctgtcattagcactggggttaggtctgccaagcacatggggcagggcatgtcctaggaatcttctagctttcacttgtcacatagctgacatctggttcttcccaagtgtcatgcacaggtctttgtgagcagaagtgtccccacagcttatgtccctcttaggaatacccgtttaacctcagctacctgggctgggacagggtctcagggaggtgtgagagatcctcctgggctttggtctggtcgtctagttggaacgggagcgcagtccagctattttagtttcctggcttccttttcccaggattggagcatgtgggtgtttcttaatagctccaggggaaaaaggaatgcttgatgttttggaaagatttgagctgggaagtgcagacagaggccatggggcgttcttaccacacaaccagcctcagcttcctgacccccagggtctttgagggacttagtccatctccaggcctgctgcttgcctgctccagagtgtggcgcttacctaggggaatggtgaggaccctggaggtgggggagtaggaagagacttgaagatagggcagtagcctttctgtctgcacagccaggtgactccccccacaaacagccagcatttgcagctggagggattctggggcttcatgggcgggtgagggcgagccttgtggaatgtggcccagagtgagaggccgccagtgggcgggtttttcccatgcccgcactcaggggccagggagtagcacgtcggttgcatccgtgactccagcagaggcatccgctctgctacgtgggtgggaacaagcccagtgcccctccctggtccagggagccatgttggataccccaaaaaaggaaagaaaggacaagactttattccttagcct

SEQ ID NO: 91086 - DNA, 1780 bp, Homo sapiens
ctcctggggtccttgggcccctacctggggcacaccacatgatgattccagcgtgcgtctgaacagctgtgctgagagacccccgggggtctctccctgccttgcgttaccttttggcagcatgttccttttggatcttcttcttcccctgctagaagagtaactgggagaatccaagccttatgcccagcggtaccttgtgttaggaaattatccttctgcctggtctcttgaatccttgataaaccccccaaaggagactttttgagagattgaaggaaccttgaaattccattgtaagcagtctacccatgggaactgtgggaccacgtgggttctgggagtggcagctggcagttgggagcagcccctgggcccaccgtgcacaggctcctcactggtccttcctccagatggatggggtgtgcccatggcttagagcggcttcctgggccacagccctgcctgaccagctcccattgcttggattgcagctgagaaagttgatgtgattgccggctcctccaagatgaagggcttctcgtcctcagagtcggagagctccagtgagtccagctcctctgacagcgaagactccgaaacaggttaggtgacttgtgttctacgtgtcttaccaaactcttcccacctgtgcctggcactagctcggtcctgtgtccaggatgctagagcccagagacggcactcccagaacttgctgggttcctctgtctgtctgtctctttgttaactgtctccctggggccatgaatagccctgcactctgtgcagtagtgtccattctctcggcctggccgttatgctctccctgccagggtctggtcatggaggatgaatggccaagggcgttgacactgcggagccctggatggtgggcggggaagctgggccatgaggactgtgggcgtgggggtccaggctgtgctgttgaccttgatgtgaccacacccagctttctgcaccagtggagacttcgtgtccccagggccttccccgtatcacagtcacgtgcagtgcggccgcttcagggagatgcttcgctggtttctggtggatgtggagcagactgcagctggccagccgcatcgccagtctgctgctggccctgccatcacctgggccccagccattgcctacccctccccagagtgtgctcgttgctgtgttggctgctcctgaatctgccctaactccacacgcacctggacttgcgtgtccctcctgcagttctaactaacagtcccttcttttcaagccccgtgggtctgcacgttggaccctgggttccccattagagcccaccttctgagcagcagcctcagtgggaggtggaggcaggtagtgatgctgggtgccaggtgggagtggagaggggactgctctcctccaagtgtgcactttcctcattattctcaggggcgcagatgctcaggctggcgcaggggagaggctagggagggagccatggtgcccagaaggcctggcgaccagcccctgctgagagatggagctaacatcctgtgtttacggccaacggggttgccgctaggctggtgcagctgtcagtgagctggcgtgctgcagaccacctgagagctggccctagggtctcaggcagactggggagtggggatccacagtgggaaacctgtgttttggcagtagactcctgcatgttctcccacgggcctgtcccatccctgggattttattctaactagaaataaatgctaaccctcaataatcagtgcatgtaaat

SEQ ID NO: 91087 - DNA, 1113 bp, Homo sapiens
ttgatcctttcagtatctggaaggaggaggttgagccaggatgttcgtctctcctggggctacctgtttgctcctctccctatagccagtcatcaggcccttcgtgcctgacgtgtccgtgtgctcttacttagattcttaggggccctccttctgcgatcaggatggccgtgagacttggtgtctgtcggcttgatcagctcctctggtgaggaagacactggcagtctttggagttgagtgaatgggtggagatagtcttgttaggaatctggttaacatgacaggcgcaaagctgggggccttcccttcccctgcctcccctatgcccacaccctgatgccccaggtgcatgctgtcgcatgttttttggagcagacgcctgggtcttgggtgacaggaaggtggtttcagccctgagtgtgtgtcttgcctgtctggtctacagctcaaagccgtgcacgagcagcttgcagccctctctcagccccagcagaacaaaccaaagaaaaaggagaaagacaagaaggaaaagaaaaaagaaaagcacaaaaggaaagaggaagtggaagagaataaaaaaagcaaagccaaggaacctcctcctaaaaagacgaagaaaaataatagcagcaacagcaatgtgaggtctgtgtcccctgaatttgtcctgggtggggaccctccttccagggcttgctctgagactgtgtgggccactgcccctccctgtcctcattgggtgcggaggctgcccctctgcagccgtggcttcacaggccaggctggtggccacttgcacacaggacttagctgcactgtctctgcctctttctgtaggatgagccttcggagctcaccatgtttggttggggaggataggcggcaaggatggggctgtagtgcatcccccacttgggcagcctccagtcacagtttgcttcggtctccactgggtgctcccagagattgagttgcccatgccccgtttcctgtgaaggctggtgggtggggggtatgggaagggcaccccttccccccaacatacatgtggaggaatgagtgcctggcttcctcagggggcccgttcttgatggtgtctgcatcgtccct

SEQ ID NO: 91088 - DNA, 1050 bp, Homo sapiens
gcagcagtccagctgccccctgtggttccaggaggtgggggcctgccagtttccagaaaccttggcaagggcggctactgccggctccctgccagaagctcttactcagaaggcagtgcttctgggaacaagggcagctgtgcctggaagctctgaggagtgttttcccgctctctgtcccctgtcagcatgtgcttcctgctccttgagcctgggcctccaggcttcatgaaggggtctttgtgcctgagttgggagttgcagccaggacgccctaggaaatgggaagtgcggttttctgctgttctttgagccccagggacaggtggaagggtttggcagagtggagtctgggatgttcgtctctcaggcaaatgcaacacgcgaatgtgcgttcactgtgtgtggtgtatgtccccacgaggtcagccagcatgtggatgtcagcatggtctctaactcgccgtcttattatgatttgtagggacagcaaaacctggcgtttccacggtaccaaacacaactcaagcatcgactcctccgcagacccagacccctcagccgaatcctcctcctgtgcaggccacgcctcaccccttccctgccgtcaccccggacctcatcgtccagacccctgtcatgacagtggtgcctccccagccactgcagacgcccccgccagtgcccccccagccacaacccccacccgctccagctccccagcccgtacagagccacccacccatcatcgcggccaccccacagcctgtgaaggtgagtctcctggactctggagggctgcttcaccagggaggagagcggccctgtccttgcccgtgctttacacagagcctgtcctgggtcccgggcactggtgggtgtttctggggagatcttgctgtgttgaaattgcagcccagaaacagccgccccactgactcaaaggtcccataattgtgtcacacctcctagtgggttcctgccccctgcacctcttttatttagactgtgcatatttgcagatgggccatctaaatagtctctgaattg

SEQ ID NO: 91089 - DNA, 1789 bp, Homo sapiens
gactgggtgtgggcttttttgctgggaggagggtgctggccatgttgaacttgcaagctgtccttgttagcctgaagcatgtgcttctggtgcccttgggattttggttcctgagcatgtctagtagagaaggtgtgaggagaatagtggcgactcatgacaaagtccatttgggtgatgtaaattgttaggaaagagcctgctaaaatgtagttgtgcagaggtgtgcccaaacagagacctccacgtgagagagggtgtgatggggccggcgcagagctcagttgctctgtgggtgatggtctgctggaactgtggacatgactgtcaataactcttggccatagatgaagtgtccccccgatcctacatgtagacctgaaggtcacttcctaaccccgtagccaaacctttcggctcggctgtgccatgaagccagatcatttgtttacagttcagaccacagatgtgattaaaatcaaccctttcaaatagaacgactctggagggagacactatacagaactcagcttttgacctctgctggtgtagtgggtaaaaatgcccagaagagatgggtaggtgagtttcttgaagtttactgtgttttttaaagtctcagctctcaccacttaggtttgagcaaaatgtgcagaccaggctctcagtttagaactgagtgggaacagcatgttatagatgaggtgacagagtgggacccctcaactagtgtgagatgtgcagtgcccagagtcctggtgagctgccatgggggtacgttggggagcattgctggggccctgctaatgtatcatggcaagaaatcctgtgtcattcacgtatttctggtgaaattgaattgtgtcaaaggagggcccctttcagtgattggctgagcttggtagatgcttaaggcattaggatggcttctcagataggccagagcttaaaagatgagggaggtgcaggtagacaagtgtaggctcagcacacctgtgggaacacaagcctctgtgatacctggtagtgtagccattgtggctcctttgggtgcagatcggggaaggacccggaatacgacgcttcatgttttgggggcagggggtgggtggcatggggtgccctgtctacagaggtggggaggggagggccctctgactctacccctgtgtctccttatccagcctggagatgacatagtcttaatggcagaagctctggaaaagctcttcttgcaaaaaataaatgagctacccacagaagaaaccgagatcatgatagtccaggcaaaaggaagaggacgtgggaggaaagaaacaggtagagtactgaaatagcaagtaaattggctttctccccgacctttgtcccttttccaagtttggtggggggctgggagtggcaggaggatgtgacattatatactgcatgccgtgttggtgtttggacatgtgagattgggtttggtgttggatccatcccatagggtcatgtggccctgtggcctcttctaagcagaaataattgggccctgccttttctgagggtaggtgatggacttagggtaaaaggaaagtgtaacttctcaaagcactttgacgtttgttgaacacttcaccctgccagtatcataggtggtttttacttttccattttaaggacattaacatgaccagaaatcattttaactaacatctcagttctaaactttgaggtttgtgattggaattaccttaatgcactggtgtcagagttatccctgcttctgatgctcagtcatctgaagtga

SEQ ID NO: 91090 - DNA, 1170 bp, Homo sapiens
agcggccttagcctctgccaggcatccttactcccaagtttaaagtcattgtgtctgtaagaactgtctggtgctattgcttcactgaatacgtgtcaagcactcgggggaagataatcagaacagggcagtacgtgtctgggtcttgaaatggctcaggaaaggtatggaggcagaagaggcgccacgctctccattgaccaagatgaggagtggaggcagtcagctgtgttggcctgcgggagggagactgttgggggagctcactgcaccaatctctagctgggctggacagggtccatagttgagagtgaaattctcagagcagatgcacagaaccaggagagaaggaactggggactggagtggaacccagagcgttgtgaggcccttaggggttggagggaaggcagaaggcctacagaagagagcatttccccagattccaacatcagaagctacagggaggtcaaagagatgaggattccgacctgatcatcctgttgacctttaggagggcattggtgaccttaggaagacgtgacacagaagtagaaaccagattgcgacggtgtgaatgagaaggtgaggatgtgaagccaccatttcaagaagcttggctttgaagggaaacgcatcagtgccagaatagcagaggggtcagcttgttacaagaaaacgcagtgggaactgaagcagggagggctgagaaggtgaagacaggagaaggaagggctgggggacttgagattgccgagaagcagcagcatcccagttgaggttgagggaacagtgctggccagcgggacagacaagtatgggtgattggttaggccatggggtttgggagttcaaggtcagtctctgaagtgcaggctggagagtggccaggacgttcttggtccaggcagagtgtgaatctacctgtccctatgactgttgacgtcgccctcattagctctgacataagaagaagggactgatccatggtggccctgatctgatgtcttcagagatgggagagtgaggagctgaggaaggagcttgctgagtgagagtggtctcagggcatttggtgggggctgagccaaaggggatgcttgatcaggagcatcatcatgctaaatctgtattctggggacttccttcttcaggagatgttaataaggc

SEQ ID NO: 91091 - DNA, 1276 bp, Homo sapiens
tgctcgatgctttgtgtgtgataaatgcaaggagttttaatgtaaatgtcatatgtgggagcctgcacatcatccccttccacacacaggcagcatctcctaaaaactcacaggtgggaaaagggatgtgcaggtttgtgagacgtggcttcattgtacatccttccccatgaccttcatagttcccagagcctttgctggctcctagtgggctctcaccacctcactctgcctcctctgttggtttgtggtctcctccctgctggagggtaagtctttggggagaggagacattggaaccctttcagtcaaagcatggggtggtccctctggccaacttggctagctaccgccagggaactcagtccttggagaccacagccagagggacttgtcattctgagcggtgcccatctgctgactgatatctcacgggggctcttctcttcctttgtagagtgcctggtgaagaatgtgatgggatcactagcatgtctgcggagagcggccctgggacgagattgagaaatctgccagtaatgggggatggactagaaacttcccaaatgtctacaacacaggcccaggcccaaccccagccagccaacgcagccagcaccaaccccccgcccccagagacctccaaccctaacaagcccaagaggcagaccaaccaactgcaatacctgctcagagtggtgctcaagacactatggaaacaccagtttgcatggcctttccagcagcctgtggatgccgtcaagctgaacctccctgtgagtagtgtgggcagggcccagggtggccgtcctggaggtcgtctcctgcatgtctcctggtcagggcagttcctggggggagggtaggagatgcatttggaatcatggtgagagctgcagggcccttgagtgagtggtttcagcagttctgatcagttgaaatcagggagaaagaatgagctaattggcttaacaataactggtttcttagatattggaatcctggggaaaattgtgtagaggttgaagcagtgggagaaaggaaggcccacagatctacttccagttccatggtgagttgaagtcagagcacttggccatcctagccccttcatttctcaggtgtggacatagttgatcaaggataagtagacgtagttgatcaaactatgctagaggggaattggcttgctgcagtagtggtcacctagcatcatcgtcactgtcacccggagcacacggtggggaaagatagtgggattacctcgcagggagtg

SEQ ID NO: 91092 - DNA, 1037 bp, Homo sapiens
cctgagtagctgggaccacaggtgtacaccaccatgcctgggtactttttttttttttttttttttggtagagatagggttgcactgtgttggccaggctggtctcaaattccagacttaaggtgatccacctgccatggcctcccaaagtgctgggattacaggcgtgagccactgtgcctggacaatctttgttttattacagcaacttgctgatcaagtgttgcaggctgtgacactgttgaatatagtgcaatctggtgttgaaatgatcaattgccttgtgctgatagttcctgcaatgccatctgagtttaccatgacatccccaaggcacctgggcactcagtttgggaactacagcattgtctaaccttgcttcatccttttcttctacactgggaacatgatatagggtttctgttggaagtagatacaaaagtaggacatcaagttcgattatgtagccgcctttggattggaaacaataagcgaaattcttttccttttccttgaccttcagctaactcttaacgtggtgaatggtggctcctgctttttggccacaggtcagtatgaaaatggagagggagcagcagtttttaatcttttcaacggaaaactttgaagatgttgtctcctgttatctatgccaggcatgccttctcttgccactgcctgcctgacccccaccacagaagcgcacacactcttcccccgcctctggtctcattctctgtcccttcttcagagatgccgcctgtccctcgggtcagtgcagatccctctccccgtccatggccagagcagccctgcccttctcctccacagtattcaccccatgtattgcctaatcactcgggagaatgccatgtcaaccgctgagtcctagggcaaggcatgttaggacctgttgcctgagcgagtgactgagtctggtggtctccacattatccatgtgagagtgtgaactgttttgcttttccagagctttgagattgagctggaagccccaggatgacaatgtgggtatggtc

SEQ ID NO: 91093 - DNA, 1111 bp, Homo sapiens
aacttgtgatttcatgaggggctgtagtcagttggcattggctggcagtctgtatggaataaaacaaatttaagccatgtcccctcaggcatcttactgcttgggaagcataaataacaacttggtgtcccttccccttgcccccacacctcatgacttcagcacagtggtatgttttagatttcacctatgacacgggatatatctcattgtaagcagatggccaggtgctgcagggagaggtcttggctctgatttgtttacgaggatgaaattctttggaatactactgctagaagtctgacttaagacccagcttatgggccacatggcacccagctgcttctgcagagaaggcaggccactgatgggtacagcaaagtgtggtgctgctggccaagccaaagacccgtgtaggatgactgggcctctgccccttgtgggtgttgccactgtgcttggtgagtggagacagctgtggagcagaggacttgaagcacacactgttccaaatgacgtccagccaaccaggccaccatccactctgcctctgtccccatggggatgatgatgaagatgataaagtcgcagcctgctttttagggttgttgtgtggataactaagccaatacagatgaagtgctcgataacagcatcagctcaagaagtggcaggtacctcctgtggagctcttctaggccctggtgcaggtctgtgtgatgatggcttgcataaagctctgctaagtgtggtttaaccagccatcgtcttggcgactgcttctgccttccctggcgtctttctacctgtgtgctccatcactttaggagaggggtgagtctgaacagaccagacagaatgaaggcaggattactgggtttcaagaggtccgctgggaggccaggacttcaggtagaactgcaaatacaaagtatagctggtcccaacccattggttttctcagtgacttgtgatggacggaactgggaactgaatctccagcaatcagcagattctgggcagttgtttgtggtctttctcttttcctctctggcttgcctttagagtcccagaactaagcctgccctgcatgtctgtatctatctatatc

SEQ ID NO: 91094 - DNA, 1123 bp, Homo sapiens
gctaaggagtctggctttctgctggaatcatttggaaaggtcgtgggagaaacatctcaagcctgcctaggttgtctctttagggcctggcctctggcttagggcactagttgtcagaacccagaaaacagagctatggggcctgtgtcggggagtggggttactaaacaaaggtattttgaggtaaaagacgtgaagcatttctaacgtggttctgtagtttgctttccctaggttgttatggaccaagagactgtagctgactttgtttaactctcatgttcaggagtggaggaggggacttgagtattaacagccgccttgacacagtggggacctggtggctgtggaagcctgaggagtcggtgcctgctcctctgaactttccctcccctcagcagatggtactgttgcgtgttctctctggtgccagtgaaagagctcattcatgccattcacagagtagtgtgcttagaactcagccctcctccatctgcaggggcaggcacccgccacggcttagtggccaccctcgggcgttgacttcctcccttcggcggccctgtgtgtctgctgggcagtgcaccagcctgtgtagcaccagctgctcggctgctttggtaaaaacaagggaagactgtgaagctgttctgtgctctgcacaccagcaggagaagccagcggagggtgtggatgggcttagggcagtgtctgcagttccggatgaattctgcctgtgccttataaacatcttctgggaaggagctgatttttgatgggtgattgtccaagtttataactggatcctgtgtttcactcctcttcttctatttatttttatttattattttttgagatgtggtcttgctctgtcaccagtctggagggcagatcatagctcactgcagcctgaaactcctggcttcaagcgatccttcccagccacccataaatccttttaataagttgcagatgtgatattacctctgtgtacttcagcaaacatttcttaagggcattctctttgaaagcagggactgaaacatgtatttgtacgcccatgttcatagcagccctatacacagtagccaaaaggtattatagaagcaacctgtgtccattg

SEQ ID NO: 91095 - DNA, 1504 bp, Homo sapiens
tgagatgttccagtggagaatgtgtattctctgggtggactgttatcctgttcagtgcataatacggaggcaatgagaagagattaggaaccacagagcctcacttgtgaaagtcataaggagtaggaatttttaaagtgccatcccatctgccacctacatttcttttttccatagggtttaccatctcctaattttagttgttattttcattcttgattgtctatctgttcctgtgaacccacaagggcagatgtctttgtgttgaatctcctgagcccacagtctcccaagagatgtagtaggatgagtcagaactcccagtattttcacctaaaccaggaaaatttcaaatgatggggatactgagtcatccccaggcacctgctgtttggctagcctcaactaggagctgatttgcagtctgttcttcaccttaacaccatctccttataggcctactccaggagcagggcataacaagtcaggagcaggcccagtagacacatgttaggaacaggatcggggtggtggtggtgggtgataagcaatggtcaggtcacagttaccataacccattgacttgggggttttgcagggtctgaagtgccatcatacccacttctttccatctgggaccagtaaaaaaaataccatatgcgtctttaatgcaatagagttttttcttttctttttcatttatgaagaacgctttttaaaacctctcaaatgtttccttgggttgaaatcaaatttataatagcctgtatatcatcccctagagatagcaaaaccaactcatgagggagcctgtgtttatgagggaagagggggtacacttaggttttcgtacatatgggtatgagatggaacacactggaaacatgaaaactgcaggcttagatgagaagcgggtgtatatgttgtgagctttaccatctgaggcagagtcccagcctggccagattagctgtttgcctagagcatctttctaggggttggtgttctgtatgttgaaatgaatgaaattgcttccccagggctggaacacatctgtttgggtggtgttctaggtgtatacttgcacccatttattattaaaggggtggtttgagtttgtactggatttgatgagagtttttctttttcagtactcgtgatgcatttcttcacctgaaagtataatgcattttgatttctatggcaaccagtgaacgccaagggaacaaattctatttctgttttctaacgtaacaggattagtggaggcgcatcaaaaattccattctaagtcagtgctgcgtcttgaagagaattgaaatggtctagtactaactttttaacattgactttgaatacacttttaataatccacatgtcagtcagcttactcttggtgttaaatgtcactcgagcaggaggaggcctcgatgggagcttctttttaatctccaatggatcctcagtgaagtccttagggatttcattttctgggtttcagaag

SEQ ID NO: 91096 - DNA, 1780 bp, Homo sapiens
gcctgtcgtccagatgtgtccagagcagccacagtctctctcctctgctgtgaactgcacgtccagacctttatcagttacagctgcagaaatgcaagggaacaagaacatttcgccttggcgtttatgttttgctcaacacagaaatgtttagtttcagagtatgagaaaatcattacatttgcgaaaactcagactcatggtatgtcctagcatggtgctccatttcttaattgttcctgattgtgctatccaggagcccccagccctcagtctactcattagcctacaaaaagacacttagcgttttggggattccagggaatcgtatgccaggaaacggtgaagaccaaatatgtatttcacaatatcacatgctacaacttggatgaatcttaagacattatgctaagagaaagaagtcagacacaaaagggcaaatattgtgattcaacttacatgagataccaaaaatggtcaaatacatacacaaaaaatagtggttaccacgagcaggaggattaaggagttactgttgagtgggtagagtttctttttggaatgatgcaaaagttccagaggaggataatgatgatggtagcacaacagtgtaaatgtacttaaagccactgaattgtacacctaaaaatggttaaaatggcggattttaggttctgtgtattttacaataaacatttaaaatataggtgtgctttaccccttccgggtcgctagcttggggacaccttactatcagtcatatccactagagactaacgagtggtgcctgcacgagtcggctaaagctcttacactctgccatggcggttaaatttttggctgatttttcttttggcaagaggacatagctgtctgctttcctgctatcgagttgccagctgttgcttcctgtcttgtacctttaactgctactctccttttaatggtctgcttatgatctggtgtcctgggaactgagataagcctgccagtggccttacccggtgccaccctgctgggtctacccagtgccaccctcctaggacttctggtttgggctcaggtagccaggagcccttaaaacaaccactctagtgtctttaacaagcgaaactgtatggtttcaggcttgttttttagcttcggtttttatattggcacctgaggttcagctaatctttttctgagttaaagatgagcttatttatttatttttttctttcagcctggatgtcactgttttgagtggtgctgccattggcctccttgaacttttagcatcgacagtagtcggctgttgtggagacacccaggtgtgcacttggtgtggtctggcaggaagcaccctttcaggggcacttaactccaagaggagttaagagagtaggacattaactaccagcagtgtgagcagagttaccctccttctgttgctgcaatcctttcacatccgaaattgtgagacctaaaactagacttttggtttggggatgtttcaggcttttcttttctttctttctttcttttttttttttttttttttttttttttttttttttttgagacggagtcttgatctgtcacctaggctggagtgcagtggcaccatctcagctcactgcaagctccgcctcccaggtttataccattctcctgcctcagcctcctcagtagctgggactacaggtgcccgccaccacgcccagctaattttttgtatttttagtacagacggggtttcaccatgttagccaagatggtctcgatctcctgacctcgt

SEQ ID NO: 91097 - DNA, 1044 bp, Homo sapiens
ccgcacgcagcccccacaaaggcagttttatttcttccttcccaatctgtgcctctctcatttccttttcttgtcttattacattagttcggacttgaagtatgattgaaaaagagtagtaagaatatgcttgtcttgttccagatgcagggggaaagcatctagtttctcagcattaagtagataccctgtgattgtgataaggcaaattctggccacagcaacagttgggaaagccacccaaggcaggcttgaaattagcaaaaatggaggacacacggaaagccttttgaaggaaagattttagccagatggagtgtcttggagaacaaggtattcccggcagagaaagcctagtgtattgatagaagaaatcgagggtcaggaggccacatgagctagcaacagcaagtgcatccgtgagagagatgcgggaacctgtctctagtccctgggctcttgttagatgcccagtgccatgaggtgctagggatacagtatgcatagacaccagacacacaccgtggcacccccaggctgcagtgggacatggcacaggtttctccagcaagctggttttctgggatgggcagaggttcaacttcaacaatatggtttgttttctgggctgttgcccccttttatggaaccttttatttaatagcaggctaggaaattgtaaacagcacaaagtagtagtatggtgttgagtgtttagacggaaaacattcatagctgaactgtagtttttatcttcattttggagttagtcatgttctttggtctctgaatggccttctgggcgtggggtctgggacagcctgcacacctttcaatatccttgactgcctgctacttcactgcacagggctccagatgcccctcactggctgtctgtgtcccaggcaccttggatgttggccaggccctagggacccaggctctgaggagatagcgattctgttcattttggattagccatggcacccagccatcatttacaacattcttccctgggaacctggcagagaagtcccaatgatt
